United States Patent
Chinnaiyan et al.

(10) Patent No.: US 10,889,864 B2
(45) Date of Patent: Jan. 12, 2021

(54) NON-CODING RNAS AND USES THEREOF

(71) Applicant: THE REGENTS OF THE UNIVERSITY OF MICHIGAN, Ann Arbor, MI (US)

(72) Inventors: Arul Chinnaiyan, Plymouth, MI (US); Felix Y. Feng, Ann Arbor, MI (US); John Prensner, Ann Arbor, MI (US); Matthew Iyer, Ann Arbor, MI (US); Yashar Niknafs, Ann Arbor, MI (US)

(73) Assignee: THE REGENTS OF THE UNIVERSITY OF MICHIGAN, Ann Arbor, MI (US)

( * ) Notice: Subject to any disclaimer, the term of this patent is extended or adjusted under 35 U.S.C. 154(b) by 225 days.

(21) Appl. No.: 14/962,961

(22) Filed: Dec. 8, 2015

(65) Prior Publication Data
US 2016/0160295 A1    Jun. 9, 2016

Related U.S. Application Data

(60) Provisional application No. 62/088,722, filed on Dec. 8, 2014.

(51) Int. Cl.
*C12Q 1/6886*    (2018.01)

(52) U.S. Cl.
CPC ..... *C12Q 1/6886* (2013.01); *C12Q 2600/158* (2013.01)

(58) Field of Classification Search
CPC .............. C12Q 1/6886; C12Q 2600/00; A01K 2207/05
See application file for complete search history.

(56) References Cited

U.S. PATENT DOCUMENTS

| | | |
|---|---|---|
| 2014/0073525 A1 | 3/2014 | Chang et al. |
| 2019/0153449 A1 | 5/2019 | Chinnaiyan et al. |
| 2019/0307787 A1 | 10/2019 | Chinnaiyan et al. |

FOREIGN PATENT DOCUMENTS

| | | |
|---|---|---|
| WO | 2014/205555 | 12/2014 |
| WO | WO 2016/094420 | 6/2016 |
| WO | WO 2017/007941 A1 | 1/2017 |
| WO | WO 2018/006074 A2 | 1/2018 |
| WO | WO 2019/103967 | 5/2019 |
| WO | WO 2019/199733 | 10/2019 |

OTHER PUBLICATIONS

International Search Report dated May 6, 2016, PCT/US2015/064525, Filed Dec. 8, 2015. 17 pages.
GenBank Accession No. AL391244, retrieved Dec. 13, 2012, 16 pages.
Abate-Shen et al., "Molecular genetics of prostate cancer." Genes Dev. Oct. 1, 2000;14(19):2410-34.
Bejerano et al., "Ultraconserved elements in the human genome." Science. May 28, 2004;304(5675):1321-5.
Cabili et al., "Integrative annotation of human large intergenic noncoding RNAs reveals global properties and specific subclasses." Genes Dev. Sep. 15, 2011;25(18):1915-27.
Cancer Genome Atlas, "Comprehensive molecular portraits of human breast tumours."Nature. Oct. 4, 2012;490(7418):61-70.
Chen et al., "LIFR is a breast cancer metastasis suppressor upstream of the Hippo-YAP pathway and a prognostic marker." Nat Med. Oct. 2012;18(10):1511-7.
Curtis et al., "The genomic and transcriptomic architecture of 2,000 breast tumours reveals novel subgroups."Nature. Apr. 18, 2012;486(7403):346-52.
Derrien et al., "The GENCODE v7 catalog of human long noncoding RNAs: analysis of their gene structure, evolution, and expression." Genome Res. Sep. 2012;22(9):1775-89.
Dimitrieva et al., "UCNEbase—a database of ultraconserved noncoding elements and genomic regulatory blocks." Nucleic Acids Res. Jan. 2013;41(Database issue):D101-9.
Epstein et al., "The pathological interpretation and significance of prostate needle biopsy findings: implications and current controversies." J Urol. Aug. 2001;166(2):402-10.
Etzioni et al., "Cancer surveillance series: interpreting trends in prostate cancer—part III: Quantifying the link between population prostate-specific antigen testing and recent declines in prostate cancer mortality." J Natl Cancer Inst. Jun. 16, 1999;91(12):1033-9.
Finn et al., "Pfam: the protein families database." Nucleic Acids Res. Jan. 2014;42(Database issue):D222-30.
Gluck et al., "TP53 genomics predict higher clinical and pathologic tumor response in operable early-stage breast cancer treated with docetaxel-capecitabine ± trastuzumab." Breast Cancer Res Treat Apr. 2012;132(3):781-91.
Grasso et al., "The mutational landscape of lethal castration-resistant prostate cancer" Nature. Jul. 12, 2012;487(7406):239-43.
Guttman et al., "Ab initio reconstruction of cell type-specific transcriptomes in mouse reveals the conserved multi-exonic structure of lincRNAs." Nat Biotechnol. May 2010;28(5):503-10.
Jacobsen et al., "Incidence of prostate cancer diagnosis in the eras before and after serum prostate-specific antigen testing." JAMA. Nov. 8, 1995;274(18):1445-9.
Li et al., "A combined analysis of genome-wide association studies in breast cancer." Breast Cancer Res Treat. Apr. 2011;126(3):717-27.
Maattanen et al., "European randomized study of prostate cancer screening: first-year results of the Finnish trial" Br J Cancer. Mar. 1999;79(7-8):1210-4.
Michailidou et al., "Large-scale genotyping identifies 41 new loci associated with breast cancer risk."Nat Genet. Apr. 2013;45(4):353-61.
Necsulea et al., "The evolution of lncRNA repertoires and expression patterns in tetrapods."Nature. Jan. 30, 2014;505(7485):635-40.
Prensner et al., "Transcriptome sequencing across a prostate cancer cohort identifies PCAT-1, an unannotated lincRNA implicated in disease progression." Nat Biotechnol. Jul. 31, 2011;29(8):742-9.
Rhodes et al., "Oncomine 10: genes, pathways, and networks in a collection of 18,000 cancer gene expression profiles." Neoplasia. Feb. 2007;9(2):166-80.

(Continued)

*Primary Examiner* — Brian Whiteman
(74) *Attorney, Agent, or Firm* — Casimir Jones, S.C.; Tanya Arenson

(57) ABSTRACT

Provided herein are compositions and methods for cancer diagnosis, research and therapy, including but not limited to, cancer markers. In particular, provided herein are non-coding RNAs as diagnostic markers and clinical targets for cancer.

12 Claims, 14 Drawing Sheets

Specification includes a Sequence Listing.

(56) References Cited

OTHER PUBLICATIONS

Ruijter et al., "Molecular genetics and epidemiology of prostate carcinoma." Endocr Rev. Feb. 1999;20(1):22-45.
Schroder et al., "Evaluation of the digital rectal examination as a screening test for prostate cancer. Rotterdam section of the European Randomized Study of Screening for Prostate Cancer." J Natl Cancer Inst. Dec. 2, 1998;90(23):1817-23.
Stacey et al., "Common variants on chromosomes 2q35 and 16q12 confer susceptibility to estrogen receptor-positive breast cancer." Nat Genet. Jul. 2007;39(7):865-9.
Steijger et al., "Assessment of transcript reconstruction methods for RNA-seq." Nat Methods. Dec. 2013;10(12):1177-84.
Taylor et al., "Integrative genomic profiling of human prostate cancer." Cancer Cell. Jul. 13, 2010;18(1):11-22.
Thomas et al., "Multistage genome-wide association study in breast cancer identifies two new risk alleles at 1p11.2 and 14q24.1 (RAD51L1)." Nat Genet. May 2009;41(5):579-84.
Turnbull et al., "Genome-wide association study identifies five new breast cancer susceptibility loci." Nat Genet. Jun. 2010;42(6):504-7.
Wang et al., "CPAT: Coding-Potential Assessment Tool using an alignment-free logistic regression model." Nucleic Acids Res. Apr. 1, 2013;41(6):e74.
Welter et al., "The NHGRI GWAS Catalog, a curated resource of SNP-trait associations." Nucleic Acids Res. Jan. 2014;42(Database issue):D1001-6.
Yu et al., "Gene expression alterations in prostate cancer predicting tumor aggression and preceding development of malignancy." J Clin Oncol. Jul. 15, 2004;22(14):2790-9.
Crea, Francesco et al. "Identification of a long non-coding RNA as a novel biomarker and potential therapeutic target for metastatic prostate cancer" Oncotarget, vol. 5, No. 3, Feb. 15, 2014, pages.
Prensner et al. "The llong noncoding RNA SChLAP1 promotes aggressive prostate cancer and antagonizes the SWI/SNF complex" Nature Genetics, vol. 45, No. 11, Sep. 29, 2013, pp. 1392-1398.
Zhou Du et al. "Integrative genomic analyses reveal clinically relevant long noncoding RNAs in human cancer" Nature Structural & Molecular Biology, vol. 20, No. 7, Jun. 2, 2013, pp. 908-913.
Pickard, M.R. et al. "Long non-coding RNA GAS5 regulates apoptosis in prostate cancer cell lines" Biochimica et Biophysica Acta Molecular Basis of Disease, vol. 1832, No. 10, Oct. 1, 2013, pp. 1613-1623.
EP Search Report, EP Patent Application No. 15867280.8, dated Jun. 19, 2018, 14 pages.
Hofmann et al., "Genome-wide analysis of cancer/testis gene expression." Proc Natl Acad Sci U S A. Dec. 23, 2008;105(51):20422-7. 6 pages.
Barretina et al. "The Cancer Cell Line Encyclopedia Enables Predictive Modelling of Anticancer Drug Sensitivity" Nature. Mar. 28, 2012;483(7391):603-7.
Bell et al. "Insulin-like Growth Factor 2 mRNA-binding Proteins (IGF2BPs): Post-Transcriptional Drivers of Cancer Progression?" Cell Mol Life Sci. Aug. 2013;70(15):2657-75.
Birney et al."Identification and Analysis of Functional Elements in 1% of the Human Genome by the ENCODE Pilot Project" Nature. Jun. 14, 2007;447(7146):799-816.
Bozgeyik et al., "OncoLncs: Long Non-Coding RNAs with Oncogenic Functions" Mol Biol 2016, 5:3, 1000162, p. 1-13.
Calin et al., "Ultraconserved Regions Encoding ncRNAs Are Altered in Human Leukemias and Carcinomas" Cancer Cell. Sep. 2007;12(3):215-29.
Cong et al., "Multiplex Genome Engineering Using CRISPR/Cas Systems" Science. Feb. 15, 2013;339(6121):819-23.
Consortium "The Genotype-Tissue Expression (GTEx) Project" Nat Genet. Jun. 2013;45(6):580-5.
Dovey et al., "Oncogenic NRAS Cooperates With p53 Loss to Generate Melanoma in Zebrafish" Zebrafish. Dec. 2009;6(4):397-404.
El-Shewy et al., "The Insulin-Like Growth Factor Type 1 and Insulin-Like Growth Factor Type 2/mannose-6-phosphate Receptors Independently Regulate ERK1/2 Activity in HEK293 Cells" J Biol Chem. Sep. 7, 2007;282(36):26150-7.
Engreitz et al., "RNA-RNA Interactions Enable Specific Targeting of Noncoding RNAs to Nascent Pre-mRNAs and Chromatin Sites" Cell. Sep. 25, 2014;159(1):188-199.
Faghihi et al., "Expression of a Noncoding RNA Is Elevated in Alzheimer's Disease and Drives Rapid Feed-Forward Regulation of Beta-Secretase" Nat Med. Jul. 2008;14(7):723-30.
Giraldez et al., "MicroRNAs Regulate Brain Morphogenesis in Zebrafish" Science. May 6, 2005;308(5723):833-8.
Gong et al., "lncRNAs Transactivate STAU1-mediated mRNA Decay by Duplexing With 3' UTRs via Alu Elements" Nature. Feb. 10, 2011;470(7333):284-8.
Gupta et al., "Long Non-Coding RNA HOTAIR Reprograms Chromatin State to Promote Cancer Metastasis" Nature. Apr. 15, 2010;464(7291):1071-6.
Hafner et al., "Transcriptome-wide Identification of RNA-binding Protein and microRNA Target Sites by PAR-CLIP" Cell. Apr. 2, 2010;141(1):129-41.
Hämmerle et al., "Posttranscriptional Destabilization of the Liver-Specific Long Noncoding RNA HULC by the IGF2 mRNA-binding Protein 1 (IGF2BP1)" Hepatology. Nov. 2013;58(5):1703-12.
Hosono et al., "Oncogenic Role of THOR, a Conserved Cancer/Testis Long Non-coding RNA" Cell. Dec. 14, 2017;171(7):1559-1572.e20.
Hudson et al., "Transcription Signatures Encoded by Ultraconserved Genomic Regions in Human Prostate Cancer" Mol Cancer. Feb. 14, 2013;12:13.
Hwang et al., "Efficient Genome Editing in Zebrafish Using a CRISPR-Cas System" Nat Biotechnol. Mar. 2013;31(3):227-9.
International Search Report of related PCT/US2018/061802, dated Feb. 19, 2019, 18 pages.
International Search Report of related PCT/US2019/026466, dated Jul. 2, 2019, , 12 pages.
Iyer et al., "The Landscape of Long Noncoding RNAs in the Human Transcriptome" Nat Genet. Mar. 2015;47(3):199-208.
Kauffmann et al., "High Expression of DNA Repair Pathways Is Associated With Metastasis in Melanoma Patients" Oncogene. Jan. 24, 2008;27(5):565-73.
Kim et al., "Widespread Transcription at Neuronal Activity-Regulated Enhancers" Nature. May 13, 2010;465(7295):182-7.
Kretz et al., "Control of Somatic Tissue Differentiation by the Long Non-Coding RNA TINCR" Nature. Jan. 10, 2013;493(7431):231-5.
Kwan et al., "The Tol2kit: A Multisite Gateway-Based Construction Kit for Tol2 Transposon Transgenesis Constructs" Dev Dyn. Nov. 2007;236(11):3088-99.
Langenau et al., "Co-injection Strategies to Modify Radiation Sensitivity and Tumor Initiation in Transgenic Zebrafish" Oncogene. Jul. 10, 2008;27(30):4242-8.
Lee et al., "EBV Noncoding RNA Binds Nascent RNA to Drive Host PAXS to Viral DNA" Cell. Feb. 12, 2015;160(4):607-618.
Lennox et al., "Cellular Localization of Long Non-Coding RNAs Affects Silencing by RNAi More Than by Antisense Oligonucleotides" Nucleic Acids Res. Jan. 29, 2016;44(2):863-77.
Lieschke et al., "Animal Models of Human Disease: Zebrafish Swim Into View"Nat Rev Genet. May 2007;8(5):353-67.
Livingstone "IGF2 and Cancer" Endocr Relat Cancer. Oct. 24, 2013;20(6):R321-39.
Luke et al., "TERRA: Telomeric Repeat-Containing RNA" EMBO J. Sep. 2, 2009;28(17):2503-10.
Malik et al., "The lncRNA PCAT29 Inhibits Oncogenic Phenotypes in Prostate Cancer" Mol Cancer Res. Aug. 2014;12(8):1081-7.
Mattick et al. "Non-coding RNA" Hum Mol Genet. Apr. 15, 2006;15 Spec No. 1:R17-29.
Mehra "A Novel RNA in Situ Hybridization Assay for the Long Noncoding RNA SChLAP1 Predicts Poor Clinical Outcome After Radical Prostatectomy in Clinically Localized Prostate Cancer" Neoplasia. Dec. 2014;16(12):1121-7.

(56) References Cited

OTHER PUBLICATIONS

Mehra "Discovery and Characterization of PRCAT47: A Novel Prostate Lineage and Cancer-Specific Long Noncoding RNA" annual reward of W81XWH-16-1-0314, Jul. 1, 2017,p. 1-27, retrieved May 27, 2019 from the internet: https://apps.dtic.mil/dtic/tr/fulltext/u2/1050260.pdf.
Mele et al., "Human Genomics. The Human Transcriptome Across Tissues and Individuals" Science. May 8, 2015;348(6235):660-5.
Nelson et al., "A Peptide Encoded by a Transcript Annotated as Long Noncoding RNA Enhances SERCA Activity in Muscle" Science. Jan. 15, 2016;351(6270):271-5.
Nielsen et al., "A Family of Insulin-Like Growth Factor II mRNA-binding Proteins Represses Translation in Late Development" Mol Cell Biol. Feb. 1999;19(2):1262-70.
Niknafs et al., "The lncRNA Landscape of Breast Cancer Reveals a Role for DSCAM-AS1 in Breast Cancer Progression" Nat Commun. Sep. 26, 2016;7:12791. 13 pages.
Pauli et al., "Toddler: An Embryonic Signal That Promotes Cell Movement via Apelin Receptors" Science. Feb. 14, 2014;343(6172):1248636.
Petrylak et al., "Docetaxel and Estramustine Compared With Mitoxantrone and Prednisone for Advanced Refractory Prostate Cancer" N Engl J Med. Oct. 7, 2004;351(15):1513-20.
Prensner et al., "The emergence of lncRNAs in cancer biology" Cancer Discov. Oct. 2011; 1(5): 391-407.
Qin et al., "Systematic Identification of Long Non-Coding RNAs With Cancer-Testis Expression Patterns in 14 Cancer Types" Oncotarget. Oct. 19, 2017;8(55):94769-94779.
Rinn et al., "Functional Demarcation of Active and Silent Chromatin Domains in Human HOX Loci by Noncoding RNAs" Cell. Jun. 29, 2007;129(7):1311-23.
Rinn et al., "Genome Regulation by Long Noncoding RNAs" Annu Rev Biochem. 2012;81:145-66.
Sahu et al., "Long Noncoding RNAs in Cancer: From Function to Translation" Trends Cancer. Oct. 1, 2015;1(2):93-109.
Salmena et al., "A ceRNA Hypothesis: The Rosetta Stone of a Hidden RNA Language?" Cell. Aug. 5, 2011;146(3):353-8.
Sanchez-Rivera et al., "Applications of the CRISPR-Cas9 System in Cancer Biology" Nat Rev Cancer. Jul. 2015;15(7):387-95.
Sauvageau et al., "Multiple Knockout Mouse Models Reveal lincRNAs Are Required for Life and Brain Development" Elife. Dec. 31, 2013;2:e01749.
Shukla et al., "Identification and Validation of PCAT14 as Prognostic Biomarker in Prostate Cancer" Neoplasia. Aug. 2016;18(8):489-99.
Simpson et al. "Cancer/testis Antigens, Gametogenesis and Cancer" Nat Rev Cancer. Aug. 2005;5(8):615-25.
St. Laurent et al., "The Landscape of Long Noncoding RNA Classification" Trends Genet. May 2015;31(5):239-51.
Subramanian et al., "Gene Set Enrichment Analysis: A Knowledge-Based Approach for Interpreting Genome-Wide Expression Profiles" Proc Natl Acad Sci U S A. Oct. 25, 2005;102(43):15545-50.
Takayama et al., "Androgen-responsive Long Noncoding RNA CTBP1-AS Promotes Prostate Cancer" EMBO J. Jun. 12, 2013;32(12):1665-80.
Tapparel et al., "The TPTE Gene Family: Cellular Expression, Subcellular Localization and Alternative Splicing" Gene. Dec. 24, 2003;323:189-99.
Ulitsky et al., "Conserved Function of lincRNAs in Vertebrate Embryonic Development Despite Rapid Sequence Evolution" Cell. Dec. 23, 2011;147(7):1537-50.
Ulitsky et al., "lincRNAs: Genomics, Evolution, and Mechanisms" Cell. Jul. 3, 2013;154(1):26-46.
Wang et al., "A Long Noncoding RNA Maintains Active Chromatin to Coordinate Homeotic Gene Expression" Nature. Apr. 7, 2011;472(7341):120-4.
Wang et al., "Molecular Mechanisms of Long Noncoding RNAs" Mol Cell. Sep. 16, 2011;43(6):904-14.
Weidensdorfer et al., "Control of C-Myc mRNA Stability by IGF2BP1-associated Cytoplasmic RNPs" RNA. Jan. 2009;15(1):104-15.
Winnepenninckx et al. "Gene Expression Profiling of Primary Cutaneous Melanoma and Clinical Outcome" J Natl Cancer Inst. Apr. 5, 2006;98(7):472-82.
Wright et al., "CopraRNA and IntaRNA: Predicting Small RNA Targets, Networks and Interaction Domains" Nucleic Acids Res. Jul. 2014;42(Web Server issue):W119-23.
Wutz et al., "Chromosomal Silencing and Localization Are Mediated by Different Domains of Xist RNA" Nat Genet. Feb. 2002;30(2):167-74.
Zhang et al., "Analysis of the Androgen Receptor-Regulated lncRNA Landscape Identifies a Role for ARLNC1 in Prostate Cancer Progression" Nat Genet. Jun. 2018;50(6):814-824.

NON-CODING RNAS AND USES THEREOF

The present application claims priority to U.S. Provisional Patent Application Ser. No. 62/088,772 filed Dec. 8, 2014, the disclosure of which is herein incorporated by reference in its entirety.

STATEMENT REGARDING FEDERALLY SPONSORED RESEARCH OR DEVELOPMENT

This invention was made with government support under CA111275, CA154365 and CA069568 awarded by the National Institutes of Health and support under W81XWH-11-1-0337 awarded by the Army/MRMC. The Government has certain rights in the invention.

FIELD OF THE DISCLOSURE

Provided herein are compositions and methods for cancer diagnosis, research and therapy, including but not limited to, cancer markers. In particular, provided herein are non-coding RNAs as diagnostic markers and clinical targets for cancer.

BACKGROUND OF THE DISCLOSURE

Afflicting one out of nine men over age 65, prostate cancer (PCA) is a leading cause of male cancer-related death, second only to lung cancer (Abate-Shen and Shen, Genes Dev 14:2410 [2000]; Ruijter et al., Endocr Rev, 20:22 [1999]). The American Cancer Society estimates that about 184,500 American men will be diagnosed with prostate cancer and 39,200 will die in 2001.

Prostate cancer is typically diagnosed with a digital rectal exam and/or prostate specific antigen (PSA) screening. An elevated serum PSA level can indicate the presence of PCA. PSA is used as a marker for prostate cancer because it is secreted only by prostate cells. A healthy prostate will produce a stable amount—typically below 4 nanograms per milliliter, or a PSA reading of "4" or less—whereas cancer cells produce escalating amounts that correspond with the severity of the cancer. A level between 4 and 10 may raise a doctor's suspicion that a patient has prostate cancer, while amounts above 50 may show that the tumor has spread elsewhere in the body.

When PSA or digital tests indicate a strong likelihood that cancer is present, a transrectal ultrasound (TRUS) is used to map the prostate and show any suspicious areas. Biopsies of various sectors of the prostate are used to determine if prostate cancer is present. Treatment options depend on the stage of the cancer. Men with a 10-year life expectancy or less who have a low Gleason number and whose tumor has not spread beyond the prostate are often treated with watchful waiting (no treatment). Treatment options for more aggressive cancers include surgical treatments such as radical prostatectomy (RP), in which the prostate is completely removed (with or without nerve sparing techniques) and radiation, applied through an external beam that directs the dose to the prostate from outside the body or via low-dose radioactive seeds that are implanted within the prostate to kill cancer cells locally. Anti-androgen hormone therapy is also used, alone or in conjunction with surgery or radiation. Hormone therapy uses luteinizing hormone-releasing hormones (LH-RH) analogs, which block the pituitary from producing hormones that stimulate testosterone production. Patients must have injections of LH-RH analogs for the rest of their lives.

While surgical and hormonal treatments are often effective for localized PCA, advanced disease remains essentially incurable. Androgen ablation is the most common therapy for advanced PCA, leading to massive apoptosis of androgen-dependent malignant cells and temporary tumor regression. In most cases, however, the tumor reemerges with a vengeance and can proliferate independent of androgen signals.

The advent of prostate specific antigen (PSA) screening has led to earlier detection of PCA and significantly reduced PCA-associated fatalities. However, the impact of PSA screening on cancer-specific mortality is still unknown pending the results of prospective randomized screening studies (Etzioni et al., J. Natl. Cancer Inst., 91:1033 [1999]; Maattanen et al., Br. J. Cancer 79:1210 [1999]; Schroder et al., J. Natl. Cancer Inst., 90:1817 [1998]). A major limitation of the serum PSA test is a lack of prostate cancer sensitivity and specificity especially in the intermediate range of PSA detection (4-10 ng/ml). Elevated serum PSA levels are often detected in patients with non-malignant conditions such as benign prostatic hyperplasia (BPH) and prostatitis, and provide little information about the aggressiveness of the cancer detected. Coincident with increased serum PSA testing, there has been a dramatic increase in the number of prostate needle biopsies performed (Jacobsen et al., JAMA 274:1445 [1995]). This has resulted in a surge of equivocal prostate needle biopsies (Epstein and Potter J. Urol., 166: 402 [2001]). Thus, development of additional serum and tissue biomarkers to supplement PSA screening is needed.

SUMMARY OF THE DISCLOSURE

Provided herein are compositions and methods for cancer diagnosis, research and therapy, including but not limited to, cancer markers. In particular, provided herein are non-coding RNAs as diagnostic markers and clinical targets for cancer.

In some embodiments, the present disclosure provides a method of screening for the presence of cancer in a subject, comprising (a) contacting a biological sample from a subject with a gene expression detection assay, wherein said gene expression detection assay comprises a gene expression informative reagent for identification of the level of expression of one or more non-coding RNAs selected from the group consisting of those described by SEQ ID NOs: 1-2309; (b) detecting the level of expression of said non-coding in said sample using an in vitro assay; and (c) diagnosing cancer in said subject when an increased level of expression of said non-coding RNAs in said sample relative to the level in normal cells is detected. In some embodiments, the RNAs are converted to cDNA prior to or during detection. In some embodiments, the sample is selected from, for example, tissue, blood, plasma, serum, urine, urine supernatant, urine cell pellet, semen, prostatic secretions or prostate cells. In some embodiments, the detection is carried out utilizing a method selected from, for example, a sequencing technique, a nucleic acid hybridization technique, or a nucleic acid amplification technique. In some embodiments, the nucleic acid amplification technique is selected from, for example, polymerase chain reaction, reverse transcription polymerase chain reaction, transcription-mediated amplification, ligase chain reaction, strand displacement amplification, or nucleic acid sequence based amplification. The present disclosure is not limited to a particular cancer. Examples include, but are not limited to, prostate cancer, breast cancer, acute myeloid leukemia (AML), chronic myeloid leukemia (CML), myeloproliferative neoplasia (MPN)), lower grade glioma (LGG), glioblastome multiforme (GBM)), cervical cancer, head and neck cancer, lung squamous cell cancer, lung adenocarcinoma, kidney cancer, papillary cell carcimona, or bladder cancer. In some embodiments, the reagent is a pair of amplification oligonucleotides, a sequencing primer, or an oligonucleotide probe. In some embodiments, the reagent comprises one or more labels. In some embodiments, the one or more non-coding RNAs is two or more (e.g., 3, 4, 5, 6, 7, 8, 9, 10, 15, 20, 25, 30, 35, 40, 50, 75, 100, or more).

Further embodiments provide a method of identifying gene expression (e.g., gene expression associated with cancer), comprising (a) contacting a biological sample from a subject with a gene expression detection assay, wherein said gene expression detection assay comprises a gene expression informative reagent for identification of the level of expression of one or more non-coding RNAs selected from the group consisting of those described by SEQ ID NOs: 1-2309; (b) detecting the level of expression of said non-coding RNA in said sample using an in vitro assay; and optionally (c) identifying gene expression subjects at risk of prostate cancer metastasis when an increased level of expression of said non-coding RNA said sample relative to the level in normal prostate cells is detected.

Additional embodiments provide a system for analyzing a cancer, comprising: a probe set comprising a plurality of probes, wherein the plurality of probes comprises a sequence that hybridizes to at least a portion of one or more non-coding RNAs selected from the group consisting of those described by SEQ ID NOs: 1-2309 or the corresponding cDNA; and a computer model or algorithm for analyzing an expression level and/or expression profile of said non-coding RNA hybridized to the probe in a sample from a subject. In some embodiments, the system further comprises one or more of computer memory for capturing and storing an expression profile, a computer-processing device, optionally connected to a computer network, a software module executed by the computer-processing device to analyze an expression profile, a software module executed by the computer-processing device to compare the expression profile to a standard or control, a software module executed by the computer-processing device to determine the expression level of the non-coding RNA, a software module executed by the computer-processing device to transmit an analysis of the expression profile to the subject or a medical professional treating the subject or a software module executed by the computer-processing device to transmit a diagnosis or prognosis to the subject or a medical professional treating the subject.

Also provided is a probe set for assessing a cancer status of a subject comprising a plurality of probes, wherein the probes in the probe set are capable of detecting an expression level of one or more non-coding RNAs selected from the group consisting of those described by SEQ ID NOs: 1-2309 or the corresponding cDNA.

Yet other embodiments provide a composition comprising one or more reaction mixtures, wherein each reaction mixture comprises a complex of a non-coding RNAs selected from those described by SEQ ID NOs: 1-2309 or the corresponding cDNA and a probe that binds to said non-coding RNA.

Additionally provided herein are methods of treating cancer, comprising contacting a cancer cell with a compound (e.g., siRNA or antisense oligonucleotide) that specifically targets one or more non-coding RNAs selected from those described by SEQ ID NOs: 1-2309. In some embodiments, the cell is in a subject.

Additional embodiments are described herein.

DEFINITIONS

Figure 1:
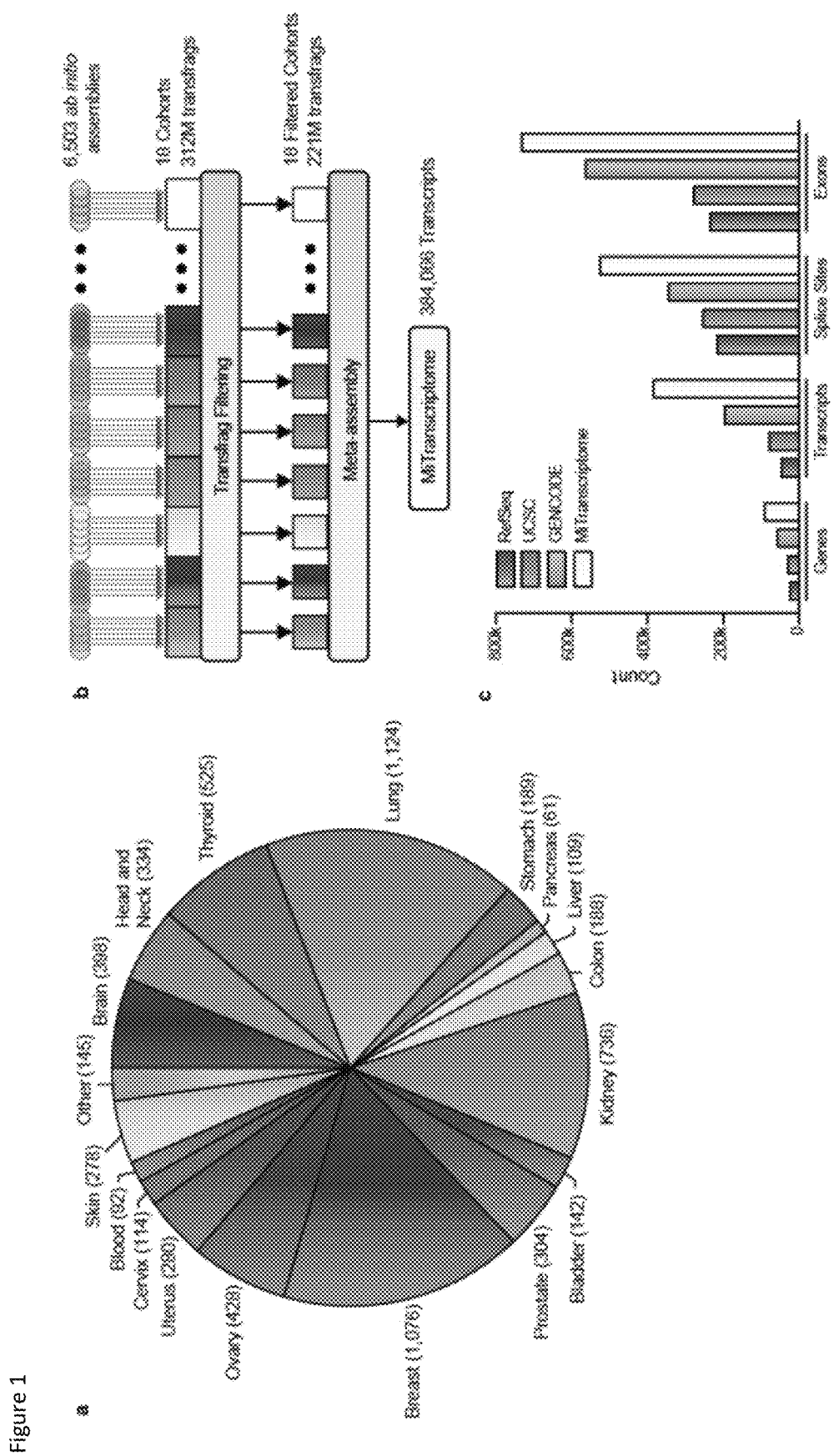
FIG. 1 shows that Ab initio transcriptome assembly reveals an expansive landscape of human transcription. (a) Pie chart showing composition and cohort sizes for RNA-Seq transcriptome reconstruction. (b) Workflow diagram for transcriptome reconstruction. (c) Bar chart comparing exons, splice sites, transcripts, and genes in the MiTranscriptome assembly with the RefSeq (December, 2013), UCSC (December, 2013) and GENCODE (release 19) catalogs.

To facilitate an understanding of the present disclosure, a number of terms and phrases are defined below:

As used herein, the terms "detect", "detecting" or "detection" may describe either the general act of discovering or discerning or the specific observation of a composition. Detecting a composition may comprise determining the presence or absence of a composition. Detecting may comprise quantifying a composition. For example, detecting comprises determining the expression level of a composition. The composition may comprise a nucleic acid molecule. For example, the composition may comprise at least a portion of the ncRNAs disclosed herein. Alternatively, or additionally, the composition may be a detectably labeled composition.

As used herein, the term "subject" refers to any organisms that are screened using the diagnostic methods described herein. Such organisms preferably include, but are not limited to, mammals (e.g., murines, simians, equines, bovines, porcines, canines, felines, and the like), and most preferably includes humans. Alternatively, the organism is an avian, amphibian, reptile or fish.

The term "diagnosed," as used herein, refers to the recognition of a disease by its signs and symptoms, or genetic analysis, pathological analysis, histological analysis, and the like.

As used herein, the term "characterizing cancer in a subject" refers to the identification of one or more properties of a cancer sample in a subject, including but not limited to, the presence of benign, pre-cancerous or cancerous tissue, the stage of the cancer, and the subject's prognosis. Cancers may be characterized by the identification of the expression of one or more cancer marker genes, including but not limited to, the ncRNAs disclosed herein.

As used herein, the term "stage of cancer" refers to a qualitative or quantitative assessment of the level of advancement of a cancer. Criteria used to determine the stage of a cancer include, but are not limited to, the size of the tumor and the extent of metastases (e.g., localized or distant).

As used herein, the term "nucleic acid molecule" refers to any nucleic acid containing molecule, including but not limited to, DNA or RNA. The nucleic acid molecule may comprise one or more nucleotides. The term encompasses sequences that include any of the known base analogs of DNA and RNA including, but not limited to, 4-acetylcytosine, 8-hydroxy-N6-methyladenosine, aziridinylcytosine, pseudoisocytosine, 5-(carboxyhydroxylmethyl) uracil, 5-fluorouracil, 5-bromouracil, 5-carboxymethylaminomethyl-2-thiouracil, 5-carboxymethylaminomethyluracil, dihydrouracil, inosine, N6-isopentenyladenine, 1-methyladenine, 1-methylpseudouracil, 1-methylguanine, 1-methylinosine, 2,2-dimethylguanine, 2-methyladenine, 2-methylguanine, 3-methylcytosine, 5-methylcytosine, N6-methyladenine, 7-methylguanine, 5-methylaminomethyluracil, 5-methoxyaminomethyl-2-thiouracil, beta-D-mannosylqueosine, 5'-methoxycarbonylmethyluracil, 5-methoxyuracil, 2-methylthio-N6-isopentenyladenine, uracil-5-oxyacetic acid methylester, uracil-5-oxyacetic acid, oxybutoxosine, pseudouracil, queosine, 2-thiocytosine, 5-methyl-2-thiouracil, 2-thiouracil, 4-thiouracil, 5-methyluracil, N-uracil-5-oxyacetic acid methylester, uracil-5-oxyacetic acid, pseudouracil, queosine, 2-thiocytosine, and 2,6-diaminopurine.

The term "gene" refers to a nucleic acid (e.g., DNA) sequence that comprises coding sequences necessary for the production of a polypeptide, precursor, or RNA (e.g., rRNA, tRNA). The polypeptide can be encoded by a full length coding sequence or by any portion of the coding sequence so long as the desired activity or functional properties (e.g., enzymatic activity, ligand binding, signal transduction, immunogenicity, etc.) of the full-length or fragments are retained. The term also encompasses the coding region of a structural gene and the sequences located adjacent to the coding region on both the 5' and 3' ends for a distance of about 1 kb or more on either end such that the gene corresponds to the length of the full-length mRNA. Sequences located 5' of the coding region and present on the mRNA are referred to as 5' non-translated sequences. Sequences located 3' or downstream of the coding region and present on the mRNA are referred to as 3' non-translated sequences. The term "gene" encompasses both cDNA and genomic forms of a gene. A genomic form or clone of a gene contains the coding region interrupted with non-coding sequences termed "introns" or "intervening regions" or "intervening sequences." Introns are segments of a gene that are transcribed into nuclear RNA (hnRNA); introns may contain regulatory elements such as enhancers. Introns are removed or "spliced out" from the nuclear or primary transcript; introns therefore are absent in the messenger RNA (mRNA) transcript. The mRNA functions during translation to specify the sequence or order of amino acids in a nascent polypeptide.

As used herein, the term "oligonucleotide," refers to a short length of single-stranded polynucleotide chain. Oligonucleotides are typically less than 200 residues long (e.g., between 15 and 100), however, as used herein, the term is also intended to encompass longer polynucleotide chains. Oligonucleotides are often referred to by their length. For example a 24 residue oligonucleotide is referred to as a "24-mer". Oligonucleotides can form secondary and tertiary structures by self-hybridizing or by hybridizing to other polynucleotides. Such structures can include, but are not limited to, duplexes, hairpins, cruciforms, bends, and triplexes.

As used herein, the terms "complementary" or "complementarity" are used in reference to polynucleotides (i.e., a sequence of nucleotides) related by the base-pairing rules. For example, the sequence "5'-A-G-T-3'," is complementary to the sequence "3'-T-C-A-5'." Complementarity may be "partial," in which only some of the nucleic acids' bases are matched according to the base pairing rules. Or, there may be "complete" or "total" complementarity between the nucleic acids. The degree of complementarity between nucleic acid strands has significant effects on the efficiency and strength of hybridization between nucleic acid strands. This is of particular importance in amplification reactions, as well as detection methods that depend upon binding between nucleic acids.

The term "homology" refers to a degree of complementarity. There may be partial homology or complete homology (i.e., identity). A partially complementary sequence is a nucleic acid molecule that at least partially inhibits a completely complementary nucleic acid molecule from hybridizing to a target nucleic acid is "substantially homologous." The inhibition of hybridization of the completely complementary sequence to the target sequence may be examined using a hybridization assay (Southern or Northern blot, solution hybridization and the like) under conditions of low stringency. A substantially homologous sequence or probe will compete for and inhibit the binding (i.e., the hybridization) of a completely homologous nucleic acid molecule to a target under conditions of low stringency. This is not to say that conditions of low stringency are such that non-specific binding is permitted; low stringency conditions require that the binding of two sequences to one another be a specific (i.e., selective) interaction. The absence of non-specific binding may be tested by the use of a second target that is substantially non-complementary (e.g., less than about 30% identity); in the absence of non-specific binding the probe will not hybridize to the second non-complementary target.

As used herein, the term "hybridization" is used in reference to the pairing of complementary nucleic acids. Hybridization and the strength of hybridization (i.e., the strength of the association between the nucleic acids) is impacted by such factors as the degree of complementary between the nucleic acids, stringency of the conditions involved, the $T_m$ of the formed hybrid, and the G:C ratio within the nucleic acids. A single molecule that contains pairing of complementary nucleic acids within its structure is said to be "self-hybridized."

As used herein the term "stringency" is used in reference to the conditions of temperature, ionic strength, and the presence of other compounds such as organic solvents, under which nucleic acid hybridizations are conducted. Under "low stringency conditions" a nucleic acid sequence of interest will hybridize to its exact complement, sequences with single base mismatches, closely related sequences (e.g., sequences with 90% or greater homology), and sequences having only partial homology (e.g., sequences with 50-90% homology). Under 'medium stringency conditions," a nucleic acid sequence of interest will hybridize only to its exact complement, sequences with single base mismatches, and closely relation sequences (e.g., 90% or greater homology). Under "high stringency conditions," a nucleic acid sequence of interest will hybridize only to its exact complement, and (depending on conditions such a temperature) sequences with single base mismatches. In other words, under conditions of high stringency the temperature can be raised so as to exclude hybridization to sequences with single base mismatches.

The term "isolated" when used in relation to a nucleic acid, as in "an isolated oligonucleotide" or "isolated polynucleotide" refers to a nucleic acid sequence that is identified and separated from at least one component or contaminant with which it is ordinarily associated in its natural source. Isolated nucleic acid is such present in a form or setting that is different from that in which it is found in nature. In contrast, non-isolated nucleic acids as nucleic acids such as DNA and RNA found in the state they exist in nature. For example, a given DNA sequence (e.g., a gene) is found on the host cell chromosome in proximity to neighboring genes; RNA sequences, such as a specific mRNA sequence encoding a specific protein, are found in the cell as a mixture with numerous other mRNAs that encode a multitude of proteins. However, isolated nucleic acid encoding a given protein includes, by way of example, such nucleic acid in cells ordinarily expressing the given protein where the nucleic acid is in a chromosomal location different from that of natural cells, or is otherwise flanked by a different nucleic acid sequence than that found in nature. The isolated nucleic acid, oligonucleotide, or polynucleotide may be present in single-stranded or double-stranded form. When an isolated nucleic acid, oligonucleotide or polynucleotide is to be utilized to express a protein, the oligonucleotide or polynucleotide will contain at a minimum the sense or coding strand (i.e., the oligonucleotide or polynucleotide may be single-stranded), but may contain both the sense and anti-sense strands (i.e., the oligonucleotide or polynucleotide may be double-stranded).

As used herein, the term "purified" or "to purify" refers to the removal of components (e.g., contaminants) from a sample. For example, antibodies are purified by removal of contaminating non-immunoglobulin proteins; they are also purified by the removal of immunoglobulin that does not bind to the target molecule. The removal of non-immunoglobulin proteins and/or the removal of immunoglobulins that do not bind to the target molecule results in an increase in the percent of target-reactive immunoglobulins in the sample. In another example, recombinant polypeptides are expressed in bacterial host cells and the polypeptides are purified by the removal of host cell proteins; the percent of recombinant polypeptides is thereby increased in the sample.

The term "label" as used herein refers to any atom or molecule that can be used to provide a detectable (preferably quantifiable) effect, and that can be attached to a nucleic acid or protein. Labels include but are not limited to dyes; radiolabels such as $^{32}P$; binding moieties such as biotin; haptens such as digoxgenin; luminogenic, phosphorescent or fluorogenic moieties; and fluorescent dyes alone or in combination with moieties that can suppress or shift emission spectra by fluorescence resonance energy transfer (FRET). Labels may provide signals detectable by fluorescence, radioactivity, colorimetry, gravimetry, X-ray diffraction or absorption, magnetism, enzymatic activity, and the like. A label may be a charged moiety (positive or negative charge) or alternatively, may be charge neutral. Labels can include or consist of nucleic acid or protein sequence, so long as the sequence comprising the label is detectable. In some embodiments, nucleic acids are detected directly without a label (e.g., directly reading a sequence).

As used herein, the term "sample" is used in its broadest sense. In one sense, it is meant to include a specimen or culture obtained from any source, as well as biological and environmental samples. Biological samples may be obtained from animals (including humans) and encompass fluids, solids, tissues, and gases. Biological samples include blood products, such as plasma, serum and the like. Such examples are not however to be construed as limiting the sample types applicable to the present disclosure.

DETAILED DESCRIPTION OF THE DISCLOSURE

Provided herein are compositions and methods for cancer diagnosis, research and therapy, including but not limited to, cancer markers. In particular, provided herein are non-coding RNAs as diagnostic markers and clinical targets for cancer.

Many RNA transcripts are not classical protein-coding genes. There is an abundance of unknown, uncharacterized RNA species in the human transcriptome (e.g., lncRNA or long non-coding RNAs). Provided herein are compositions and methods for utilizing such non-coding RNAs in diagnostic, research, and screening methods.

I. Diagnostic and Screening Methods

As described herein, embodiments of the present disclosure provide diagnostic and screening methods that utilize the detection of one or more non-coding RNAs. Exemplary non-coding RNAs include, but are not limited to, those described in SEQ ID NOs: 1-2309. Exemplary, non-limiting methods are described herein.

Any patient sample suspected of containing the non-coding RNAs may be tested according to methods of embodiments of the present disclosure. By way of non-limiting examples, the sample may be tissue (e.g., a biopsy sample, a prostate biopsy sample or a tissue sample obtained by prostatectomy), blood, urine, semen, prostatic secretions or a fraction thereof (e.g., plasma, serum, urine supernatant, urine cell pellet, cells or prostate cells). A urine sample may be collected immediately following an attentive digital rectal examination (DRE), which causes prostate cells from the prostate gland to shed into the urinary tract.

In some embodiments, the patient sample is subjected to preliminary processing designed to isolate or enrich the sample for the non-coding RNAs or cells that contain the non-coding RNAs. A variety of techniques known to those of ordinary skill in the art may be used for this purpose, including but not limited to: centrifugation; immunocapture; cell lysis; nucleic acid amplification; and, nucleic acid target capture (See, e.g., EP Pat. No. 1 409 727, herein incorporated by reference in its entirety). The non-coding RNAs may be detected along with other markers in a multiplex or panel format.

Markers may be selected for their predictive value alone or in combination with non-coding RNAs described herein (e.g., one or more of SEQ ID NOs: 1-2309). Exemplary prostate cancer markers include, but are not limited to: AMACR/P504S (U.S. Pat. No. 6,262,245); PCA3 (U.S. Pat. No. 7,008,765); PCGEM1 (U.S. Pat. No. 6,828,429); prostein/P501S, P503S, P504S, P509S, P510S, prostase/P703P, P710P (U.S. Publication No. 20030185830); RAS/KRAS (Bos, Cancer Res. 49:4682-89 (1989); Kranenburg, Biochimica et Biophysica Acta 1756:81-82 (2005)); and, those disclosed in U.S. Pat. Nos. 5,854,206 and 6,034,218, 7,229,774, each of which is herein incorporated by reference in its entirety. Markers for other cancers, diseases, infections, and metabolic conditions are also contemplated for inclusion in a multiplex or panel format.

In some embodiments, multiplex or array formats are utilized to detect multiple markers in combination. For example, in some embodiments, the level of expression of one or more, 2 or more, 3 or more, 4 or more, 5 or more, 10 or more, 15 or more, 20 or more, 25 or more, 30 or more, 35 or more, 40 or more 45 or more, 50 or more, 60 or more, 70 or more, 80 or more, 90 or more, 100 or more non-coding RNAs (ncRNAs) is utilized in the research, screening, diagnostic and prognositic compositions and methods described herein. The one or more ncRNAs may be selected from the group comprising.

i. DNA and RNA Detection

The non-coding RNAs of the present disclosure are detected using a variety of nucleic acid techniques known to those of ordinary skill in the art, including but not limited to: nucleic acid sequencing; nucleic acid hybridization; and, nucleic acid amplification.

The methods, compositions and kits may comprise one or more ncRNAs. The methods, compositions and kits may comprise 2 or more, 3 or more, 4 or more, 5 or more, 6 or more, 7 or more, 8 or more, 9 or more, 10 or more, 15 or more, 20 or more, 25 or more, 30 or more, 40 or more, 45 or more, 50 or more, 55 or more, 60 or more, 70 or more, 80 or more, 90 or more, 100 or more, 110 or more, 120 or more, 130 or more, 140 or more, 150 or more ncRNAs.

The one or more ncRNAs may be selected from, for example, those described in SEQ ID NOs: 1-2309.

1. Sequencing

In some embodiments, nucleic acid sequencing methods are utilized (e.g., for detection of amplified nucleic acids). In some embodiments, the technology provided herein finds use in a Second Generation (a.k.a. Next Generation or Next-Gen), Third Generation (a.k.a. Next-Next-Gen), or Fourth Generation (a.k.a. N3-Gen) sequencing technology including, but not limited to, pyrosequencing, sequencing-by-ligation, single molecule sequencing, sequence-by-synthesis (SBS), semiconductor sequencing, massive parallel clonal, massive parallel single molecule SBS, massive parallel single molecule real-time, massive parallel single molecule real-time nanopore technology, etc. Morozova and Marra provide a review of some such technologies in *Genomics*, 92: 255 (2008), herein incorporated by reference in its entirety. Those of ordinary skill in the art will recognize that because RNA is less stable in the cell and more prone to nuclease attack experimentally RNA is usually reverse transcribed to DNA before sequencing.

A number of DNA sequencing techniques are suitable, including fluorescence-based sequencing methodologies (See, e.g., Birren et al., Genome Analysis: Analyzing DNA, 1, Cold Spring Harbor, N.Y.; herein incorporated by reference in its entirety). In some embodiments, the technology finds use in automated sequencing techniques understood in that art. In some embodiments, the present technology finds use in parallel sequencing of partitioned amplicons (PCT Publication No: WO2006084132 to Kevin McKernan et al., herein incorporated by reference in its entirety). In some embodiments, the technology finds use in DNA sequencing by parallel oligonucleotide extension (See, e.g., U.S. Pat. No. 5,750,341 to Macevicz et al., and U.S. Pat. No. 6,306,597 to Macevicz et al., both of which are herein incorporated by reference in their entireties). Additional examples of sequencing techniques in which the technology finds use include the Church polony technology (Mitra et al., 2003, Analytical Biochemistry 320, 55-65; Shendure et al., 2005 Science 309, 1728-1732; U.S. Pat. Nos. 6,432,360, 6,485,944, 6,511,803; herein incorporated by reference in their entireties), the 454 picotiter pyrosequencing technology (Margulies et al., 2005 Nature 437, 376-380; US 20050130173; herein incorporated by reference in their entireties), the Solexa single base addition technology (Bennett et al., 2005, Pharmacogenomics, 6, 373-382; U.S. Pat. Nos. 6,787,308; 6,833,246; herein incorporated by reference in their entireties), the Lynx massively parallel signature sequencing technology (Brenner et al. (2000). Nat. Biotechnol. 18:630-634; U.S. Pat. Nos. 5,695,934; 5,714,330; herein incorporated by reference in their entireties), and the Adessi PCR colony technology (Adessi et al. (2000). Nucleic Acid Res. 28, E87; WO 00018957; herein incorporated by reference in its entirety).

Next-generation sequencing (NGS) methods share the common feature of massively parallel, high-throughput strategies, with the goal of lower costs in comparison to older sequencing methods (see, e.g., Voelkerding et al., *Clinical Chem.*, 55: 641-658, 2009; MacLean et al., *Nature Rev. Microbiol.*, 7: 287-296; each herein incorporated by reference in their entirety). NGS methods can be broadly divided into those that typically use template amplification and those that do not. Amplification-requiring methods include pyrosequencing commercialized by Roche as the 454 technology platforms (e.g., GS 20 and GS FLX), Life Technologies/Ion Torrent, the Solexa platform commercialized by Illumina, GnuBio, and the Supported Oligonucleotide Ligation and Detection (SOLiD) platform commercialized by Applied Biosystems. Non-amplification approaches, also known as single-molecule sequencing, are exemplified by the Heli Scope platform commercialized by Helicos BioSciences, and emerging platforms commercialized by VisiGen, Oxford Nanopore Technologies Ltd., and Pacific Biosciences, respectively.

In pyrosequencing (Voelkerding et al., *Clinical Chem.*, 55: 641-658, 2009; MacLean et al., *Nature Rev. Microbiol.*, 7: 287-296; U.S. Pat. Nos. 6,210,891; 6,258,568; each herein incorporated by reference in its entirety), template DNA is fragmented, end-repaired, ligated to adaptors, and clonally amplified in-situ by capturing single template molecules with beads bearing oligonucleotides complementary to the adaptors. Each bead bearing a single template type is compartmentalized into a water-in-oil microvesicle, and the template is clonally amplified using a technique referred to as emulsion PCR. The emulsion is disrupted after amplification and beads are deposited into individual wells of a picotitre plate functioning as a flow cell during the sequencing reactions. Ordered, iterative introduction of each of the four dNTP reagents occurs in the flow cell in the presence of sequencing enzymes and luminescent reporter such as luciferase. In the event that an appropriate dNTP is added to the 3' end of the sequencing primer, the resulting production of ATP causes a burst of luminescence within the well, which is recorded using a CCD camera. It is possible to achieve read lengths greater than or equal to 400 bases, and $10^6$ sequence reads can be achieved, resulting in up to 500 million base pairs (Mb) of sequence.

In the Solexa/Illumina platform (Voelkerding et al., *Clinical Chem.*, 55: 641-658, 2009; MacLean et al., *Nature Rev. Microbiol.*, 7: 287-296; U.S. Pat. Nos. 6,833,246; 7,115,400; 6,969,488; each herein incorporated by reference in its entirety), sequencing data are produced in the form of shorter-length reads. In this method, single-stranded fragmented DNA is end-repaired to generate 5'-phosphorylated blunt ends, followed by Klenow-mediated addition of a single A base to the 3' end of the fragments. A-addition facilitates addition of T-overhang adaptor oligonucleotides, which are subsequently used to capture the template-adaptor molecules on the surface of a flow cell that is studded with oligonucleotide anchors. The anchor is used as a PCR primer, but because of the length of the template and its proximity to other nearby anchor oligonucleotides, extension by PCR results in the "arching over" of the molecule to hybridize with an adjacent anchor oligonucleotide to form a bridge structure on the surface of the flow cell. These loops of DNA are denatured and cleaved. Forward strands are then sequenced with reversible dye terminators. The sequence of incorporated nucleotides is determined by detection of post-incorporation fluorescence, with each fluor and block removed prior to the next cycle of dNTP addition. Sequence read length ranges from 36 nucleotides to over 250 nucleotides, with overall output exceeding 1 billion nucleotide pairs per analytical run.

Sequencing nucleic acid molecules using SOLiD technology (Voelkerding et al., *Clinical Chem.*, 55: 641-658, 2009; MacLean et al., *Nature Rev. Microbiol.*, 7: 287-296; U.S. Pat. Nos. 5,912,148; 6,130,073; each herein incorporated by reference in their entirety) also involves fragmentation of the template, ligation to oligonucleotide adaptors, attachment to beads, and clonal amplification by emulsion PCR. Following this, beads bearing template are immobilized on a derivatized surface of a glass flow-cell, and a primer complementary to the adaptor oligonucleotide is annealed. However, rather than utilizing this primer for 3' extension, it is instead used to provide a 5' phosphate group for ligation to interrogation probes containing two probe-specific bases followed by 6 degenerate bases and one of four fluorescent labels. In the SOLiD system, interrogation probes have 16 possible combinations of the two bases at the 3' end of each probe, and one of four fluors at the 5' end. Fluor color, and thus identity of each probe, corresponds to specified color-space coding schemes. Multiple rounds (usually 7) of probe annealing, ligation, and fluor detection are followed by denaturation, and then a second round of sequencing using a primer that is offset by one base relative to the initial primer. In this manner, the template sequence can be computationally re-constructed, and template bases are interrogated twice, resulting in increased accuracy. Sequence read length averages 35 nucleotides, and overall output exceeds 4 billion bases per sequencing run.

In certain embodiments, the technology finds use in nanopore sequencing (see, e.g., Astier et al., J. Am. Chem. Soc. 2006 Feb. 8; 128(5):1705-10, herein incorporated by reference). The theory behind nanopore sequencing has to do with what occurs when a nanopore is immersed in a conducting fluid and a potential (voltage) is applied across it. Under these conditions a slight electric current due to conduction of ions through the nanopore can be observed, and the amount of current is exceedingly sensitive to the size of the nanopore. As each base of a nucleic acid passes through the nanopore, this causes a change in the magnitude of the current through the nanopore that is distinct for each of the four bases, thereby allowing the sequence of the DNA molecule to be determined.

In certain embodiments, the technology finds use in HeliScope by Helicos BioSciences (Voelkerding et al., *Clinical Chem.*, 55: 641-658, 2009; MacLean et al., *Nature Rev. Microbiol.*, 7: 287-296; U.S. Pat. Nos. 7,169,560; 7,282,337; 7,482,120; 7,501,245; 6,818,395; 6,911,345; 7,501,245; each herein incorporated by reference in their entirety). Template DNA is fragmented and polyadenylated at the 3' end, with the final adenosine bearing a fluorescent label. Denatured polyadenylated template fragments are ligated to poly(dT) oligonucleotides on the surface of a flow cell. Initial physical locations of captured template molecules are recorded by a CCD camera, and then label is cleaved and washed away. Sequencing is achieved by addition of polymerase and serial addition of fluorescently-labeled dNTP reagents. Incorporation events result in fluor signal corresponding to the dNTP, and signal is captured by a CCD camera before each round of dNTP addition. Sequence read length ranges from 25-50 nucleotides, with overall output exceeding 1 billion nucleotide pairs per analytical run.

The Ion Torrent technology is a method of DNA sequencing based on the detection of hydrogen ions that are released during the polymerization of DNA (see, e.g., Science 327 (5970): 1190 (2010); U. S. Pat. Appl. Pub. Nos. 20090026082, 20090127589, 20100301398, 20100197507, 20100188073, and 20100137143, incorporated by reference in their entireties for all purposes). A microwell contains a template DNA strand to be sequenced. Beneath the layer of microwells is a hypersensitive ISFET ion sensor. All layers are contained within a CMOS semiconductor chip, similar to that used in the electronics industry. When a dNTP is incorporated into the growing complementary strand a hydrogen ion is released, which triggers a hypersensitive ion sensor. If homopolymer repeats are present in the template sequence, multiple dNTP molecules will be incorporated in a single cycle. This leads to a corresponding number of released hydrogens and a proportionally higher electronic signal. This technology differs from other sequencing technologies in that no modified nucleotides or optics are used. The per-base accuracy of the Ion Torrent sequencer is ~99.6% for 50 base reads, with ~100 Mb to 100 Gb generated per run. The read-length is 100-300 base pairs. The accuracy for homopolymer repeats of 5 repeats in length is ~98%. The benefits of ion semiconductor sequencing are rapid sequencing speed and low upfront and operating costs.

The technology finds use in another nucleic acid sequencing approach developed by Stratos Genomics, Inc. and involves the use of Xpandomers. This sequencing process typically includes providing a daughter strand produced by a template-directed synthesis. The daughter strand generally includes a plurality of subunits coupled in a sequence corresponding to a contiguous nucleotide sequence of all or a portion of a target nucleic acid in which the individual subunits comprise a tether, at least one probe or nucleobase residue, and at least one selectively cleavable bond. The selectively cleavable bond(s) is/are cleaved to yield an Xpandomer of a length longer than the plurality of the subunits of the daughter strand. The Xpandomer typically includes the tethers and reporter elements for parsing genetic information in a sequence corresponding to the contiguous nucleotide sequence of all or a portion of the target nucleic acid. Reporter elements of the Xpandomer are then detected. Additional details relating to Xpandomer-based approaches are described in, for example, U.S. Pat. Pub No. 20090035777, entitled "High Throughput Nucleic Acid Sequencing by Expansion," filed Jun. 19, 2008, which is incorporated herein in its entirety.

Other emerging single molecule sequencing methods include real-time sequencing by synthesis using a VisiGen platform (Voelkerding et al., *Clinical Chem.*, 55: 641-58, 2009; U.S. Pat. No. 7,329,492; U.S. patent application Ser. No. 11/671,956; U.S. patent application Ser. No. 11/781, 166; each herein incorporated by reference in their entirety) in which immobilized, primed DNA template is subjected to strand extension using a fluorescently-modified polymerase and florescent acceptor molecules, resulting in detectible fluorescence resonance energy transfer (FRET) upon nucleotide addition.

2. Hybridization

Illustrative non-limiting examples of nucleic acid hybridization techniques include, but are not limited to, in situ hybridization (ISH), microarray, and Southern or Northern blot.

In situ hybridization (ISH) is a type of hybridization that uses a labeled complementary DNA or RNA strand as a probe to localize a specific DNA or RNA sequence in a portion or section of tissue (in situ), or, if the tissue is small enough, the entire tissue (whole mount ISH). DNA ISH can be used to determine the structure of chromosomes. RNA ISH is used to measure and localize mRNAs and other transcripts (e.g., ncRNAs) within tissue sections or whole mounts. Sample cells and tissues are usually treated to fix the target transcripts in place and to increase access of the probe. The probe hybridizes to the target sequence at elevated temperature, and then the excess probe is washed away. The probe that was labeled with either radio-, fluorescent- or antigen-labeled bases is localized and quantitated in the tissue using either autoradiography, fluorescence microscopy or immunohistochemistry, respectively. ISH can also use two or more probes, labeled with radioactivity or the other non-radioactive labels, to simultaneously detect two or more transcripts.

In some embodiments, ncRNAs are detected using fluorescence in situ hybridization (FISH). In some embodiments, FISH assays utilize bacterial artificial chromosomes (BACs). These have been used extensively in the human genome sequencing project (see *Nature* 409: 953-958 (2001)) and clones containing specific BACs are available through distributors that can be located through many sources, e.g., NCBI. Each BAC clone from the human genome has been given a reference name that unambiguously identifies it. These names can be used to find a corresponding GenBank sequence and to order copies of the clone from a distributor.

The present disclosure further provides a method of performing a FISH assay on the patient sample. The methods disclosed herein may comprise performing a FISH assay on one or more cells, tissues, organs, or fluids surrounding such cells, tissues and organs. In some instances, the methods disclosed herein further comprise performing a FISH assy on human prostate cells, human prostate tissue or on the fluid surrounding said human prostate cells or human prostate tissue. Alternatively, or additionally, the methods disclosed herien comprise performing a FISH assay on breast cells, lung cells, pancreatic cells, liver cells, breast tissue, lung tissue, pancreatic tissue, liver tissue, or on the fluid surrounding the cells or tissues. Specific protocols are well known in the art and can be readily adapted for the present disclosure. Guidance regarding methodology may be obtained from many references including: *In situ Hybridization: Medical Applications* (eds. G. R. Coulton and J. de Belleroche), Kluwer Academic Publishers, Boston (1992); *In situ Hybridization: In Neurobiology; Advances in Methodology* (eds. J. H. Eberwine, K. L. Valentino, and J. D. Barchas), Oxford University Press Inc., England (1994); *In situ Hybridization: A Practical Approach* (ed. D. G. Wilkinson), Oxford University Press Inc., England (1992)); Kuo, et al., *Am. J. Hum. Genet.* 49:112-119 (1991); Klinger, et al., *Am. J. Hum. Genet.* 51:55-65 (1992); and Ward, et al., *Am. J. Hum. Genet.* 52:854-865 (1993)). There are also kits that are commercially available and that provide protocols for performing FISH assays (available from e.g., Oncor, Inc., Gaithersburg, Md.). Patents providing guidance on methodology include U.S. Pat. Nos. 5,225,326; 5,545,524; 6,121, 489 and 6,573,043. All of these references are hereby incorporated by reference in their entirety and may be used along with similar references in the art and with the information provided in the Examples section herein to establish procedural steps convenient for a particular laboratory.

The one or more ncRNAs may be detected by conducting one or more hybridization reactions. The one or more hybridization reactions may comprise one or more hybridization arrays, hybridization reactions, hybridization chain reactions, isothermal hybridization reactions, nucleic acid hybridization reactions, or a combination thereof. The one or more hybridization arrays may comprise hybridization array genotyping, hybridization array proportional sensing, DNA hybridization arrays, macroarrays, microarrays, high-density oligonucleotide arrays, genomic hybridization arrays, comparative hybridization arrays, or a combination thereof.

3. Microarrays

Different kinds of biological assays are called microarrays including, but not limited to: DNA microarrays (e.g., cDNA microarrays and oligonucleotide microarrays); protein microarrays; tissue microarrays; transfection or cell microarrays; chemical compound microarrays; and, antibody microarrays. A DNA microarray, commonly known as gene chip, DNA chip, or biochip, is a collection of microscopic DNA spots attached to a solid surface (e.g., glass, plastic or silicon chip) forming an array for the purpose of expression profiling or monitoring expression levels for thousands of genes simultaneously. The affixed DNA segments are known as probes, thousands of which can be used in a single DNA microarray. Microarrays can be used to identify disease genes or transcripts (e.g., ncRNAs) by comparing gene expression in disease and normal cells. Microarrays can be fabricated using a variety of technologies, including but not limiting: printing with fine-pointed pins onto glass slides; photolithography using pre-made masks; photolithography using dynamic micromirror devices; ink-jet printing; or, electrochemistry on microelectrode arrays.

3. Amplification

The methods disclosed herein may comprise conducting one or more amplification reactions. Nucleic acids (e.g., ncRNAs) may be amplified prior to or simultaneous with detection. Conducting one or more amplification reactions may comprise one or more PCR-based amplifications, non-PCR based amplifications, or a combination thereof. Illustrative non-limiting examples of nucleic acid amplification techniques include, but are not limited to, polymerase chain reaction (PCR), reverse transcription polymerase chain reaction (RT-PCR), nested PCR, linear amplification, multiple displacement amplification (MDA), real-time SDA, rolling circle amplification, circle-to-circle amplification transcription-mediated amplification (TMA), ligase chain reaction (LCR), strand displacement amplification (SDA), and nucleic acid sequence based amplification (NASBA). Those of ordinary skill in the art will recognize that certain amplification techniques (e.g., PCR) require that RNA be reversed transcribed to DNA prior to amplification (e.g., RT-PCR), whereas other amplification techniques directly amplify RNA (e.g., TMA and NASBA).

The polymerase chain reaction (U.S. Pat. Nos. 4,683,195, 4,683,202, 4,800,159 and 4,965,188, each of which is herein incorporated by reference in its entirety), commonly referred to as PCR, uses multiple cycles of denaturation, annealing of primer pairs to opposite strands, and primer extension to exponentially increase copy numbers of a target nucleic acid sequence. In a variation called RT-PCR, reverse transcriptase (RT) is used to make a complementary DNA (cDNA) from mRNA, and the cDNA is then amplified by PCR to produce multiple copies of DNA. For other various permutations of PCR see, e.g., U.S. Pat. Nos. 4,683,195, 4,683,202 and 4,800,159; Mullis et al., *Meth. Enzymol.* 155: 335 (1987); and, Murakawa et al., *DNA* 7: 287 (1988), each of which is herein incorporated by reference in its entirety.

Transcription mediated amplification (U.S. Pat. Nos. 5,480,784 and 5,399,491, each of which is herein incorporated by reference in its entirety), commonly referred to as TMA, synthesizes multiple copies of a target nucleic acid sequence autocatalytically under conditions of substantially constant temperature, ionic strength, and pH in which multiple RNA copies of the target sequence autocatalytically generate additional copies. See, e.g., U.S. Pat. Nos. 5,399, 491 and 5,824,518, each of which is herein incorporated by reference in its entirety. In a variation described in U.S. Publ. No. 20060046265 (herein incorporated by reference in its entirety), TMA optionally incorporates the use of blocking moieties, terminating moieties, and other modifying moieties to improve TMA process sensitivity and accuracy.

The ligase chain reaction (Weiss, R., *Science* 254: 1292 (1991), herein incorporated by reference in its entirety), commonly referred to as LCR, uses two sets of complementary DNA oligonucleotides that hybridize to adjacent regions of the target nucleic acid. The DNA oligonucleotides are covalently linked by a DNA ligase in repeated cycles of thermal denaturation, hybridization and ligation to produce a detectable double-stranded ligated oligonucleotide product.

Strand displacement amplification (Walker, G. et al., *Proc. Natl. Acad. Sci. USA* 89: 392-396 (1992); U. S. Pat. Nos. 5,270,184 and 5,455,166, each of which is herein incorporated by reference in its entirety), commonly referred to as SDA, uses cycles of annealing pairs of primer sequences to opposite strands of a target sequence, primer extension in the presence of a dNTPαS to produce a duplex hemiphosphorothioated primer extension product, endonuclease-mediated nicking of a hemimodified restriction endonuclease recognition site, and polymerase-mediated primer extension from the 3' end of the nick to displace an existing strand and produce a strand for the next round of primer annealing, nicking and strand displacement, resulting in geometric amplification of product. Thermophilic SDA (tSDA) uses thermophilic endonucleases and polymerases at higher temperatures in essentially the same method (EP Pat. No. 0 684 315).

Other amplification methods include, for example: nucleic acid sequence based amplification (U.S. Pat. No. 5,130,238, herein incorporated by reference in its entirety), commonly referred to as NASBA; one that uses an RNA replicase to amplify the probe molecule itself (Lizardi et al., *BioTechnol.* 6: 1197 (1988), herein incorporated by reference in its entirety), commonly referred to as Qβ replicase; a transcription based amplification method (Kwoh et al., *Proc. Natl. Acad. Sci. USA* 86:1173 (1989)); and, self-sustained sequence replication (Guatelli et al., *Proc. Natl. Acad. Sci. USA* 87: 1874 (1990), each of which is herein incorporated by reference in its entirety). For further discussion of known amplification methods see Persing, David H., "In Vitro Nucleic Acid Amplification Techniques" in *Diagnostic Medical Microbiology: Principles and Applications* (Persing et al., Eds.), pp. 51-87 (American Society for Microbiology, Washington, D.C. (1993)).

ii. Data Analysis

In some embodiments, a computer-based analysis program is used to translate the raw data generated by the detection assay (e.g., the presence, absence, or amount of a given marker or markers) into data of predictive value for a clinician. The clinician can access the predictive data using any suitable means. Thus, in some preferred embodiments, the present disclosure provides the further benefit that the clinician, who is not likely to be trained in genetics or molecular biology, need not understand the raw data. The data is presented directly to the clinician in its most useful form. The clinician is then able to immediately utilize the information in order to optimize the care of the subject.

The present disclosure contemplates any method capable of receiving, processing, and transmitting the information to and from laboratories conducting the assays, information providers, medical personnel, and subjects. For example, in some embodiments of the present disclosure, a sample (e.g., a biopsy or a serum or urine sample) is obtained from a subject and submitted to a profiling service (e.g., clinical lab at a medical facility, genomic profiling business, etc.), located in any part of the world (e.g., in a country different than the country where the subject resides or where the information is ultimately used) to generate raw data. Where the sample comprises a tissue or other biological sample, the subject may visit a medical center to have the sample obtained and sent to the profiling center, or subjects may collect the sample themselves (e.g., a urine sample) and directly send it to a profiling center. Where the sample comprises previously determined biological information, the information may be directly sent to the profiling service by the subject (e.g., an information card containing the information may be scanned by a computer and the data transmitted to a computer of the profiling center using an electronic communication systems). Once received by the profiling service, the sample is processed and a profile is produced (i.e., expression data), specific for the diagnostic or prognostic information desired for the subject.

The profile data is then prepared in a format suitable for interpretation by one or more medical personnel (e.g., a treating clinician, physician assistant, nurse, or pharmacist). For example, rather than providing raw expression data, the prepared format may represent a diagnosis or risk assessment (e.g., presence or absence of a ncRNA) for the subject, along with recommendations for particular treatment options. The data may be displayed to the medical personnel by any suitable method. For example, in some embodiments, the profiling service generates a report that can be printed for the medical personnel (e.g., at the point of care) or displayed to the medical personnel on a computer monitor.

In some embodiments, the information is first analyzed at the point of care or at a regional facility. The raw data is then sent to a central processing facility for further analysis and/or to convert the raw data to information useful for medical personnel or patient. The central processing facility provides the advantage of privacy (all data is stored in a central facility with uniform security protocols), speed, and uniformity of data analysis. The central processing facility can then control the fate of the data following treatment of the subject. For example, using an electronic communication system, the central facility can provide data to the medical personnel, the subject, or researchers.

In some embodiments, the subject is able to directly access the data using the electronic communication system. The subject may chose further intervention or counseling based on the results.

In some embodiments, the data is used for research use. For example, the data may be used to further optimize the inclusion or elimination of markers as useful indicators of a particular condition or stage of disease or as a companion diagnostic to determine a treatment course of action.

iii. Compositions & Kits

Compositions for use in the diagnostic methods described herein include, but are not limited to, probes, amplification oligonucleotides, and the like.

The compositions and kits may comprise 1 or more, 2 or more, 3 or more, 4 or more, 5 or more, 6 or more, 7 or more, 8 or more, 9 or more, 10 or more, 11 or more, 12 or more, 13 or more, 14 or more, 15 or more, 20 or more, 25 or more, 30 or more, 35 or more, 40 or more, 45 or more, 50 or more, 60 or more, 70 or more, 80 or more, 90 or more, 100 or more, 110 or more, 120 or more probes.

The probes may hybridize to 1 or more, 2 or more, 3 or more, 4 or more, 5 or more, 6 or more, 7 or more, 8 or more, 9 or more, 10 or more, 11 or more, 12 or more, 13 or more, 14 or more, 15 or more, 20 or more, 25 or more, 30 or more, 35 or more, 40 or more, 45 or more, 50 or more, 60 or more, 70 or more, 80 or more, 90 or more, 100 or more, 110 or more, 120 or more target molecules. The target molecules may be a ncRNA, RNA, DNA, cDNA, mRNA, a portion or fragment thereof or a combination thereof. In some instances, at least a portion of the target molecules are ncRNAs. The probes may hybridize to 1 or more, 2 or more, 3 or more, 4 or more, 5 or more, 6 or more, 7 or more, 8 or more, 9 or more, 10 or more, 11 or more, 12 or more, 13 or more, 14 or more, 15 or more, 20 or more, 25 or more, 30 or more, 35 or more, 40 or more, 45 or more, 50 or more, 60 or more, 70 or more, 80 or more, 90 or more, 100 or more, 110 or more, 120 or more ncRNAs disclosed herein (e.g., SEQ ID NOs: 1-2309).

Typically, the probes comprise a target specific sequence. The target specific sequence may be complementary to at least a portion of the target molecule. The target specific sequence may be at least about 50% or more, 55% or more, 60% or more, 65% or more, 70% or more, 75% or more, 80% or more, 85% or more, 90% or more, 95% or more, 97% or more, 98% or more, or 100% complementary to at leat a portion of the target molecule.

The target specific sequence may be at least about 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more nucleotides in length. In some instances, the target specific sequence is between about 8 to about 20 nucleotides, 10 to about 18 nucleotides, or 12 to about 16 nucleotides in length.

The compositions and kits may comprise a plurality of probes, wherein the two or more probes of the plurality of probes comprise identical target specific sequences. The compositions and kits may comprise a plurality of probes, wherein the two or more probes of the plurality of probes comprise different target specific sequences.

The probes may further comprise a unique sequence. The unique sequence is noncomplementary to the ncRNA. The unique sequence may comprise a label, barcode, or unique identifier. The unique sequence may comprise a random sequence, nonrandom sequence, or a combination thereof. The unique sequence may be at least about 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 22 or more, 24 or more, 26 or more, 28 or more, 30 or more nucleotides in length. In some instances, the unique sequence is between about 8 to about 20 nucleotides, 10 to about 18 nucleotides, or 12 to about 16 nucleotides in length.

The unique sequence may allow differentiation of two or more target molecules. The two or more target molecules may have identical sequences. Thus, the unique sequence may allow quantification of a target molecule. Alternatively, the two or more target molecules may have different sequences. Thus, the unique sequence may allow detection of the target molecules. The compositions and kits may comprise a plurality of probes for quantifying one or more target molecules. The compositions and kits may comprise a plurality of probes for detecting one or more target molecules.

The unique sequence may allow differentiation of two or more samples. The compositions and kits may comprise 1 or more, 2 or more, 3 or more, 4 or more, 5 or more, 6 or more, 7 or more, 8 or more, 9 or more, 10 or more, 11 or more, 12 or more, 13 or more, 14 or more, 15 or more, 20 or more, 25 or more, 30 or more probe sets for differentiating two or more samples from one or more subjects. The two or more samples may be from two or more different subjects. For example, the compositions and kits comprise a first set of probes comprising a first unique sequence that is specific for a first subject and a second set of probes comprising a second unique sequence that is specific for a second subject. The compositions and kits may further comprise one or more sets of probes with one or more unique sequences to differentiate one or more additional subjects.

The compositions and kits may comprise 2 or more probe sets for differentiating from 2 or more, 3 or more, 4 or more, 5 or more, 6 or more, 7 or more, 8 or more, 9 or more, 10 or more, 11 or more, 12 or more, 13 or more, 14 or more, 15 or more, 20 or more, 25 or more, 30 or more samples from 1 or more subjects.

The compositions and kits may comprise 2 or more probe sets for differentiating 1 or more, 2 or more, 3 or more, 4 or more, 5 or more, 6 or more, 7 or more, 8 or more, 9 or more, 10 or more, 11 or more, 12 or more, 13 or more, 14 or more, 15 or more, 20 or more, 25 or more, 30 or more samples from one or more cells, tissues, organs, bodily fluid, or a combination thereof.

The compositions and kits may comprise 2 or more probe sets for differentiating samples from 1 or more, 2 or more, 3 or more, 4 or more, 5 or more, 6 or more, 7 or more, 8 or more, 9 or more, 10 or more, 11 or more, 12 or more, 13 or more, 14 or more, 15 or more, 20 or more, 25 or more, 30 or more subjects.

Alternatively, or additionally, the two or more samples may be from two or more different timepoints from the same subject or different subjects. For example, the compositions and kits comprise a first set of probes comprising a first unique sequence that is specific for a first subject and a second set of probes comprising a second unique sequence that is specific for a second subject. The compositions and kits may comprise 2 or more probe sets for differentiating samples from 1 or more, 2 or more, 3 or more, 4 or more, 5 or more, 6 or more, 7 or more, 8 or more, 9 or more, 10 or more, 11 or more, 12 or more, 13 or more, 14 or more, 15 or more, 20 or more, 25 or more, 30 or more timepoints. The timepoints may be every 1, 2, 3, 4, 5, 6, 7, 8, 9, 10, 11, 12, 13, 14, 15, 16, 17, 18, 19, 20, 21, 22, 23, 24 or more hours. The timepoints may be every 1, 2, 3, 4, 5, 6, 7, 8, 9, 10, 11, 12, 13, 14, 15, 16, 17, 18, 19, 20, 21, 22, 23, 24 or more days. The timepoints may be every 1, 2, 3, 4, 5, 6, 7, 8, 9, 10, 11, 12, 13, 14, 15, 16, 17, 18, 19, 20, 21, 22, 23, 24 or more weeks. The timepoints may be every 1, 2, 3, 4, 5, 6, 7, 8, 9, 10, 11, 12, 13, 14, 15, 16, 17, 18, 19, 20, 21, 22, 23, 24 or more months. The timepoints may be every 1, 2, 3, 4, 5, 6, 7, 8, 9, 10, 11, 12, 13, 14, 15, 16, 17, 18, 19, 20, 21, 22, 23, 24 or more years. The timepoints may be before diagnosis, after diagnosis, before treatment, during treatment, after treatment, before metastasis, after metastatis, before remission, during remission, or a combination thereof.

The compositions and kits may comprise a first probe comprising a first target-specific sequence and a first unique sequence and a second probe comprising a second target-specific sequence and a second unique sequence, wherein the first target specific sequence and the second target specific sequence are identical and the first unique sequence and the second unique sequence are different. The compositions and kits may comprise a first probe comprising a first target-specific sequence and a first unique sequence and a second probe comprising a second target-specific sequence and a second unique sequence, wherein the first target specific sequence and the second target specific sequence are different and the first unique sequence and the second unique sequence are different. The compositions and kits may comprise a first probe comprising a first target-specific sequence and a first unique sequence and a second probe comprising a second target-specific sequence and a second unique sequence, wherein the first target specific sequence and the second target specific sequence are identical and the first unique sequence and the second unique sequence are identical. The compositions and kits may comprise a first probe comprising a first target-specific sequence and a first unique sequence and a second probe comprising a second target-specific sequence and a second unique sequence, wherein the first target specific sequence and the second target specific sequence are different and the first unique sequence and the second unique sequence are identical.

The probes may further comprise a universal sequence. The universal sequence may comprise a primer binding site. The universal sequence may enable detection of the target sequence. The universal sequence may enable amplification of the target sequence. The universal sequence may enable transcription or reverse transcription of the target sequence. The universal sequence may enable sequencing of the target sequence.

The probe and antibody compositions of the present disclosure may also be provided on a solid support. The solid support may comprise one or more beads, plates, solid surfaces, wells, chips, or a combination thereof. The beads may be magnetic, antibody coated, protein A crosslinked, protein G crosslinked, streptavidin coated, oligonucleotide conjugated, silica coated, or a combination thereof. Examples of beads include, but are not limited to, Ampure beads, AMPure XP beads, streptavidin beads, agarose beads, magnetic beads, Dynabeads®, MACS® microbeads, antibody conjugated beads (e.g., anti-immunoglobulin microbead), protein A conjugated beads, protein G conjugated beads, protein A/G conjugated beads, protein L conjugated beads, oligo-dT conjugated beads, silica beads, silica-like beads, anti-biotin microbead, anti-fluorochrome microbead, and BcMag™ Carboxy-Terminated Magnetic Beads.

The compositions and kits may comprise primers and primer pairs capable of amplifying target molecules, or fragments or subsequences or complements thereof. The nucleotide sequences of the target molecules may be provided in computer-readable media for in silico applications and as a basis for the design of appropriate primers for amplification of one or more target molecules.

Primers based on the nucleotide sequences of target molecules can be designed for use in amplification of the target molecules. For use in amplification reactions such as PCR, a pair of primers can be used. The exact composition of the primer sequences is not critical to the disclosure, but for most applications the primers may hybridize to specific sequences of the target molecules or the universal sequence of the probe under stringent conditions, particularly under conditions of high stringency, as known in the art. The pairs of primers are usually chosen so as to generate an amplification product of at least about 15 or more, 20 or more, 30 or more, 40 or more, 50 or more, 60 or more, 70 or more, 80 or more, 90 or more, 100 or more, 125 or more, 150 or more, 175 or more, 200 or more, 250 or more, 300 or more, 350 or more, 400 or more, 450 or more, 500 or more, 600 or more, 700 or more, 800 or more, 900 or more, or 1000 or more nucleotides. Algorithms for the selection of primer sequences are generally known, and are available in commercial software packages. These primers may be used in standard quantitative or qualitative PCR-based assays to assess transcript expression levels of target molecules. Alternatively, these primers may be used in combination with probes, such as molecular beacons in amplifications using real-time PCR.

One skilled in the art also appreciates that the nucleotide sequence of the entire length of the primer does not need to be derived from the target sequence. Thus, for example, the primer may comprise nucleotide sequences at the 5' and/or 3' termini that are not derived from the target molecule. Nucleotide sequences which are not derived from the nucleotide sequence of the target molecule may provide additional functionality to the primer. For example, they may provide a restriction enzyme recognition sequence or a "tag" that facilitates detection, isolation, purification or immobilization onto a solid support. Alternatively, the additional nucleotides may provide a self-complementary sequence that allows the primer to adopt a hairpin configuration. Such configurations may be necessary for certain primers, for example, molecular beacon and Scorpion primers, which can be used in solution hybridization techniques.

The probes or primers can incorporate moieties useful in detection, isolation, purification, or immobilization, if desired. Such moieties are well-known in the art (see, for example, Ausubel et al., (1997 & updates) *Current Protocols in Molecular Biology*, Wiley & Sons, New York) and are chosen such that the ability of the probe to hybridize with its target molecule is not affected.

Examples of suitable moieties are detectable labels, such as radioisotopes, fluorophores, chemiluminophores, enzymes, colloidal particles, and fluorescent microparticles, as well as antigens, antibodies, haptens, avidin/streptavidin, biotin, haptens, enzyme cofactors/substrates, enzymes, and the like.

A label can optionally be attached to or incorporated into a probe or primer to allow detection and/or quantitation of a target polynucleotide representing the target molecule of interest. The target polynucleotide may be the expressed target molecule RNA itself, a cDNA copy thereof, or an amplification product derived therefrom, and may be the positive or negative strand, so long as it can be specifically detected in the assay being used. Similarly, an antibody may be labeled.

In certain multiplex formats, labels used for detecting different target molecules may be distinguishable. The label can be attached directly (e.g., via covalent linkage) or indirectly, e.g., via a bridging molecule or series of molecules (e.g., a molecule or complex that can bind to an assay component, or via members of a binding pair that can be incorporated into assay components, e.g. biotin-avidin or streptavidin). Many labels are commercially available in activated forms which can readily be used for such conjugation (for example through amine acylation), or labels may be attached through known or determinable conjugation schemes, many of which are known in the art.

Labels useful in the disclosure described herein include any substance which can be detected when bound to or incorporated into the target molecule. Any effective detection method can be used, including optical, spectroscopic, electrical, piezoelectrical, magnetic, Raman scattering, surface plasmon resonance, colorimetric, calorimetric, etc. A label is typically selected from a chromophore, a lumiphore, a fluorophore, one member of a quenching system, a chromogen, a hapten, an antigen, a magnetic particle, a material exhibiting nonlinear optics, a semiconductor nanocrystal, a metal nanoparticle, an enzyme, an antibody or binding portion or equivalent thereof, an aptamer, and one member of a binding pair, and combinations thereof. Quenching schemes may be used, wherein a quencher and a fluorophore as members of a quenching pair may be used on a probe, such that a change in optical parameters occurs upon binding to the target introduce or quench the signal from the fluorophore. One example of such a system is a molecular beacon. Suitable quencher/fluorophore systems are known in the art. The label may be bound through a variety of intermediate linkages. For example, a target polynucleotide may comprise a biotin-binding species, and an optically detectable label may be conjugated to biotin and then bound to the labeled target polynucleotide. Similarly, a polynucleotide sensor may comprise an immunological species such as an antibody or fragment, and a secondary antibody containing an optically detectable label may be added.

Chromophores useful in the methods described herein include any substance which can absorb energy and emit light. For multiplexed assays, a plurality of different signaling chromophores can be used with detectably different emission spectra. The chromophore can be a lumophore or a fluorophore. Typical fluorophores include fluorescent dyes, semiconductor nanocrystals, lanthanide chelates, polynucleotide-specific dyes and green fluorescent protein.

Coding schemes may optionally be used, comprising encoded particles and/or encoded tags associated with different polynucleotides of the disclosure. A variety of different coding schemes are known in the art, including fluorophores, including SCNCs, deposited metals, and RF tags.

Polynucleotides from the described target molecules may be employed as probes for detecting target molecules expression, for ligation amplification schemes, or may be used as primers for amplification schemes of all or a portion of a target molecule. When amplified, either strand produced by amplification may be provided in purified and/or isolated form.

In some instances, the compositions and kits comprise a biomarker library. The biomarker library may comprise 1 or more, 2 or more, 3 or more, 4 or more, 5 or more, 6 or more, 7 or more, 8 or more, 9 or more, 10 or more, 11 or more, 12 or more, 13 or more, 14 or more, 15 or more, 20 or more, 25 or more, 30 or more, 35 or more, 40 or more, 45 or more, 50 or more, 60 or more, 70 or more, 80 or more, 90 or more, 100 or more, 110 or more, 120 or more target molecules. The target molecules may be a ncRNA, RNA, DNA, cDNA, mRNA, a portion or fragment thereof or a combination thereof. In some instances, at least a portion of the target molecules are ncRNAs. The biomarker library may comprise 1 or more, 2 or more, 3 or more, 4 or more, 5 or more, 6 or more, 7 or more, 8 or more, 9 or more, 10 or more, 11 or more, 12 or more, 13 or more, 14 or more, 15 or more, 20 or more, 25 or more, 30 or more, 35 or more, 40 or more, 45 or more, 50 or more, 60 or more, 70 or more, 80 or more, 90 or more, 100 or more, 110 or more, 120 or more ncRNAs disclosed herein.

In some embodiments, is a kit for analyzing a cancer comprising (a) a probe set comprising a plurality of probes comprising target specific sequences complementary to one or more target molecules, wherein the one or more target molecules comprise one or more ncRNAs; and (b) a computer model or algorithm for analyzing an expression level and/or expression profile of the one or more target molecules in a sample. The target molecules may comprise one or more of those described by SEQ ID NOs:1-2309, or a combination thereof. In some embodiments, is a kit for analyzing a cancer comprising (a) a probe set comprising a plurality of probes comprising target specific sequences complementary to one or more target molecules of a biomarker library; and (b) a computer model or algorithm for analyzing an expression level and/or expression profile of the one or more target molecules in a sample. Control samples and/or nucleic acids may optionally be provided in the kit. Control samples may include tissue and/or nucleic acids obtained from or representative of tumor samples from a healthy subject, as well as tissue and/or nucleic acids obtained from or representative of tumor samples from subjects diagnosed with a cancer.

Instructions for using the kit to perform one or more methods of the disclosure can be provided, and can be provided in any fixed medium. The instructions may be located inside or outside a container or housing, and/or may be printed on the interior or exterior of any surface thereof. A kit may be in multiplex form for concurrently detecting and/or quantitating one or more different target polynucleotides representing the expressed target molecules.

iv. Devices

Devices useful for performing methods of the disclosure are also provided. The devices can comprise means for characterizing the expression level of a target molecule of the disclosure, for example components for performing one or more methods of nucleic acid extraction, amplification, and/or detection. Such components may include one or more of an amplification chamber (for example a thermal cycler), a plate reader, a spectrophotometer, capillary electrophoresis apparatus, a chip reader, and or robotic sample handling components. These components ultimately can obtain data that reflects the expression level of the target molecules used in the assay being employed.

The devices may include an excitation and/or a detection means. Any instrument that provides a wavelength that can excite a species of interest and is shorter than the emission wavelength(s) to be detected can be used for excitation. Commercially available devices can provide suitable excitation wavelengths as well as suitable detection component.

Exemplary excitation sources include a broadband UV light source such as a deuterium lamp with an appropriate filter, the output of a white light source such as a xenon lamp or a deuterium lamp after passing through a monochromator to extract out the desired wavelength(s), a continuous wave (cw) gas laser, a solid state diode laser, or any of the pulsed lasers. Emitted light can be detected through any suitable device or technique; many suitable approaches are known in the art. For example, a fluorimeter or spectrophotometer may be used to detect whether the test sample emits light of a wavelength characteristic of a label used in an assay.

The devices typically comprise a means for identifying a given sample, and of linking the results obtained to that sample. Such means can include manual labels, barcodes, and other indicators which can be linked to a sample vessel, and/or may optionally be included in the sample itself, for example where an encoded particle is added to the sample. The results may be linked to the sample, for example in a computer memory that contains a sample designation and a record of expression levels obtained from the sample. Linkage of the results to the sample can also include a linkage to a particular sample receptacle in the device, which is also linked to the sample identity.

The devices also comprise a means for correlating the expression levels of the target molecules being studied with a prognosis of disease outcome. Such means may comprise one or more of a variety of correlative techniques, including lookup tables, algorithms, multivariate models, and linear or nonlinear combinations of expression models or algorithms. The expression levels may be converted to one or more likelihood scores, reflecting a likelihood that the patient providing the sample may exhibit a particular disease outcome. The models and/or algorithms can be provided in machine readable format and can optionally further designate a treatment modality for a patient or class of patients.

The device also comprises output means for outputting the disease status, prognosis and/or a treatment modality. Such output means can take any form which transmits the results to a patient and/or a healthcare provider, and may include a monitor, a printed format, or both. The device may use a computer system for performing one or more of the steps provided.

The methods disclosed herein may also comprise the transmission of data/information. For example, data/information derived from the detection and/or quantification of the target may be transmitted to another device and/or instrument. In some instances, the information obtained from an algorithm may also be transmitted to another device and/or instrument. Transmission of the data/information may comprise the transfer of data/information from a first source to a second source. The first and second sources may be in the same approximate location (e.g., within the same room, building, block, campus). Alternatively, first and second sources may be in multiple locations (e.g., multiple cities, states, countries, continents, etc).

Transmission of the data/information may comprise digital transmission or analog transmission. Digital transmission may comprise the physical transfer of data (a digital bit stream) over a point-to-point or point-to-multipoint communication channel. Examples of such channels are copper wires, optical fibres, wireless communication channels, and storage media. The data may be represented as an electromagnetic signal, such as an electrical voltage, radiowave, microwave, or infrared signal.

Analog transmission may comprise the transfer of a continuously varying analog signal. The messages can either be represented by a sequence of pulses by means of a line code (baseband transmission), or by a limited set of continuously varying wave forms (passband transmission), using a digital modulation method. The passband modulation and corresponding demodulation (also known as detection) can be carried out by modem equipment. According to the most common definition of digital signal, both baseband and passband signals representing bit-streams are considered as digital transmission, while an alternative definition only considers the baseband signal as digital, and passband transmission of digital data as a form of digital-to-analog conversion.

v. Samples

Samples for use with the compositions and kits and in the methods of the present disclosure comprise nucleic acids suitable for providing RNA expression information. In principle, the biological sample from which the expressed RNA is obtained and analyzed for target molecule expression can be any material suspected of comprising cancer tissue or cells. The sample can be a biological sample used directly in a method of the disclosure. Alternatively, the sample can be a sample prepared from a biological sample.

In one embodiment, the sample or portion of the sample comprising or suspected of comprising cancer tissue or cells can be any source of biological material, including cells, tissue, secretions, or fluid, including bodily fluids. Non-limiting examples of the source of the sample include an aspirate, a needle biopsy, a cytology pellet, a bulk tissue preparation or a section thereof obtained for example by surgery or autopsy, lymph fluid, blood, plasma, serum, tumors, and organs. Alternatively, or additionally, the source of the sample can be urine, bile, excrement, sweat, tears, vaginal fluids, spinal fluid, and stool. In some instances, the sources of the sample are secretions. In some instances, the secretions are exosomes.

The samples may be archival samples, having a known and documented medical outcome, or may be samples from current patients whose ultimate medical outcome is not yet known.

In some embodiments, the sample may be dissected prior to molecular analysis. The sample may be prepared via macrodissection of a bulk tumor specimen or portion thereof, or may be treated via microdissection, for example via Laser Capture Microdissection (LCM).

The sample may initially be provided in a variety of states, as fresh tissue, fresh frozen tissue, fine needle aspirates, and may be fixed or unfixed. Frequently, medical laboratories routinely prepare medical samples in a fixed state, which facilitates tissue storage. A variety of fixatives can be used to fix tissue to stabilize the morphology of cells, and may be used alone or in combination with other agents. Exemplary fixatives include crosslinking agents, alcohols, acetone, Bouin's solution, Zenker solution, Hely solution, osmic acid solution and Carnoy solution.

Crosslinking fixatives can comprise any agent suitable for forming two or more covalent bonds, for example, an aldehyde. Sources of aldehydes typically used for fixation include formaldehyde, paraformaldehyde, glutaraldehyde or formalin. Preferably, the crosslinking agent comprises formaldehyde, which may be included in its native form or in the form of paraformaldehyde or formalin. One of skill in the art would appreciate that for samples in which crosslinking fixatives have been used special preparatory steps may be necessary including for example heating steps and proteinase-k digestion.

One or more alcohols may be used to fix tissue, alone or in combination with other fixatives. Exemplary alcohols used for fixation include methanol, ethanol and isopropanol.

Formalin fixation is frequently used in medical laboratories. Formalin comprises both an alcohol, typically methanol, and formaldehyde, both of which can act to fix a biological sample.

Whether fixed or unfixed, the biological sample may optionally be embedded in an embedding medium. Exemplary embedding media used in histology including paraffin, Tissue-Tek® V.I.P.™, Paramat, Paramat Extra, Paraplast, Paraplast X-tra, Paraplast Plus, Peel Away Paraffin Embedding Wax, Polyester Wax, Carbowax Polyethylene Glycol, Polyfin™, Tissue Freezing Medium TFMFM, Cryo-Gel™, and OCT Compound (Electron Microscopy Sciences, Hatfield, Pa.). Prior to molecular analysis, the embedding material may be removed via any suitable techniques, as known in the art. For example, where the sample is embedded in wax, the embedding material may be removed by extraction with organic solvent(s), for example xylenes. Kits are commercially available for removing embedding media from tissues. Samples or sections thereof may be subjected to further processing steps as needed, for example serial hydration or dehydration steps.

In some embodiments, the sample is a fixed, wax-embedded biological sample. Frequently, samples from medical laboratories are provided as fixed, wax-embedded samples, most commonly as formalin-fixed, paraffin embedded (FFPE) tissues.

Whatever the source of the biological sample, the target polynucleotide that is ultimately assayed can be prepared synthetically (in the case of control sequences), but typically is purified from the biological source and subjected to one or more preparative steps. The RNA may be purified to remove or diminish one or more undesired components from the biological sample or to concentrate it. Conversely, where the RNA is too concentrated for the particular assay, it may be diluted.

II. Drug Screening Applications

In some embodiments, the present disclosure provides drug screening assays (e.g., to screen for anticancer drugs).

The screening methods of the present disclosure utilize ncRNAs. For example, in some embodiments, the present disclosure provides methods of screening for compounds that alter the expression or activity of ncRNAs. The compounds may increase the expression or activity of the ncRNAs. The compounds may decrease the expression or activity of the ncRNAs. The compounds or agents may interfere with transcription, by interacting, for example, with the promoter region. The compounds or agents may interfere with mRNA (e.g., by RNA interference, antisense technologies, etc.). The compounds or agents may interfere with pathways that are upstream or downstream of the biological activity of ncRNAs. In some embodiments, candidate compounds are antisense or interfering RNA agents (e.g., oligonucleotides) directed against ncRNAs. In other embodiments, candidate compounds are antibodies or small molecules that specifically bind to a ncRNA regulator. Alternatively, or additionally, the candidate compounds are expression products that inhibit the biological function of the ncRNAs.

In one screening method, candidate compounds are evaluated for their ability to alter ncRNAs expression by contacting a compound with a cell expressing a ncRNA and then assaying for the effect of the candidate compounds on expression. In some embodiments, the effect of candidate compounds on expression of ncRNAs is assayed for by detecting the level ncRNA expressed by the cell. mRNA expression can be detected by any suitable method.

III. Diagnosis, Prognosis, and Monitoring

The methods, compositions, and kits disclosed herein may be used for the diagnosis, prognosis, and/or monitoring the status or outcome of a cancer in a subject. In some embodiments, the diagnosing, predicting, and/or monitoring the status or outcome of a cancer comprises determining the malignancy or malignant potential of the cancer or tumor. Alternatively, the diagnosing, predicting, and/or monitoring the status or outcome of a cancer comprises determining the stage of the cancer. The diagnosing, predicting, and/or monitoring the status or outcome of a cancer can comprise determining the tumor grade. Alternatively, the diagnosing, predicting, and/or monitoring the status or outcome of a cancer comprises assessing the risk of developing a cancer. In some embodiments, the diagnosing, predicting, and/or monitoring the status or outcome of a cancer includes assessing the risk of cancer recurrence. In some embodiments, diagnosing, predicting, and/or monitoring the status or outcome of a cancer may comprise determining the efficacy of treatment.

In some embodiments, diagnosing, predicting, and/or monitoring the status or outcome of a cancer may comprise determining a therapeutic regimen. Determining a therapeutic regimen may comprise administering an anti-cancer therapeutic. Alternatively, determining the treatment for the cancer may comprise modifying a therapeutic regimen. Modifying a therapeutic regimen may comprise increasing, decreasing, or terminating a therapeutic regimen.

In some instances, the methods disclosed herein can diagnose, prognose, and/or monitor the status or outcome of a cancer in a subject with an accuracy of at least about 50%. In other instances, the methods disclosed herein can diagnose, prognose, and/or monitor the status or outcome of a cancer in a subject with an accuracy of at least about 60%. The methods disclosed herein can diagnose, prognose, and/or monitor the status or outcome of a cancer in a subject with an accuracy of at least about 65%. Alternatively, the methods disclosed herein can diagnose, prognose, and/or monitor the status or outcome of a cancer in a subject with an accuracy of at least about 70%. In some instances, the methods disclosed herein can diagnose, prognose, and/or monitor the status or outcome of a cancer in a subject with an accuracy of at least about 75%. In other instances, the methods disclosed herein can diagnose, prognose, and/or monitor the status or outcome of a cancer in a subject with an accuracy of at least about 80%. The methods disclosed herein can diagnose, prognose, and/or monitor the status or outcome of a cancer in a subject with an accuracy of at least about 85%. Alternatively, the methods disclosed herein can diagnose, prognose, and/or monitor the status or outcome of a cancer in a subject with an accuracy of at least about 90%. The methods disclosed herein can diagnose, prognose, and/or monitor the status or outcome of a cancer in a subject with an accuracy of at least about 95%.

The disclosure also encompasses any of the methods disclosed herein where the sensitivity is at least about 45%. In some embodiments, the sensitivity is at least about 50%. In some embodiments, the sensitivity is at least about 55%. In some embodiments, the sensitivity is at least about 60%. In some embodiments, the sensitivity is at least about 65%. In some embodiments, the sensitivity is at least about 70%. In some embodiments, the sensitivity is at least about 75%. In some embodiments, the sensitivity is at least about 80%. In some embodiments, the sensitivity is at least about 85%. In some embodiments, the sensitivity is at least about 90%. In some embodiments, the sensitivity is at least about 95%.

The disclosure also encompasses any of the methods disclosed herein where the expression level determines the status or outcome of a cancer in the subject with at least about 45% specificity. In some embodiments, the expression level determines the status or outcome of a cancer in the subject with at least about 50% specificity. In some embodiments, the expression level determines the status or outcome of a cancer in the subject with at least about 55% specificity. In some embodiments, the expression level determines the status or outcome of a cancer in the subject with at least about 60% specificity. In some embodiments, the expression level determines the status or outcome of a cancer in the subject with at least about 65% specificity. In some embodiments, the expression level determines the status or outcome of a cancer in the subject with at least about 70% specificity. In some embodiments, the expression level determines the status or outcome of a cancer in the subject with at least about 75% specificity. In some embodiments, the expression level determines the status or outcome of a cancer in the subject with at least about 80% specificity. In some embodiments, the expression level determines the status or outcome of a cancer in the subject with at least about 85% specificity. In some embodiments, the expression level determines the status or outcome of a cancer in the subject with at least about 90% specificity. In some embodiments, the expression level determines the status or outcome of a cancer in the subject with at least about 95% specificity.

Cancer

The systems, compositions and methods disclosed herein may be used to diagnosis, monitor and/or predict the status or outcome of a cancer. Generally, a cancer is characterized by the uncontrolled growth of abnormal cells anywhere in a body. The abnormal cells may be termed cancer cells, malignant cells, or tumor cells. Many cancers and the abnormal cells that compose the cancer tissue are further identified by the name of the tissue that the abnormal cells originated from (for example, breast cancer, lung cancer, colon cancer, prostate cancer, pancreatic cancer, thyroid cancer). Cancer is not confined to humans; animals and other living organisms can get cancer.

In some instances, the cancer may be malignant. Alternatively, the cancer may be benign. The cancer may be a recurrent and/or refractory cancer. Most cancers can be classified as a carcinoma, sarcoma, leukemia, lymphoma, myeloma, or a central nervous system cancer.

The cancer may be a sarcoma. Sarcomas are cancers of the bone, cartilage, fat, muscle, blood vessels, or other connective or supportive tissue. Sarcomas include, but are not limited to, bone cancer, fibrosarcoma, chondrosarcoma, Ewing's sarcoma, malignant hemangioendothelioma, malignant schwannoma, bilateral vestibular schwannoma, osteosarcoma, soft tissue sarcomas (e.g. alveolar soft part sarcoma, angiosarcoma, cystosarcoma phylloides, dermatofibrosarcoma, desmoid tumor, epithelioid sarcoma, extraskeletal osteosarcoma, fibrosarcoma, hemangiopericytoma, hemangiosarcoma, Kaposi's sarcoma, leiomyosarcoma, liposarcoma, lymphangiosarcoma, lymphosarcoma, malignant fibrous histiocytoma, neurofibrosarcoma, rhabdomyosarcoma, and synovial sarcoma).

Alternatively, the cancer may be a carcinoma. Carcinomas are cancers that begin in the epithelial cells, which are cells that cover the surface of the body, produce hormones, and make up glands. By way of non-limiting example, carcinomas include breast cancer, pancreatic cancer, lung cancer, colon cancer, colorectal cancer, rectal cancer, kidney cancer, bladder cancer, stomach cancer, prostate cancer, liver cancer, ovarian cancer, brain cancer, vaginal cancer, vulvar cancer, uterine cancer, oral cancer, penic cancer, testicular cancer, esophageal cancer, skin cancer, cancer of the fallopian tubes, head and neck cancer, gastrointestinal stromal cancer, adenocarcinoma, cutaneous or intraocular melanoma, cancer of the anal region, cancer of the small intestine, cancer of the endocrine system, cancer of the thyroid gland, cancer of the parathyroid gland, cancer of the adrenal gland, cancer of the urethra, cancer of the renal pelvis, cancer of the ureter, cancer of the endometrium, cancer of the cervix, cancer of the pituitary gland, neoplasms of the central nervous system (CNS), primary CNS lymphoma, brain stem glioma, and spinal axis tumors. In some instances, the cancer is a skin cancer, such as a basal cell carcinoma, squamous, melanoma, nonmelanoma, or actinic (solar) keratosis. Preferably, the cancer is a prostate cancer. Alternatively, the cancer may be a thyroid cancer. The cancer can be a pancreatic cancer. In some instances, the cancer is a bladder cancer.

In some instances, the cancer is a lung cancer. Lung cancer can start in the airways that branch off the trachea to supply the lungs (bronchi) or the small air sacs of the lung (the alveoli). Lung cancers include non-small cell lung carcinoma (NSCLC), small cell lung carcinoma, and mesotheliomia. Examples of NSCLC include squamous cell carcinoma, adenocarcinoma, and large cell carcinoma. The mesothelioma may be a cancerous tumor of the lining of the lung and chest cavity (pleura) or lining of the abdomen (peritoneum). The mesothelioma may be due to asbestos exposure. The cancer may be a brain cancer, such as a glioblastoma.

Alternatively, the cancer may be a central nervous system (CNS) tumor. CNS tumors may be classified as gliomas or nongliomas. The glioma may be malignant glioma, high grade glioma, diffuse intrinsic pontine glioma. Examples of gliomas include astrocytomas, oligodendrogliomas (or mixtures of oligodendroglioma and astocytoma elements), and ependymomas. Astrocytomas include, but are not limited to, low-grade astrocytomas, anaplastic astrocytomas, glioblastoma multiforme, pilocytic astrocytoma, pleomorphic xanthoastrocytoma, and subependymal giant cell astrocytoma. Oligodendrogliomas include low-grade oligodendrogliomas (or oligoastrocytomas) and anaplastic oligodendriogliomas. Nongliomas include meningiomas, pituitary adenomas, primary CNS lymphomas, and medulloblastomas. In some instances, the cancer is a meningioma.

The cancer may be leukemia. The leukemia may be an acute lymphocytic leukemia, acute myelocytic leukemia, chronic lymphocytic leukemia, or chronic myelocytic leukemia. Additional types of leukemias include hairy cell leukemia, chronic myelomonocytic leukemia, and juvenile myelomonocytic-leukemia.

In some instances, the cancer is a lymphoma. Lymphomas are cancers of the lymphocytes and may develop from either B or T lymphocytes. The two major types of lymphoma are Hodgkin's lymphoma, previously known as Hodgkin's disease, and non-Hodgkin's lymphoma. Hodgkin's lymphoma is marked by the presence of the Reed-Sternberg cell. Non-Hodgkin's lymphomas are all lymphomas which are not Hodgkin's lymphoma. Non-Hodgkin lymphomas may be indolent lymphomas and aggressive lymphomas. Non-Hodgkin's lymphomas include, but are not limited to, diffuse large B cell lymphoma, follicular lymphoma, mucosa-associated lymphatic tissue lymphoma (MALT), small cell lymphocytic lymphoma, mantle cell lymphoma, Burkitt's lymphoma, mediastinal large B cell lymphoma, Waldenström macroglobulinemia, nodal marginal zone B cell lymphoma (NMZL), splenic marginal zone lymphoma (SMZL), extranodal marginal zone B cell lymphoma, intravascular large B cell lymphoma, primary effusion lymphoma, and lymphomatoid granulomatosis.

Cancer Staging

Diagnosing, predicting, or monitoring a status or outcome of a cancer may comprise determining the stage of the cancer. Generally, the stage of a cancer is a description (usually numbers I to IV with IV having more progression) of the extent the cancer has spread. The stage often takes into account the size of a tumor, how deeply it has penetrated, whether it has invaded adjacent organs, how many lymph nodes it has metastasized to (if any), and whether it has spread to distant organs. Staging of cancer can be used as a predictor of survival, and cancer treatment may be determined by staging. Determining the stage of the cancer may occur before, during, or after treatment. The stage of the cancer may also be determined at the time of diagnosis.

Cancer staging can be divided into a clinical stage and a pathologic stage. Cancer staging may comprise the TNM classification. Generally, the TNM Classification of Malignant Tumours (TNM) is a cancer staging system that describes the extent of cancer in a patient's body. T may describe the size of the tumor and whether it has invaded nearby tissue, N may describe regional lymph nodes that are involved, and M may describe distant metastasis (spread of cancer from one body part to another). In the TNM (Tumor, Node, Metastasis) system, clinical stage and pathologic stage are denoted by a small "c" or "p" before the stage (e.g., cT3N1M0 or pT2N0).

Often, clinical stage and pathologic stage may differ. Clinical stage may be based on all of the available information obtained before a surgery to remove the tumor. Thus, it may include information about the tumor obtained by physical examination, radiologic examination, and endoscopy. Pathologic stage can add additional information gained by examination of the tumor microscopically by a pathologist. Pathologic staging can allow direct examination of the tumor and its spread, contrasted with clinical staging which may be limited by the fact that the information is obtained by making indirect observations at a tumor which is still in the body. The TNM staging system can be used for most forms of cancer.

Alternatively, staging may comprise Ann Arbor staging. Generally, Ann Arbor staging is the staging system for lymphomas, both in Hodgkin's lymphoma (previously called Hodgkin's disease) and Non-Hodgkin lymphoma (abbreviated NHL). The stage may depend on both the place where the malignant tissue is located (as located with biopsy, CT scanning and increasingly positron emission tomography) and on systemic symptoms due to the lymphoma ("B symptoms": night sweats, weight loss of >10% or fevers). The principal stage may be determined by location of the tumor. Stage I may indicate that the cancer is located in a single region, usually one lymph node and the surrounding area. Stage I often may not have outward symptoms. Stage II can indicate that the cancer is located in two separate regions, an affected lymph node or organ and a second affected area, and that both affected areas are confined to one side of the diaphragm—that is, both are above the diaphragm, or both are below the diaphragm. Stage III often indicates that the cancer has spread to both sides of the diaphragm, including one organ or area near the lymph nodes or the spleen. Stage IV may indicate diffuse or disseminated involvement of one or more extralymphatic organs, including any involvement of the liver, bone marrow, or nodular involvement of the lungs.

Modifiers may also be appended to some stages. For example, the letters A, B, E, X, or S can be appended to some stages. Generally, A or B may indicate the absence of constitutional (B-type) symptoms is denoted by adding an "A" to the stage; the presence is denoted by adding a "B" to the stage. E can be used if the disease is "extranodal" (not in the lymph nodes) or has spread from lymph nodes to adjacent tissue. X is often used if the largest deposit is >10 cm large ("bulky disease"), or whether the mediastinum is wider than ⅓ of the chest on a chest X-ray. S may be used if the disease has spread to the spleen.

The nature of the staging may be expressed with CS or PS. CS may denote that the clinical stage as obtained by doctor's examinations and tests. PS may denote that the pathological stage as obtained by exploratory laparotomy (surgery performed through an abdominal incision) with splenectomy (surgical removal of the spleen).

Therapeutic Regimens

Diagnosing, predicting, or monitoring a status or outcome of a cancer may comprise treating a cancer or preventing a cancer progression. In addition, diagnosing, predicting, or monitoring a status or outcome of a cancer may comprise identifying or predicting responders to an anti-cancer therapy. In some instances, diagnosing, predicting, or monitoring may comprise determining a therapeutic regimen. Determining a therapeutic regimen may comprise administering an anti-cancer therapy. Alternatively, determining a therapeutic regimen may comprise modifying, recommending, continuing or discontinuing an anti-cancer regimen. In some instances, if the sample expression patterns are consistent with the expression pattern for a known disease or disease outcome, the expression patterns can be used to designate one or more treatment modalities (e.g., therapeutic regimens, anti-cancer regimen). An anti-cancer regimen may comprise one or more anti-cancer therapies. Examples of anti-cancer therapies include targeting cancer therapy (e.g., targeting the non-coding RNAs described herein), surgery, chemotherapy, radiation therapy, immunotherapy/biological therapy, photodynamic therapy. In some embodiments, the present disclsoure targets the expression of cancer markers. For example, in some embodiments, the present disclsoure employs compositions comprising oligomeric antisense or RNAi compounds, particularly oligonucleotides (e.g., those identified in the drug screening methods described above), for use in modulating the function of nucleic acid molecules encoding cancer markers of the present disclsoure, ultimately modulating the amount of cancer marker expressed.

In some embodiments, RNAi is utilized to target non-coding RNAs (e.g., one or more of SEQ ID NOs: 1-2309). RNAi represents an evolutionary conserved cellular defense for controlling the expression of foreign genes in most eukaryotes, including humans. RNAi is typically triggered by double-stranded RNA (dsRNA) and causes sequence-specific mRNA degradation of single-stranded target RNAs homologous in response to dsRNA. The mediators of mRNA degradation are small interfering RNA duplexes (siRNAs), which are normally produced from long dsRNA by enzymatic cleavage in the cell. siRNAs are generally approximately twenty-one nucleotides in length (e.g. 21-23 nucleotides in length), and have a base-paired structure characterized by two nucleotide 3'-overhangs. Following the introduction of a small RNA, or RNAi, into the cell, it is believed the sequence is delivered to an enzyme complex called RISC (RNA-induced silencing complex). RISC recognizes the target and cleaves it with an endonuclease. It is noted that if larger RNA sequences are delivered to a cell, RNase III enzyme (Dicer) converts longer dsRNA into 21-23 nt ds siRNA fragments.

Chemically synthesized siRNAs have become powerful reagents for genome-wide analysis of mammalian gene function in cultured somatic cells. Beyond their value for validation of gene function, siRNAs also hold great potential as gene-specific therapeutic agents (Tuschl and Borkhardt, Molecular Intervent. 2002; 2(3):158-67, herein incorporated by reference).

The transfection of siRNAs into animal cells results in the potent, long-lasting post-transcriptional silencing of specific genes (Caplen et al, Proc Natl Acad Sci U.S.A. 2001; 98: 9742-7; Elbashir et al., Nature. 2001; 411:494-8; Elbashir et al., Genes Dev. 2001; 15: 188-200; and Elbashir et al., EMBO J. 2001; 20: 6877-88, all of which are herein incorporated by reference). Methods and compositions for performing RNAi with siRNAs are described, for example, in U.S. Pat. No. 6,506,559, herein incorporated by reference.

siRNAs are extraordinarily effective at lowering the amounts of targeted RNA, and by extension proteins, frequently to undetectable levels. The silencing effect can last several months, and is extraordinarily specific, because one nucleotide mismatch between the target RNA and the central region of the siRNA is frequently sufficient to prevent silencing (Brummelkamp et al, Science 2002; 296:550-3; and Holen et al, Nucleic Acids Res. 2002; 30:1757-66, both of which are herein incorporated by reference).

An important factor in the design of siRNAs is the presence of accessible sites for siRNA binding. Bahoia et al., (J. Biol. Chem., 2003; 278: 15991-15997; herein incorporated by reference) describe the use of a type of DNA array called a scanning array to find accessible sites in mRNAs for designing effective siRNAs. These arrays comprise oligonucleotides ranging in size from monomers to a certain maximum, usually Comers, synthesized using a physical barrier (mask) by stepwise addition of each base in the sequence. Thus the arrays represent a full oligonucleotide complement of a region of the target gene. Hybridization of the target mRNA to these arrays provides an exhaustive accessibility profile of this region of the target mRNA. Such data are useful in the design of antisense oligonucleotides (ranging from 7mers to 25mers), where it is important to achieve a compromise between oligonucleotide length and binding affinity, to retain efficacy and target specificity (Sohail et al, Nucleic Acids Res., 2001; 29(10): 2041-2045). Additional methods and concerns for selecting siRNAs are described for example, in WO 05054270, WO05038054A1, WO03070966A2, J Mol Biol. 2005 May 13; 348(4):883-93, J Mol Biol. 2005 May 13; 348(4):871-81, and Nucleic Acids Res. 2003 Aug. 1; 31(15):4417-24, each of which is herein incorporated by reference in its entirety. In addition, software (e.g., the MWG online siMAX siRNA design tool) is commercially or publicly available for use in the selection of siRNAs.

In other embodiments, expression of non-coding RNAs (e.g., one or more of SEQ ID NOs: 1-2309) is modulated using antisense compounds that specifically hybridize with one or more nucleic acids encoding the RNAs. The specific hybridization of an oligomeric compound with its target nucleic acid interferes with the normal function of the nucleic acid. This modulation of function of a target nucleic acid by compounds that specifically hybridize to it is generally referred to as "antisense." The functions of DNA to be interfered with include replication and transcription. The functions of RNA to be interfered with include all vital functions such as, for example, translocation of the RNA to the site of protein translation, translation of protein from the RNA, splicing of the RNA to yield one or more mRNA species, and catalytic activity that may be engaged in or facilitated by the RNA. The overall effect of such interference with target nucleic acid function is modulation of the expression of cancer markers of the present disclsoure. In the context of the present disclsoure, "modulation" means either an increase (stimulation) or a decrease (inhibition) in the expression of a gene. For example, expression may be inhibited to potentially prevent tumor proliferation.

It is preferred to target specific nucleic acids for antisense. "Targeting" an antisense compound to a particular nucleic acid, in the context of the present disclsoure, is a multistep process. The process usually begins with the identification of a nucleic acid sequence whose function is to be modulated. This may be, for example, a cellular gene (or mRNA transcribed from the gene) whose expression is associated with a particular disorder or disease state, or a nucleic acid molecule from an infectious agent. In the present disclsoure, the target is a nucleic acid molecule encoding a cancer marker of the present disclsoure. The targeting process also includes determination of a site or sites within this gene for the antisense interaction to occur such that the desired effect, e.g., detection or modulation of expression of the protein, will result. Within the context of the present disclsoure, a preferred intragenic site is the region encompassing the translation initiation or termination codon of the open reading frame (ORF) of the gene. Since the translation initiation codon is typically 5'-AUG (in transcribed mRNA molecules; 5'-ATG in the corresponding DNA molecule), the translation initiation codon is also referred to as the "AUG codon," the "start codon" or the "AUG start codon". A minority of genes have a translation initiation codon having the RNA sequence 5'-GUG, 5'-UUG or 5'-CUG, and 5'-AUA, 5'-ACG and 5'-CUG have been shown to function in vivo. Thus, the terms "translation initiation codon" and "start codon" can encompass many codon sequences, even though the initiator amino acid in each instance is typically methionine (in eukaryotes) or formylmethionine (in prokaryotes). Eukaryotic and prokaryotic genes may have two or more alternative start codons, any one of which may be preferentially utilized for translation initiation in a particular cell type or tissue, or under a particular set of conditions. In the context of the present disclsoure, "start codon" and "translation initiation codon" refer to the codon or codons that are used in vivo to initiate translation of an RNA (e.g., one or more of SEQ ID NOs: 1-2309).

Translation termination codon (or "stop codon") of a gene may have one of three sequences (i.e., 5'-UAA, 5'-UAG and 5'-UGA; the corresponding DNA sequences are 5'-TAA, 5'-TAG and 5'-TGA, respectively). The terms "start codon region" and "translation initiation codon region" refer to a portion of such an mRNA or gene that encompasses from about 25 to about 50 contiguous nucleotides in either direction (i.e., 5' or 3') from a translation initiation codon. Similarly, the terms "stop codon region" and "translation termination codon region" refer to a portion of such an mRNA or gene that encompasses from about 25 to about 50 contiguous nucleotides in either direction (i.e., 5' or 3') from a translation termination codon.

The open reading frame (ORF) or "coding region," which refers to the region between the translation initiation codon and the translation termination codon, is also a region that may be targeted effectively. Other target regions include the 5' untranslated region (5' UTR), referring to the portion of an mRNA in the 5' direction from the translation initiation codon, and thus including nucleotides between the 5' cap site and the translation initiation codon of an mRNA or corresponding nucleotides on the gene, and the 3' untranslated region (3' UTR), referring to the portion of an mRNA in the 3' direction from the translation termination codon, and thus including nucleotides between the translation termination codon and 3' end of an mRNA or corresponding nucleotides on the gene. The 5' cap of an mRNA comprises an N7-methylated guanosine residue joined to the 5'-most residue of the mRNA via a 5'-5' triphosphate linkage. The 5' cap region of an mRNA is considered to include the 5' cap structure itself as well as the first 50 nucleotides adjacent to the cap. The cap region may also be a preferred target region.

Although some eukaryotic mRNA transcripts are directly translated, many contain one or more regions, known as "introns," that are excised from a transcript before it is translated. The remaining (and therefore translated) regions are known as "exons" and are spliced together to form a continuous mRNA sequence. mRNA splice sites (i.e., intron-exon junctions) may also be preferred target regions, and are particularly useful in situations where aberrant splicing is implicated in disease, or where an overproduction of a particular mRNA splice product is implicated in disease. It has also been found that introns can also be effective, and therefore preferred, target regions for antisense compounds targeted, for example, to DNA or pre-mRNA.

In some embodiments, target sites for antisense inhibition are identified using commercially available software programs (e.g., Biognostik, Gottingen, Germany; SysArris Software, Bangalore, India; Antisense Research Group, University of Liverpool, Liverpool, England; GeneTrove, Carlsbad, Calif.). In other embodiments, target sites for antisense inhibition are identified using the accessible site method described in PCT Publ. No. WO0198537A2, herein incorporated by reference.

Once one or more target sites have been identified, oligonucleotides are chosen that are sufficiently complementary to the target (i.e., hybridize sufficiently well and with sufficient specificity) to give the desired effect. For example, in preferred embodiments of the present disclsoure, antisense oligonucleotides are targeted to or near the start codon.

In the context of this disclsoure, "hybridization," with respect to antisense compositions and methods, means hydrogen bonding, which may be Watson-Crick, Hoogsteen or reversed Hoogsteen hydrogen bonding, between complementary nucleoside or nucleotide bases. For example, adenine and thymine are complementary nucleobases that pair through the formation of hydrogen bonds. It is understood that the sequence of an antisense compound need not be 100% complementary to that of its target nucleic acid to be specifically hybridizable. An antisense compound is specifically hybridizable when binding of the compound to the target DNA or RNA molecule interferes with the normal function of the target DNA or RNA to cause a loss of utility, and there is a sufficient degree of complementarity to avoid non-specific binding of the antisense compound to non-target sequences under conditions in which specific binding is desired (i.e., under physiological conditions in the case of in vivo assays or therapeutic treatment, and in the case of in vitro assays, under conditions in which the assays are performed).

The specificity and sensitivity of antisense is also applied for therapeutic uses. For example, antisense oligonucleotides have been employed as therapeutic moieties in the treatment of disease states in animals and man. Antisense oligonucleotides have been safely and effectively administered to humans and numerous clinical trials are presently underway. It is thus established that oligonucleotides are useful therapeutic modalities that can be configured to be useful in treatment regimes for treatment of cells, tissues, and animals, especially humans.

While antisense oligonucleotides are a preferred form of antisense compound, the present disclsoure comprehends other oligomeric antisense compounds, including but not limited to oligonucleotide mimetics such as are described below. The antisense compounds in accordance with this disclsoure preferably comprise from about 8 to about 30 nucleobases (i.e., from about 8 to about 30 linked bases), although both longer and shorter sequences may find use with the present disclsoure. Particularly preferred antisense compounds are antisense oligonucleotides, even more preferably those comprising from about 12 to about 25 nucleobases.

Specific examples of preferred antisense compounds useful with the present disclsoure include oligonucleotides containing modified backbones or non-natural internucleoside linkages. As defined in this specification, oligonucleotides having modified backbones include those that retain a phosphorus atom in the backbone and those that do not have a phosphorus atom in the backbone. For the purposes of this specification, modified oligonucleotides that do not have a phosphorus atom in their internucleoside backbone can also be considered to be oligonucleosides.

Preferred modified oligonucleotide backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms are also included.

The present disclsoure contemplates the use of any genetic manipulation for use in modulating the expression of non-coding RNAs (e.g., one or more of SEQ ID NOs: 1-2309). Examples of genetic manipulation include, but are not limited to, gene knockout (e.g., removing the gene encoding the RNA from the chromosome using, for example, recombination), expression of antisense constructs with or without inducible promoters, and the like. Delivery of nucleic acid construct to cells in vitro or in vivo may be conducted using any suitable method. A suitable method is one that introduces the nucleic acid construct into the cell such that the desired event occurs (e.g., expression of an antisense construct). Genetic therapy may also be used to deliver siRNA or other interfering molecules that are expressed in vivo (e.g., upon stimulation by an inducible promoter (e.g., an androgen-responsive promoter)).

Introduction of molecules carrying genetic information into cells is achieved by any of various methods including, but not limited to, directed injection of naked DNA constructs, bombardment with gold particles loaded with said constructs, and macromolecule mediated gene transfer using, for example, liposomes, biopolymers, and the like. Preferred methods use gene delivery vehicles derived from viruses, including, but not limited to, adenoviruses, retroviruses, vaccinia viruses, and adeno-associated viruses. Because of the higher efficiency as compared to retroviruses, vectors derived from adenoviruses are the preferred gene delivery vehicles for transferring nucleic acid molecules into host cells in vivo. Adenoviral vectors have been shown to provide very efficient in vivo gene transfer into a variety of solid tumors in animal models and into human solid tumor xenografts in immune-deficient mice. Examples of adenoviral vectors and methods for gene transfer are described in PCT publications WO 00/12738 and WO 00/09675 and U.S. Pat. Nos. 6,033,908, 6,019,978, 6,001,557, 5,994,132, 5,994,128, 5,994,106, 5,981,225, 5,885,808, 5,872,154, 5,830,730, and 5,824,544, each of which is herein incorporated by reference in its entirety.

Vectors may be administered to subject in a variety of ways. For example, in some embodiments of the present disclsoure, vectors are administered into tumors or tissue associated with tumors using direct injection. In other embodiments, administration is via the blood or lymphatic circulation (See e.g., PCT publication 99/02685 herein incorporated by reference in its entirety). Exemplary dose levels of adenoviral vector are preferably $10^8$ to $10^{11}$ vector particles added to the perfusate.

Surgical oncology uses surgical methods to diagnose, stage, and treat cancer, and to relieve certain cancer-related symptoms. Surgery may be used to remove the tumor (e.g., excisions, resections, debulking surgery), reconstruct a part of the body (e.g., restorative surgery), and/or to relieve symptoms such as pain (e.g., palliative surgery). Surgery may also include cryosurgery. Cryosurgery (also called cryotherapy) may use extreme cold produced by liquid nitrogen (or argon gas) to destroy abnormal tissue. Cryosurgery can be used to treat external tumors, such as those on the skin. For external tumors, liquid nitrogen can be applied directly to the cancer cells with a cotton swab or spraying device. Cryosurgery may also be used to treat tumors inside the body (internal tumors and tumors in the bone). For internal tumors, liquid nitrogen or argon gas may be circulated through a hollow instrument called a cryoprobe, which is placed in contact with the tumor. An ultrasound or MRI may be used to guide the cryoprobe and monitor the freezing of the cells, thus limiting damage to nearby healthy tissue. A ball of ice crystals may form around the probe, freezing nearby cells. Sometimes more than one probe is used to deliver the liquid nitrogen to various parts of the tumor. The probes may be put into the tumor during surgery or through the skin (percutaneously). After cryosurgery, the frozen tissue thaws and may be naturally absorbed by the body (for internal tumors), or may dissolve and form a scab (for external tumors).

Chemotherapeutic agents may also be used for the treatment of cancer. Examples of chemotherapeutic agents include alkylating agents, anti-metabolites, plant alkaloids and terpenoids, vinca alkaloids, podophyllotoxin, taxanes, topoisomerase inhibitors, and cytotoxic antibiotics. Cisplatin, carboplatin, and oxaliplatin are examples of alkylating agents. Other alkylating agents include mechlorethamine, cyclophosphamide, chlorambucil, ifosfamide. Alkylating agens may impair cell function by forming covalent bonds with the amino, carboxyl, sulfhydryl, and phosphate groups in biologically important molecules. Alternatively, alkylating agents may chemically modify a cell's DNA.

Anti-metabolites are another example of chemotherapeutic agents. Anti-metabolites may masquerade as purines or pyrimidines and may prevent purines and pyrimidines from becoming incorporated in to DNA during the "S" phase (of the cell cycle), thereby stopping normal development and division. Antimetabolites may also affect RNA synthesis. Examples of metabolites include azathioprine and mercaptopurine.

Alkaloids may be derived from plants and block cell division may also be used for the treatment of cancer. Alkyloids may prevent microtubule function. Examples of alkaloids are vinca alkaloids and taxanes. Vinca alkaloids may bind to specific sites on tubulin and inhibit the assembly of tubulin into microtubules (M phase of the cell cycle). The vinca alkaloids may be derived from the Madagascar periwinkle, *Catharanthus roseus* (formerly known as *Vinca rosea*). Examples of vinca alkaloids include, but are not limited to, vincristine, vinblastine, vinorelbine, or vindesine. Taxanes are diterpenes produced by the plants of the genus *Taxus* (yews). Taxanes may be derived from natural sources or synthesized artificially. Taxanes include paclitaxel (Taxol) and docetaxel (Taxotere). Taxanes may disrupt microtubule function. Microtubules are essential to cell division, and taxanes may stabilize GDP-bound tubulin in the microtubule, thereby inhibiting the process of cell division. Thus, in essence, taxanes may be mitotic inhibitors. Taxanes may also be radiosensitizing and often contain numerous chiral centers.

Alternative chemotherapeutic agents include podophyllotoxin. Podophyllotoxin is a plant-derived compound that may help with digestion and may be used to produce cytostatic drugs such as etoposide and teniposide. They may prevent the cell from entering the G1 phase (the start of DNA replication) and the replication of DNA (the S phase).

Topoisomerases are essential enzymes that maintain the topology of DNA. Inhibition of type I or type II topoisomerases may interfere with both transcription and replication of DNA by upsetting proper DNA supercoiling. Some chemotherapeutic agents may inhibit topoisomerases. For example, some type I topoisomerase inhibitors include *camptothecins*: irinotecan and topotecan. Examples of type II inhibitors include amsacrine, etoposide, etoposide phosphate, and teniposide.

Another example of chemotherapeutic agents is cytotoxic antibiotics. Cytotoxic antibiotics are a group of antibiotics that are used for the treatment of cancer because they may interfere with DNA replication and/or protein synthesis. Cytotoxic antibiotics include, but are not limited to, actinomycin, anthracyclines, doxorubicin, daunorubicin, valrubicin, idarubicin, epirubicin, bleomycin, plicamycin, and mitomycin.

In some instances, the anti-cancer treatment may comprise radiation therapy. Radiation can come from a machine outside the body (external-beam radiation therapy) or from radioactive material placed in the body near cancer cells (internal radiation therapy, more commonly called brachytherapy). Systemic radiation therapy uses a radioactive substance, given by mouth or into a vein that travels in the blood to tissues throughout the body.

External-beam radiation therapy may be delivered in the form of photon beams (either x-rays or gamma rays). A photon is the basic unit of light and other forms of electromagnetic radiation. An example of external-beam radiation therapy is called 3-dimensional conformal radiation therapy (3D-CRT). 3D-CRT may use computer software and advanced treatment machines to deliver radiation to very precisely shaped target areas. Many other methods of external-beam radiation therapy are currently being tested and used in cancer treatment. These methods include, but are not limited to, intensity-modulated radiation therapy (IMRT), image-guided radiation therapy (IGRT), Stereotactic radiosurgery (SRS), Stereotactic body radiation therapy (SBRT), and proton therapy.

Intensity-modulated radiation therapy (IMRT) is an example of external-beam radiation and may use hundreds of tiny radiation beam-shaping devices, called collimators, to deliver a single dose of radiation. The collimators can be stationary or can move during treatment, allowing the intensity of the radiation beams to change during treatment sessions. This kind of dose modulation allows different areas of a tumor or nearby tissues to receive different doses of radiation. IMRT is planned in reverse (called inverse treatment planning). In inverse treatment planning, the radiation doses to different areas of the tumor and surrounding tissue are planned in advance, and then a high-powered computer program calculates the required number of beams and angles of the radiation treatment. In contrast, during traditional (forward) treatment planning, the number and angles of the radiation beams are chosen in advance and computers calculate how much dose may be delivered from each of the planned beams. The goal of IMRT is to increase the radiation dose to the areas that need it and reduce radiation exposure to specific sensitive areas of surrounding normal tissue.

Another example of external-beam radiation is image-guided radiation therapy (IGRT). In IGRT, repeated imaging scans (CT, MRI, or PET) may be performed during treatment. These imaging scans may be processed by computers to identify changes in a tumor's size and location due to treatment and to allow the position of the patient or the planned radiation dose to be adjusted during treatment as needed. Repeated imaging can increase the accuracy of radiation treatment and may allow reductions in the planned volume of tissue to be treated, thereby decreasing the total radiation dose to normal tissue.

Tomotherapy is a type of image-guided IMRT. A tomotherapy machine is a hybrid between a CT imaging scanner and an external-beam radiation therapy machine. The part of the tomotherapy machine that delivers radiation for both imaging and treatment can rotate completely around the patient in the same manner as a normal CT scanner. Tomotherapy machines can capture CT images of the patient's tumor immediately before treatment sessions, to allow for very precise tumor targeting and sparing of normal tissue.

Stereotactic radiosurgery (SRS) can deliver one or more high doses of radiation to a small tumor. SRS uses extremely accurate image-guided tumor targeting and patient positioning. Therefore, a high dose of radiation can be given without excess damage to normal tissue. SRS can be used to treat small tumors with well-defined edges. It is most commonly used in the treatment of brain or spinal tumors and brain metastases from other cancer types. For the treatment of some brain metastases, patients may receive radiation therapy to the entire brain (called whole-brain radiation therapy) in addition to SRS. SRS requires the use of a head frame or other device to immobilize the patient during treatment to ensure that the high dose of radiation is delivered accurately.

Stereotactic body radiation therapy (SBRT) delivers radiation therapy in fewer sessions, using smaller radiation fields and higher doses than 3D-CRT in most cases. SBRT may treat tumors that lie outside the brain and spinal cord. Because these tumors are more likely to move with the normal motion of the body, and therefore cannot be targeted as accurately as tumors within the brain or spine, SBRT is usually given in more than one dose. SBRT can be used to treat small, isolated tumors, including cancers in the lung and liver. SBRT systems may be known by their brand names, such as the CyberKnife®.

In proton therapy, external-beam radiation therapy may be delivered by proton. Protons are a type of charged particle. Proton beams differ from photon beams mainly in the way they deposit energy in living tissue. Whereas photons deposit energy in small packets all along their path through tissue, protons deposit much of their energy at the end of their path (called the Bragg peak) and deposit less energy along the way. Use of protons may reduce the exposure of normal tissue to radiation, possibly allowing the delivery of higher doses of radiation to a tumor.

Other charged particle beams such as electron beams may be used to irradiate superficial tumors, such as skin cancer or tumors near the surface of the body, but they cannot travel very far through tissue.

Internal radiation therapy (brachytherapy) is radiation delivered from radiation sources (radioactive materials) placed inside or on the body. Several brachytherapy techniques are used in cancer treatment. Interstitial brachytherapy may use a radiation source placed within tumor tissue, such as within a prostate tumor. Intracavitary brachytherapy may use a source placed within a surgical cavity or a body cavity, such as the chest cavity, near a tumor. Episcleral brachytherapy, which may be used to treat melanoma inside the eye, may use a source that is attached to the eye. In brachytherapy, radioactive isotopes can be sealed in tiny pellets or "seeds." These seeds may be placed in patients using delivery devices, such as needles, catheters, or some other type of carrier. As the isotopes decay naturally, they give off radiation that may damage nearby cancer cells. Brachytherapy may be able to deliver higher doses of radiation to some cancers than external-beam radiation therapy while causing less damage to normal tissue.

Brachytherapy can be given as a low-dose-rate or a high-dose-rate treatment. In low-dose-rate treatment, cancer cells receive continuous low-dose radiation from the source over a period of several days. In high-dose-rate treatment, a robotic machine attached to delivery tubes placed inside the body may guide one or more radioactive sources into or near a tumor, and then removes the sources at the end of each treatment session. High-dose-rate treatment can be given in one or more treatment sessions. An example of a high-dose-rate treatment is the MammoSite® system. Bracytherapy may be used to treat patients with breast cancer who have undergone breast-conserving surgery.

The placement of brachytherapy sources can be temporary or permanent. For permanent brachytherapy, the sources may be surgically sealed within the body and left there, even after all of the radiation has been given off. In some instances, the remaining material (in which the radioactive isotopes were sealed) does not cause any discomfort or harm to the patient. Permanent brachytherapy is a type of low-dose-rate brachytherapy. For temporary brachytherapy, tubes (catheters) or other carriers are used to deliver the radiation sources, and both the carriers and the radiation sources are removed after treatment. Temporary brachytherapy can be either low-dose-rate or high-dose-rate treatment. Brachytherapy may be used alone or in addition to external-beam radiation therapy to provide a "boost" of radiation to a tumor while sparing surrounding normal tissue.

In systemic radiation therapy, a patient may swallow or receive an injection of a radioactive substance, such as radioactive iodine or a radioactive substance bound to a monoclonal antibody. Radioactive iodine ($^{131}$I) is a type of systemic radiation therapy commonly used to help treat cancer, such as thyroid cancer. Thyroid cells naturally take up radioactive iodine. For systemic radiation therapy for some other types of cancer, a monoclonal antibody may help target the radioactive substance to the right place. The antibody joined to the radioactive substance travels through the blood, locating and killing tumor cells. For example, the drug ibritumomab tiuxetan (Zevalin®) may be used for the treatment of certain types of B-cell non-Hodgkin lymphoma (NHL). The antibody part of this drug recognizes and binds to a protein found on the surface of B lymphocytes. The combination drug regimen of tositumomab and iodine $^{131}$I tositumomab (Bexxar®) may be used for the treatment of certain types of cancer, such as NHL. In this regimen, nonradioactive tositumomab antibodies may be given to patients first, followed by treatment with tositumomab antibodies that have $^{131}$I attached. Tositumomab may recognize and bind to the same protein on B lymphocytes as ibritumomab. The nonradioactive form of the antibody may help protect normal B lymphocytes from being damaged by radiation from 131I.

Some systemic radiation therapy drugs relieve pain from cancer that has spread to the bone (bone metastases). This is a type of palliative radiation therapy. The radioactive drugs samarium-153-lexidronam (Quadramet®) and strontium-89 chloride (Metastron®) are examples of radiopharmaceuticals may be used to treat pain from bone metastases.

Biological therapy (sometimes called immunotherapy, biotherapy, or biological response modifier (BRM) therapy) uses the body's immune system, either directly or indirectly, to fight cancer or to lessen the side effects that may be caused by some cancer treatments. Biological therapies include interferons, interleukins, colony-stimulating factors, monoclonal antibodies, vaccines, gene therapy, and nonspecific immunomodulating agents.

Interferons (IFNs) are types of cytokines that occur naturally in the body. Interferon alpha, interferon beta, and interferon gamma are examples of interferons that may be used in cancer treatment.

Like interferons, interleukins (ILs) are cytokines that occur naturally in the body and can be made in the laboratory. Many interleukins have been identified for the treatment of cancer. For example, interleukin-2 (IL-2 or aldesleukin), interleukin 7, and interleukin 12 have may be used as an anti-cancer treatment. IL-2 may stimulate the growth and activity of many immune cells, such as lymphocytes, that can destroy cancer cells. Interleukins may be used to treat a number of cancers, including leukemia, lymphoma, and brain, colorectal, ovarian, breast, kidney and prostate cancers.

Colony-stimulating factors (CSFs) (sometimes called hematopoietic growth factors) may also be used for the treatment of cancer. Some examples of CSFs include, but are not limited to, G-CSF (filgrastim) and GM-CSF (sargramostim). CSFs may promote the division of bone marrow stem cells and their development into white blood cells, platelets, and red blood cells. Bone marrow is critical to the body's immune system because it is the source of all blood cells. Because anticancer drugs can damage the body's ability to make white blood cells, red blood cells, and platelets, stimulation of the immune system by CSFs may benefit patients undergoing other anti-cancer treatment, thus CSFs may be combined with other anti-cancer therapies, such as chemotherapy. CSFs may be used to treat a large variety of cancers, including lymphoma, leukemia, multiple myeloma, melanoma, and cancers of the brain, lung, esophagus, breast, uterus, ovary, prostate, kidney, colon, and rectum.

Another type of biological therapy includes monoclonal antibodies (MOABs or MoABs). These antibodies may be produced by a single type of cell and may be specific for a particular antigen. To create MOABs, human cancer cells may be injected into mice. In response, the mouse immune system can make antibodies against these cancer cells. The mouse plasma cells that produce antibodies may be isolated and fused with laboratory-grown cells to create "hybrid" cells called hybridomas. Hybridomas can indefinitely produce large quantities of these pure antibodies, or MOABs. MOABs may be used in cancer treatment in a number of ways. For instance, MOABs that react with specific types of cancer may enhance a patient's immune response to the cancer. MOABs can be programmed to act against cell growth factors, thus interfering with the growth of cancer cells.

MOABs may be linked to other anti-cancer therapies such as chemotherapeutics, radioisotopes (radioactive substances), other biological therapies, or other toxins. When the antibodies latch onto cancer cells, they deliver these anti-cancer therapies directly to the tumor, helping to destroy it. MOABs carrying radioisotopes may also prove useful in diagnosing certain cancers, such as colorectal, ovarian, and prostate.

Rituxan® (rituximab) and Herceptin® (trastuzumab) are examples of MOABs that may be used as a biological therapy. Rituxan may be used for the treatment of non-Hodgkin lymphoma. Herceptin can be used to treat metastatic breast cancer in patients with tumors that produce excess amounts of a protein called HER2. Alternatively, MOABs may be used to treat lymphoma, leukemia, melanoma, and cancers of the brain, breast, lung, kidney, colon, rectum, ovary, prostate, and other areas.

Cancer vaccines are another form of biological therapy. Cancer vaccines may be designed to encourage the patient's immune system to recognize cancer cells. Cancer vaccines may be designed to treat existing cancers (therapeutic vaccines) or to prevent the development of cancer (prophylactic vaccines). Therapeutic vaccines may be injected in a person after cancer is diagnosed. These vaccines may stop the growth of existing tumors, prevent cancer from recurring, or eliminate cancer cells not killed by prior treatments. Cancer vaccines given when the tumor is small may be able to eradicate the cancer. On the other hand, prophylactic vaccines are given to healthy individuals before cancer develops. These vaccines are designed to stimulate the immune system to attack viruses that can cause cancer. By targeting these cancer-causing viruses, development of certain cancers may be prevented. For example, cervarix and gardasil are vaccines to treat human papilloma virus and may prevent cervical cancer. Therapeutic vaccines may be used to treat melanoma, lymphoma, leukemia, and cancers of the brain, breast, lung, kidney, ovary, prostate, pancreas, colon, and rectum. Cancer vaccines can be used in combination with other anti-cancer therapies.

Gene therapy is another example of a biological therapy. Gene therapy may involve introducing genetic material into a person's cells to fight disease. Gene therapy methods may improve a patient's immune response to cancer. For example, a gene may be inserted into an immune cell to enhance its ability to recognize and attack cancer cells. In another approach, cancer cells may be injected with genes that cause the cancer cells to produce cytokines and stimulate the immune system.

In some instances, biological therapy includes nonspecific immunomodulating agents. Nonspecific immunomodulating agents are substances that stimulate or indirectly augment the immune system. Often, these agents target key immune system cells and may cause secondary responses such as increased production of cytokines and immunoglobulins. Two nonspecific immunomodulating agents used in cancer treatment are bacillus Calmette-Guerin (BCG) and levamisole. BCG may be used in the treatment of superficial bladder cancer following surgery. BCG may work by stimulating an inflammatory, and possibly an immune, response. A solution of BCG may be instilled in the bladder. Levamisole is sometimes used along with fluorouracil (5-FU) chemotherapy in the treatment of stage III (Dukes' C) colon cancer following surgery. Levamisole may act to restore depressed immune function.

Photodynamic therapy (PDT) is an anti-cancer treatment that may use a drug, called a photosensitizer or photosensitizing agent, and a particular type of light. When photosensitizers are exposed to a specific wavelength of light, they may produce a form of oxygen that kills nearby cells. A photosensitizer may be activated by light of a specific wavelength. This wavelength determines how far the light can travel into the body. Thus, photosensitizers and wavelengths of light may be used to treat different areas of the body with PDT.

In the first step of PDT for cancer treatment, a photosensitizing agent may be injected into the bloodstream. The agent may be absorbed by cells all over the body but may stay in cancer cells longer than it does in normal cells. Approximately 24 to 72 hours after injection, when most of the agent has left normal cells but remains in cancer cells, the tumor can be exposed to light. The photosensitizer in the tumor can absorb the light and produces an active form of oxygen that destroys nearby cancer cells. In addition to directly killing cancer cells, PDT may shrink or destroy tumors in two other ways. The photosensitizer can damage blood vessels in the tumor, thereby preventing the cancer from receiving necessary nutrients. PDT may also activate the immune system to attack the tumor cells.

The light used for PDT can come from a laser or other sources. Laser light can be directed through fiber optic cables (thin fibers that transmit light) to deliver light to areas inside the body. For example, a fiber optic cable can be inserted through an endoscope (a thin, lighted tube used to look at tissues inside the body) into the lungs or esophagus to treat cancer in these organs. Other light sources include light-emitting diodes (LEDs), which may be used for surface tumors, such as skin cancer. PDT is usually performed as an outpatient procedure. PDT may also be repeated and may be used with other therapies, such as surgery, radiation, or chemotherapy.

Extracorporeal photopheresis (ECP) is a type of PDT in which a machine may be used to collect the patient's blood cells. The patient's blood cells may be treated outside the body with a photosensitizing agent, exposed to light, and then returned to the patient. ECP may be used to help lessen the severity of skin symptoms of cutaneous T-cell lymphoma that has not responded to other therapies. ECP may be used to treat other blood cancers, and may also help reduce rejection after transplants.

Additionally, photosensitizing agent, such as porfimer sodium or Photofrin®, may be used in PDT to treat or relieve the symptoms of esophageal cancer and non-small cell lung cancer. Porfimer sodium may relieve symptoms of esophageal cancer when the cancer obstructs the esophagus or when the cancer cannot be satisfactorily treated with laser therapy alone. Porfimer sodium may be used to treat non-small cell lung cancer in patients for whom the usual treatments are not appropriate, and to relieve symptoms in patients with non-small cell lung cancer that obstructs the airways. Porfimer sodium may also be used for the treatment of precancerous lesions in patients with Barrett esophagus, a condition that can lead to esophageal cancer.

Laser therapy may use high-intensity light to treat cancer and other illnesses. Lasers can be used to shrink or destroy tumors or precancerous growths. Lasers are most commonly used to treat superficial cancers (cancers on the surface of the body or the lining of internal organs) such as basal cell skin cancer and the very early stages of some cancers, such as cervical, penile, vaginal, vulvar, and non-small cell lung cancer.

Lasers may also be used to relieve certain symptoms of cancer, such as bleeding or obstruction. For example, lasers can be used to shrink or destroy a tumor that is blocking a patient's trachea (windpipe) or esophagus. Lasers also can be used to remove colon polyps or tumors that are blocking the colon or stomach.

Laser therapy is often given through a flexible endoscope (a thin, lighted tube used to look at tissues inside the body). The endoscope is fitted with optical fibers (thin fibers that transmit light). It is inserted through an opening in the body, such as the mouth, nose, anus, or vagina. Laser light is then precisely aimed to cut or destroy a tumor.

Laser-induced interstitial thermotherapy (LITT), or interstitial laser photocoagulation, also uses lasers to treat some cancers. LITT is similar to a cancer treatment called hyperthermia, which uses heat to shrink tumors by damaging or killing cancer cells. During LITT, an optical fiber is inserted into a tumor. Laser light at the tip of the fiber raises the temperature of the tumor cells and damages or destroys them. LITT is sometimes used to shrink tumors in the liver.

Laser therapy can be used alone, but most often it is combined with other treatments, such as surgery, chemotherapy, or radiation therapy. In addition, lasers can seal nerve endings to reduce pain after surgery and seal lymph vessels to reduce swelling and limit the spread of tumor cells.

Lasers used to treat cancer may include carbon dioxide ($CO_2$) lasers, argon lasers, and neodymium:yttrium-aluminum-garnet (Nd:YAG) lasers. Each of these can shrink or destroy tumors and can be used with endoscopes. $CO_2$ and argon lasers can cut the skin's surface without going into deeper layers. Thus, they can be used to remove superficial cancers, such as skin cancer. In contrast, the Nd:YAG laser is more commonly applied through an endoscope to treat internal organs, such as the uterus, esophagus, and colon. Nd:YAG laser light can also travel through optical fibers into specific areas of the body during LITT. Argon lasers are often used to activate the drugs used in PDT.

Experimental

The following examples are provided in order to demonstrate and further illustrate certain preferred embodiments and aspects of the present disclosure and are not to be construed as limiting the scope thereof.

Example 1

Methods

High Performance Computing

Computational analysis was performed using the Flux high-performance computer cluster hosted by the Advanced Research Computing (ARC) at the University of Michigan.

RNA-Seq Data Processing

Figure 5:
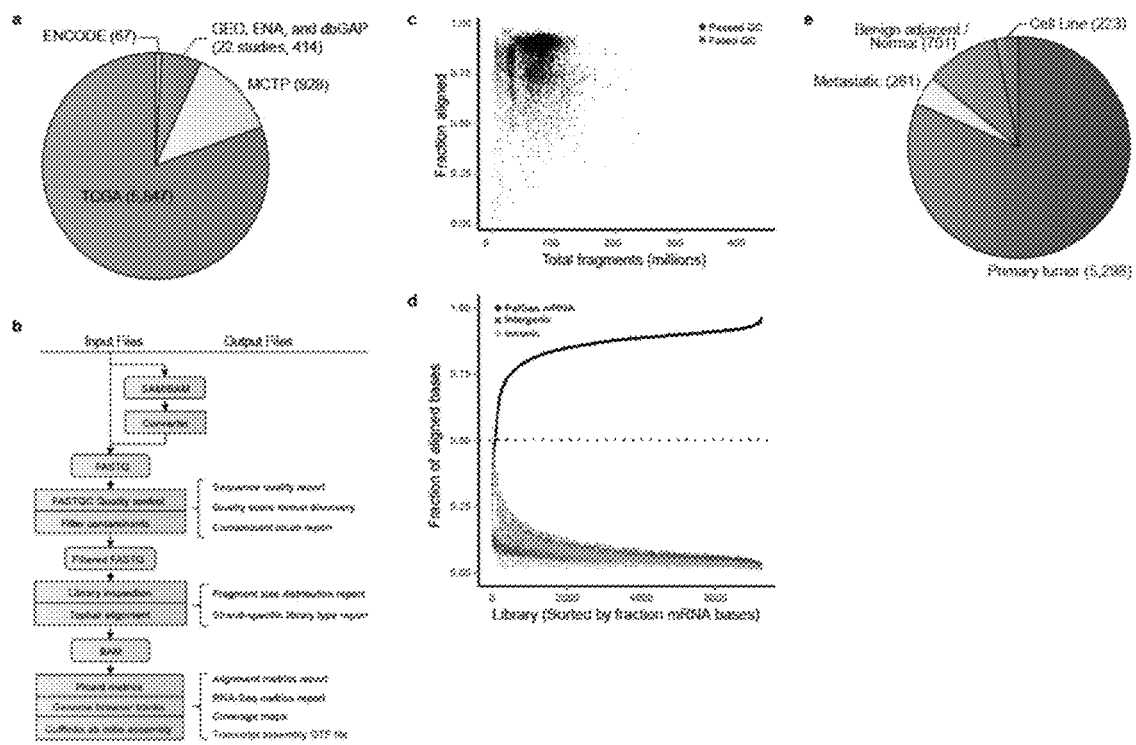
FIG. 5 shows curation and processing of samples in the MiTrascriptome compendia. A. Pie chart showing the number of studies curated from TCGA, ENCODE, MCTP, and other datasets.

A comprehensive RNA-Seq analysis pipeline was employed on all samples (FIG. 5b). The analysis pipeline provided sequence quality metrics, filtering of contaminant reads, fragment size estimation, strand-specific library type estimation, spliced alignment of reads to the human reference genome (version hg19/GrCh37), alignment performance metrics, generation of visualization tracks for genome browsers, and ab initio transcript assembly. The third-party tools used to process RNA-Seq data were selected based on computational performance, ease-of-use, user and community support, and experience.

Software versions were managed effectively using the Modules Environment Management system. Computational analysis was performed in a 64-bit Linux environment (Red Hat Enterprise Linux 6). Pre-compiled 64-bit Linux binaries were downloaded when available.

Initial sequence quality control metrics were calculated using FASTQC. Next, filtering was performed to remove reads mapping to mitochondrial DNA, ribosomal RNA, poly-A, poly-C, Illumina sequencing adaptors, and the spiked-in phiX174 viral genome. Sequences were downloaded from the Illumina iGenomes server (2012 Mar. 9). Mapping was performed using bowtie2 (2.0.2).

The fragment size distribution (for paired-end libraries) and fragment layout of each library was determined automatically by mapping a subset of the reads to a reference consisting of the 15,868 unique Ensembl v69 exons larger than 500 bp that had no other overlapping features on either strand. These exons represent contiguous genomic regions where both paired-end reads from a single fragment could confidently be aligned. An alignment index was prepared from this reference using the bowtie-build utility.

Reads were mapped using Tophat2 (2.0.6 and 2.0.8) using default parameters 1. Reference genome annotation files were downloaded from the Illumina iGenomes FTP server. A human genome reference was constructed from UCSC version hg19 chromosomes 1-22, X, Y, and mitochondrial DNA. References from alternate haplotype alleles were omitted. Alignment index files for Bowtie versions 0.12.8 and 2.0.2 were built from this reference using the bowtie-build and bowtie2-build programs, respectively. The Ensembl version 69 transcriptome reference gene set was downloaded from the Ensembl FTP server. Chromosome names were converted from GRCh37 format to UCSC format (e.g. "1" converted to "chr1"). Genes found on alternate haplotype alleles were omitted. The cuffcompare utility was used as specified in the Cufflinks user's manual to assign promoter and transcription start site attributes to the gene features in the Ensembl reference. Alignment index files for Bowtie versions 0.12.8 and 2.0.2 were prepared from this reference using the—transcriptome index option in Tophat version 2.0.6.

Sequence alignment metrics were computed using the Picard tools CollectMultipleMetrics and CollectRnaSeq-Metrics. The Picard CollectRnaSeqMetrics diagnostic utility required gene annotation and ribosomal interval files as input. The "refFlat" table provided by the Illumina iGenomes download package (2012 Mar. 9) was used as the gene annotation reference. Ribosomal DNA intervals were curated from the RepeatMasker table downloaded from the UCSC table browser (Karolchik, D. et al. Nucleic acids research 32, D493-496, (2004)). This table of repeat elements was originally provided for hg19 by UCSC on May 27, 2009. Tracks for visualization on genome browers were generated using the BEDTools 'genomecov' utility and the UCSC bedGraphToBigWig utility (Kent, et al., Bioinformatics 26, 2204-2207, (2010); Quinlan, A. R. & Hall, I. M. Bioinformatics 26, 841-842, (2010)).

Ab initio assembly was performed using Cufflinks (2.0.2) with multi-read correction Enabled (Trapnell, C. et al. Nature biotechnology 28, 511-515, (2010)). Gene features with the ribosomal RNA biotype 'rRNA' were added to a mask file for use with the --mask-file option in Cufflinks.

Overview of Transcriptome Reconstruction

To merge ab initio assembled transcript fragments (transfrags) into a consensus transcriptome a bioinformatics method that (1) classifies and filters sources of background noise in individual libraries and (2) reassembles transfrags weighted by their expression levels from multiple libraries into a consensus transcriptome was utiized.

Quality Control for Ab Initio Assembled Transcripts

Figure 4:
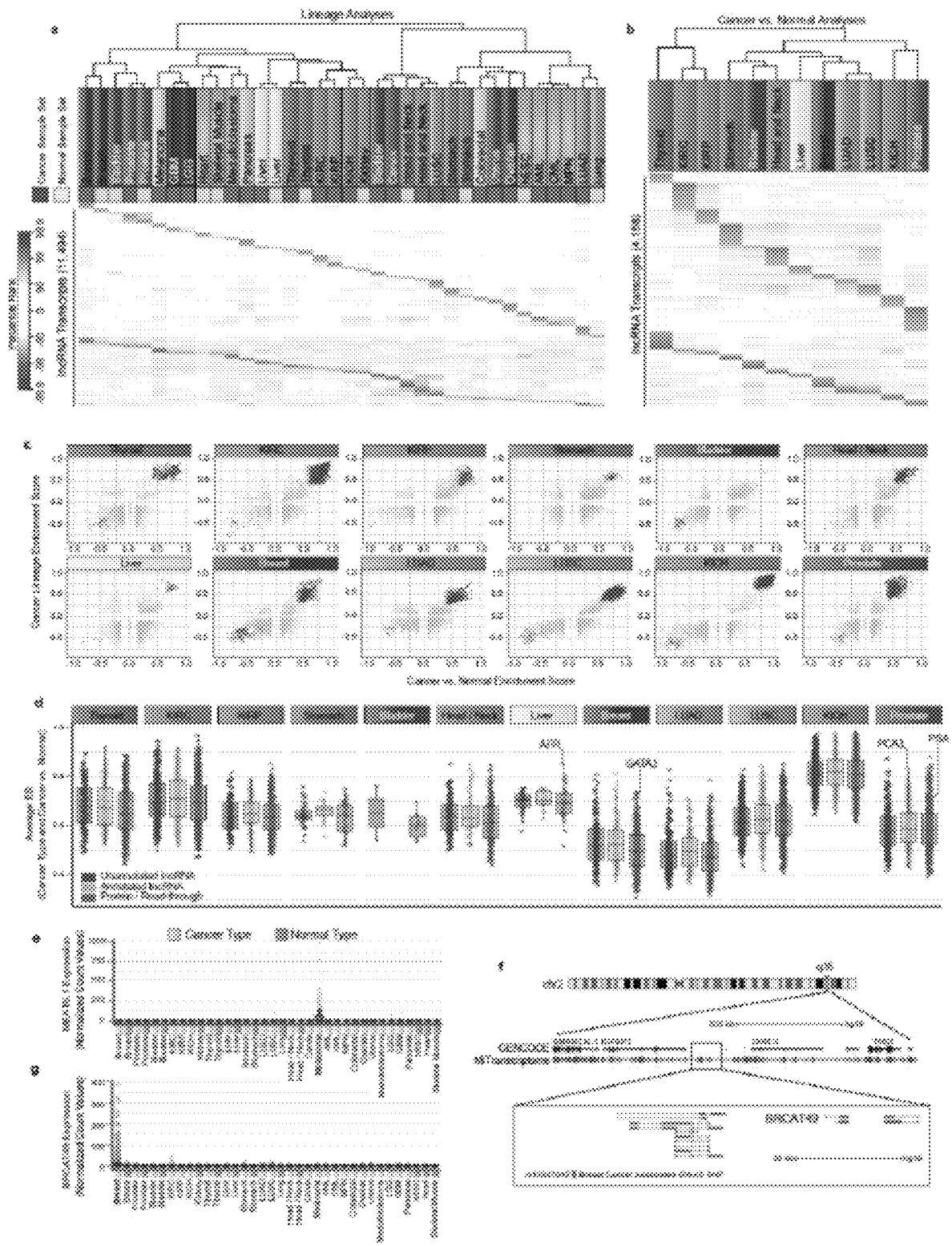
FIG. 4 shows discovery of lineage-associated and cancer-associated lncRNAs in the MiTranscriptome compendia. (a) Heatmap of lineage-specific lncRNAs. (b) Heatmap of cancer-specific lncRNAs nominated by SSEA Cancer vs. Normal analysis of 12 cancer types (columns). (c) Scatter plots showing enrichment score for Cancer vs. Normal (x axis) and Cancer Lineage (y axis) for all lineage-specific and cancer-associated lncRNA transcripts across 12 cancer types. (d) Boxplot comparing the performance of cancer- and lineage-associated lncRNAs corresponding to unannotated or annotated lncRNAs or protein-coding transcripts (including readthroughs) across 12 cancer types. (e) Expression data for MEAT6 across all MiTranscriptome cancer and normal tissue type cohorts. (f) Genomic view of chromosome 2q35 locus. (g) Expression data for BRCAT49 across all MiTranscriptome cancer and normal tissue type cohorts.

Ab initio assembly yielded 312,883,292 transcript fragments (transfrags) across all libraries average of 46,810 transfrags per library). Alignment artifacts and poorly assembled transcripts were controlled for by clipping very short first or last exons 15 bp) and excluding short transfrags (<250 bp). These thresholds filtered out an average of 2.0% of the transfrags from each library, but in rare cases up to 67% of all transfrags in a library were excluded (FIG. 4a). After implementing these measures, 304,397,840 transfrags (97.2% of input) were maintained.

Assessment of Genomic DNA and Incompletely Processed RNA Levels

Figure 6:
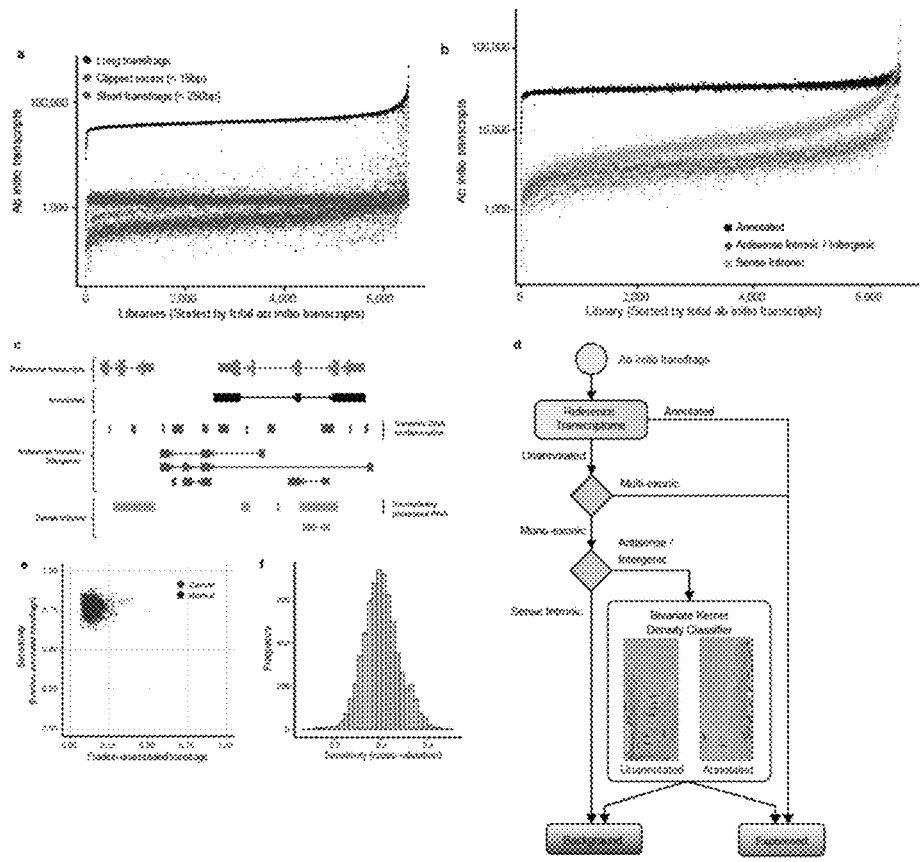
FIG. 6 shows transfrag filtering. a) Pie chart showing the number of studies curated from datasets. b) workflow for bioinformatics processing of individual RNA-SEQ libraries. C) scatter plot showing total fragments (x-axis) and the fraction of aligned fragments (y-axis for each RNA-SEQ library. D) dot plot showing the fraction of aligned bases corresponding to mRNA, intronic regions, or intergenic regions. E0pie chart showing numbers of primare tumors, metastatic tumors, benign adjacent tissues or healthy tissues, or cell lines for RNA-SEQ libraries.

RNA sequencing experiments that isolate poly-adenylated RNA from whole cells inadvertently capture variable amounts of incompletely processed RNA and genomic DNA4. These noise sequences manifest within ab initio transcript assemblies as intron retentions, mono-exonic intronic transfrags in the sense orientation, and relatively lowly expressed transfrags dispersed throughout intergenic regions (Cabili, M. N. et al. Genes & development 25, 1915-1927, (2011)). Thus, background noise complicates the correct assembly of mono-exonic transcripts, intronic transcripts, or both. To characterize noise, the total unannotated sense-oriented intronic (intronic-like) transfrag population was used as a surrogate measure of both genomic and incompletely processed RNA levels, and the unannotated intergenic or antisense-oriented (intergenic-like) transfrag population as a surrogate measure of only genomic DNA levels. Comparing the transfrags in each category across all 6,503 libraries revealed significant variability in both the number and abundance of transfrags corresponding to noise (FIG. 6b). On average, intergenic-like transfrags constituted 8.6% of all transfrags (min: 0.65%, max: 43%), but only 0.88% of total FPKM per library (min: 0.16%, max: 16.8%). Intronic-like transfrags constituted 17% (min: 0.56%, max: 64%) of all transfrags and 2.0% (min: 0.18%, max: 54%) of total FPKM per library. These results implicate genomic DNA contamination and incompletely processed RNA as approximately equal contributors to total noise levels; however, these two sources of noise were not necessarily correlated. Furthermore, individual libraries contain variable amounts of incompletely processed RNA and genomic DNA contamination. Thus, a filtering strategy that discriminated true unannotated transcription from background noise in a library-specific manner was utilized.

Filtering Genomic DNA Contamination Artifacts from Ab Initio Assemblies

Figure 10:
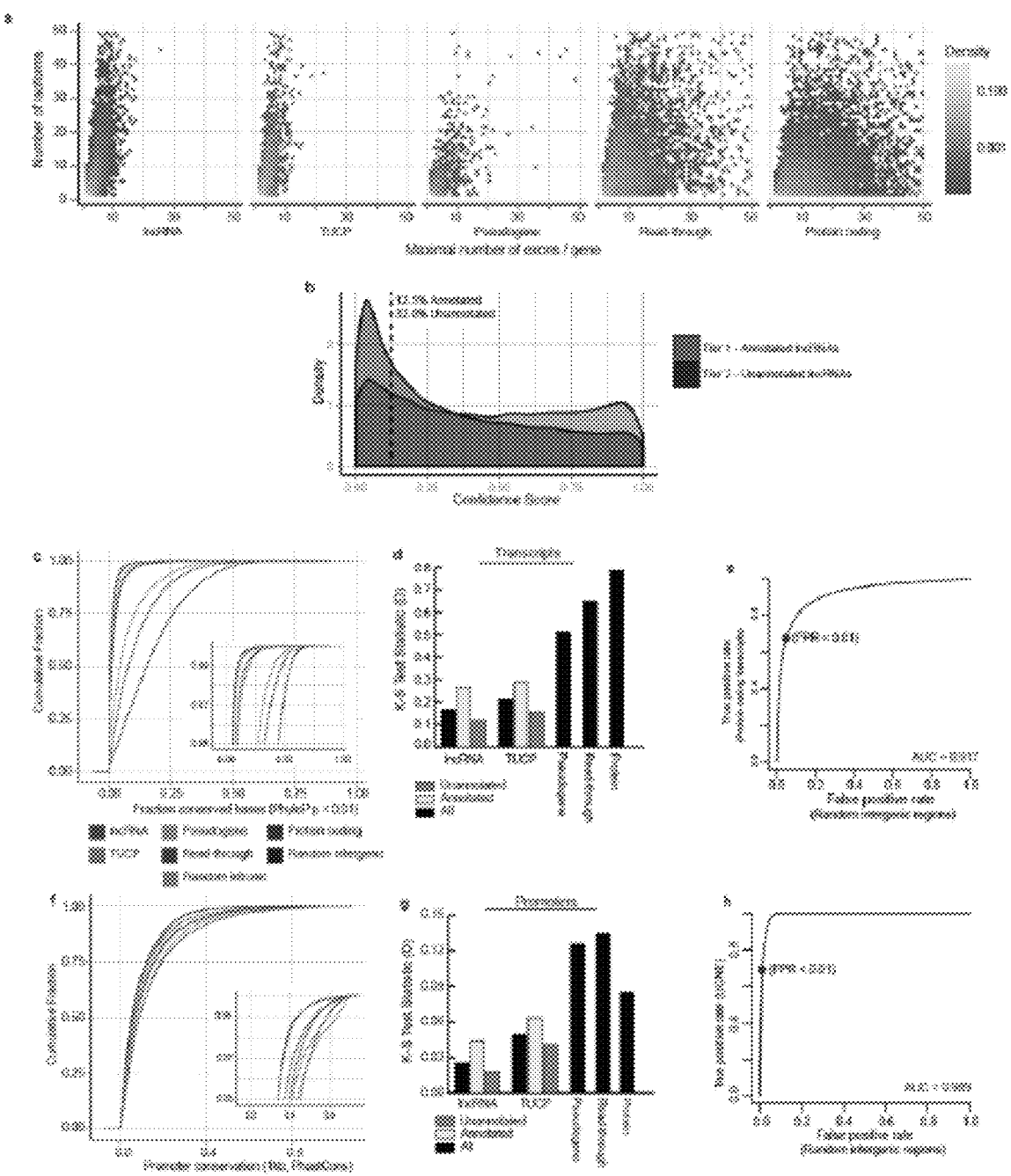
FIG. 10 shows Mitranscriptome characterization. a, Comparison of the relationship of maximum number of exons per gene to the number of isoforms per gene. b, Density histogram depicting the confidence scores for annotated and unannotated lncRNAs. c, Cumulative distribulion plot for basewise conservation fraction of proteins, read-throughs, pseudogenes, TUCPs, lncRNAs. d, Bar plot showing KS test statistics for classes of transcripts versus random intergenic controls. e, Cumulative dislribution plot for promoter conservation (legend shared with a). f, Bar plot showing KS tests for promoter conservation versus random intergenic regions. g, ROC curve for predicting conservation of protein coding genes versus random intergenic controls.

To discriminate genomic DNA contamination from robust transcription a classification method that utilizes both relative transcript abundance and recurrence across independent biological samples was developed. The method requires a known transcript catalogue (Ensembl version 69) to determine the annotation status of ab initio transfrags (Flicek, P. et al. Ensembl 2014. Nucleic acids research 42, D749-755, (2014)). Transfrags that overlapped known transcripts in the sense orientation were denoted "annotated", and the remaining transfrags were categorized as either "Sense Intronic" or "Antisense/Intergenic" based on their relationship to annotated transcripts (FIG. 6c,d). Relative abundance was determined by using the empirical distribution of FPKM values to converting transcript FPKM values into quantiles. Recurrence levels were first computed per base by counting independent biological samples with evidence of transcription (replicates of identical cell lines or tumor tissues from the same patient were not counted towards recurrence). A single recurrence value was then computed for each transfrag by averaging the recurrence values of all bases of the transfrag. After computing relative abundance and recurrence for all transfrags, a classifier was trained to discriminate annotated from unannotated transfrags as a surrogate for classifying true transcription from background noise. Specifically, bivariate kernel density estimates were converted using the abundance-recurrence axes separately for annotated and unannotated transfrags. These densities were mapped onto a square grid (50×50). The annotated density was then divided by the unannotated density at each grid point after adding a nominal value to avoid floating point overflow errors. This resulted in a new grid containing likelihood ratios for annotated versus unannotated transfrags along the abundance-recurrence axes. To account for the total noise present in the library, the likelihood estimates were weighted by the relative ratio of unannotated versus annotated transfrags in the library being classified. This weight equaled the ratio of the fraction of known to unannotated transcripts in a library divided by the ratio of the medians of these fractions in all libraries. Finally, for each transfrag in an ab initio assembly, the weighted log-likelihood of the transfrag being annotated was calculated by linearly interpolating the transfrag abundance and recurrence onto the grid. For each library, a likelihood ratio cutoff was calculated by optimizing the balanced accuracy (average of sensitivity and specificity) of the classifier performance (FIG. 6e). Transfrags with likelihood below this cutoff were labeled 'background' and the remainder 'expressed'. Results from individual libraries were then concatenated to produce separate background and expressed transfrag catalogues as output. Transcripts classified as background noise were discarded and meta-assembly was carried out on the expressed fraction. To assess the sensitivity of the classification method, the filtering approach was calculated after leaving out 10% of annotated transfrags as 'test' data. The ability to detect these genes was then assessed using likelihood cutoffs determined without the test data included (FIG. 10f).

Transcriptome Meta-Assembly

A meta-assembly algorithm that produces isoforms from splicing pattern graphs after pruning sources of incompletely processed RNA that manifest as intron retentions and inappropriately long exons is provided. Studies of alternative splicing have revealed a tightly controlled system where often only a small number of possible isoforms is observed from loci with innumerable splicing possibilities (Pickrell, J. K. et al. Nature 464, 768-772, (2010); Barash, Y. et al. Nature 465, 53-59, (2010)). To incorporate these biological observations, a greedy dynamic programming approach that reports the most highly abundant transcripts and discards minor isoforms was used.

Figure 7:
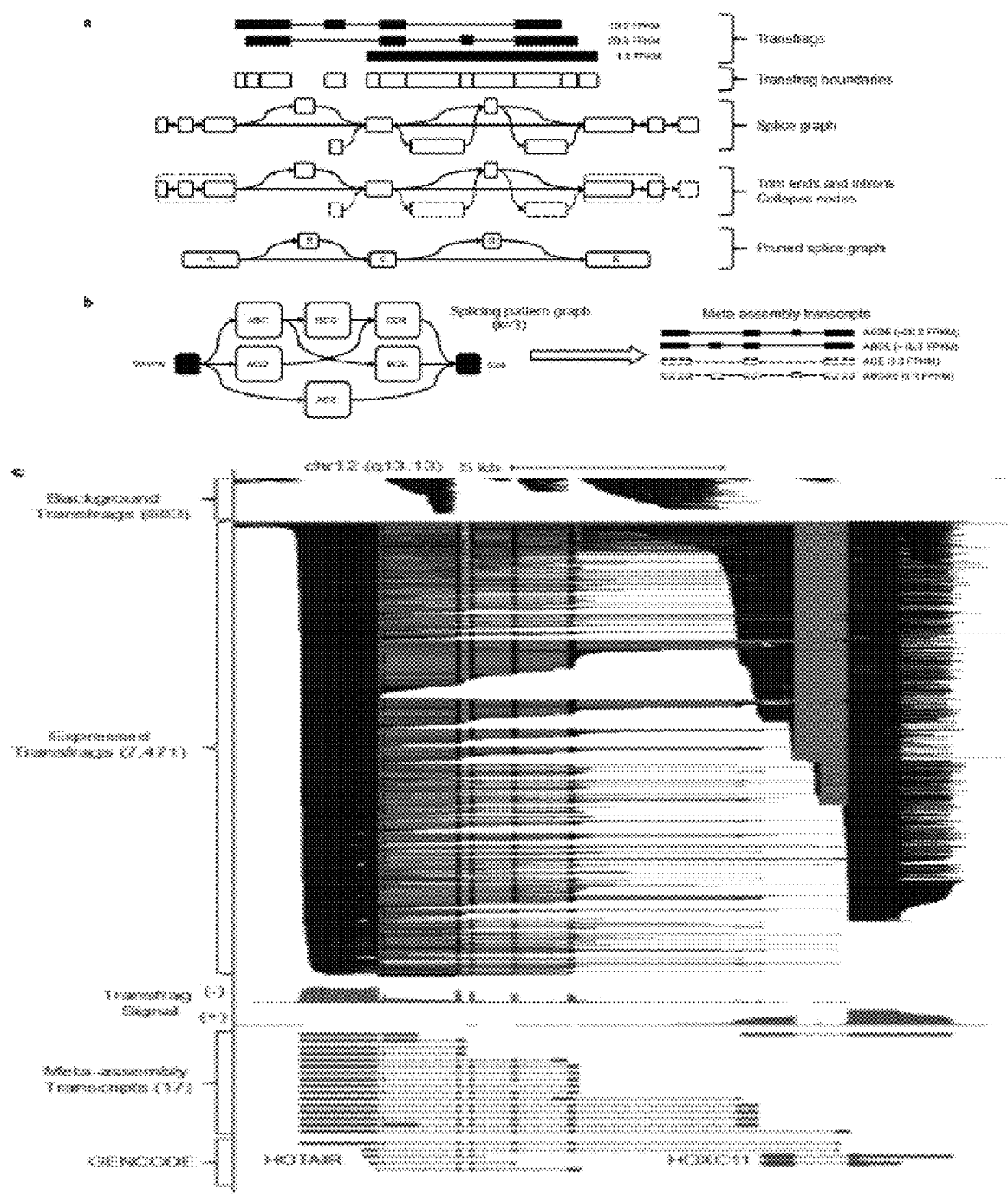
FIG. 7 shows meta assembly. a, schematic of transcriptome meta-assembly algorithm using a simplified example with three transtrags transcribed from left to right. b, The pruned splice graph from panel a is subjected to meta-assembly. c, Genome view showing an example of the meta-assembly procedure for breast cohort transfrags in a chromosome 12q13.3 locus containing the LncRNA HOTAIR and the protein-coding gene HOXC11 on opposite strands (chr12:54,349,995-54,377,376, hg19).

To begin, directed acyclic splicing graphs where nodes in the graph reflect contiguous exonic regions and edges correspond to splicing possibilities were generated (FIG. 7a). Nodes in the splicing graph are then pruned according to several criteria. First, low scoring ends in the graph that correspond to extraneously long exons or overhanging exons that extend into introns are removed. Second, nodes within introns are trimmed when their scores are less than a fraction of neighboring exons. Weakly connected components of the pruned splicing graphs are then extracted and processed independently.

A splicing graph encompasses the milieu of possible isoforms that could be transcribed. Enumerating all possible paths through splicing graphs is impractical; many graphs have millions of paths of which only minute fractions are observed in vivo. The initial input transfrags provide partial paths through the splicing graph and also indicate which parts of the graph are more abundant. The approach described herein incorporates this partial path information by building a splicing pattern graph that subsumes the original splice graph (FIG. 7b). The splicing pattern graph is a type of De Bruijn graph where each node represents a contiguous path of length k through the splice graph, and edges connect paths with k−1 nodes in common. As k increases so does the amount of correlative path information retained in the graph at the cost of losing short transfrags with length less than k. Each node in the graph carries a weight equal to the summed weights from all transcripts that share the node. Thus for each splice graph the partial path length k is optimized to maximize the number of nodes in the path graph with the constraint that the summed node weights of transfrags with path length greater than or equal to k is above a userspecified fraction of the total score of all transfrags. After the path graph has been constructed, every partial path transfrag is extended into a full-length transcript by transmitting the transfrag's weight along incoming and outgoing edges. This weight is allocated proportionally at nodes with multiple incoming or outgoing edges. This approach effectively extends all partial transcript fragments into full-length transcripts and assures that the sum of incoming and outgoing node weights at equivalent. Finally, a set of isoforms is predicted from the graph using a greedy algorithm. The algorithm finds and reports the highest abundance transcript by traversing the graph using dynamic programming. The weight of the transcript equals the minimum weight of all nodes in the path. The transcript weight is then subtracted from every node in the path and the dynamic programming procedure is repeated. Suboptimal transcripts are enumerated until a path weight falls below a fraction of the highest weighted transcript (e.g. the major isoform). The total number of isoforms produced from each gene can also be explicitly constrained. The meta-assembled isoforms are then reported in GTF and/or BED format. A genome track with summed node weights can optionally be reported in BedGraph format as well.

AssemblyLine was developed as a software package written in Python and R to
(1) characterize and filter sources of background noise in RNA-Seq assemblies and (2) perform meta-assembly to coalesce large-scale RNA-Seq datasets. AssemblyLine accepts as input a set GTF files containing transfrags assembled from individual libraries. Transfrags of length less than 250 bp were omitted from meta-assembly, and the remaining transfrags were labeled as 'annotated' or 'unannotated' relative to a reference GTF file (GENCODE version 16). An ab initio transfrag was considered 'annotated' if its exons overlapping any reference transcript exons on the identical strand. A recurrence score for each ab initio transfrag was computed as the average number of samples (replicate libraries from a single cell line or tissue were considered a single sample) per nucleotide with same-stranded transcription.

Classification and filtering of 'background' and 'expressed' transfrags was performed by modeling the abundance (FPKM) and recurrence of 'annotated' and 'unannotated' transcripts using bivariate kernel density estimation on a square grid (grid size 50×50, bandwidth determined by Silverman's rule of thumb). A grid of likelihood ratios was derived from the 'annotated' and 'unannotated' grids by element-wise division at each grid point. The probability of each transfrag being 'annotated' was then determined by linearly interpolation onto this grid, and this probability was used as a surrogate measure for the probability that a transcript represented background noise. A likelihood ratio of less than or equal to one was used as a cutoff for filtering 'background' transcripts.

Filtered transcripts were subjected to the AssemblyLine meta-assembly algorithm. To limit transcript output for complex loci, isoforms with abundance less than 10% of the major transcript isoform were excluded (--fraction-major-isoform 0.10), a maximum of 20 isoforms were allowed for each gene (--maxpaths 20). During splicing pattern graph creation an optimal De Bruijn graph parameter k was determine to maximize the number of graph nodes. A maximum value of k was limited to 20 to improve the computational tractability of the optimization approach (--kmax 20). The output of meta-assembly was a GTF-formatted file as well as BED and BEDGraph-formatted files (--gtf-bed--bedgraph).

Merging of Meta-Assemblies

To merge meta-assemblies from 18 cohorts, the Cuffmerge tool (Trapnell, C. et al. Nature protocols 7, 562-578, (2012)), which produced a final transcriptome GTF file, was used.

Comparisons of MiTranscriptome with Reference Catalogs

The exons, splice sites, and splicing patterns of all assembled transcripts were compared to RefSeq, UCSC, GENCODE (version 19), and the merged union of all three reference catalogs using custom python scripts. Sensitivity and precision values were computed using the number of shared strand-specific transcribed bases, introns, and splicing patterns. Precision was also computed for the subset of ab initio transcripts that overlapped any part of a reference transcript.

Transcripts that overlapped a reference transcript on the same strand were designated annotated. When an ab initio transcript matched multiple reference transcripts, a best match was chosen using the following criteria: (1) matching splicing pattern, (2) fraction of shared introns, and (3) fraction of shared transcribed bases. The biotype (protein, read-through, pseudogene, or lncRNA) for annotated transcripts was imputed from the best matching reference transcript. Annotated lncRNAs and unannotated transcripts were reclassified as either lncRNAs or TUCPs.

Prediction of Transcripts of Unknown Coding Potential (TUCP)

Figure 9:
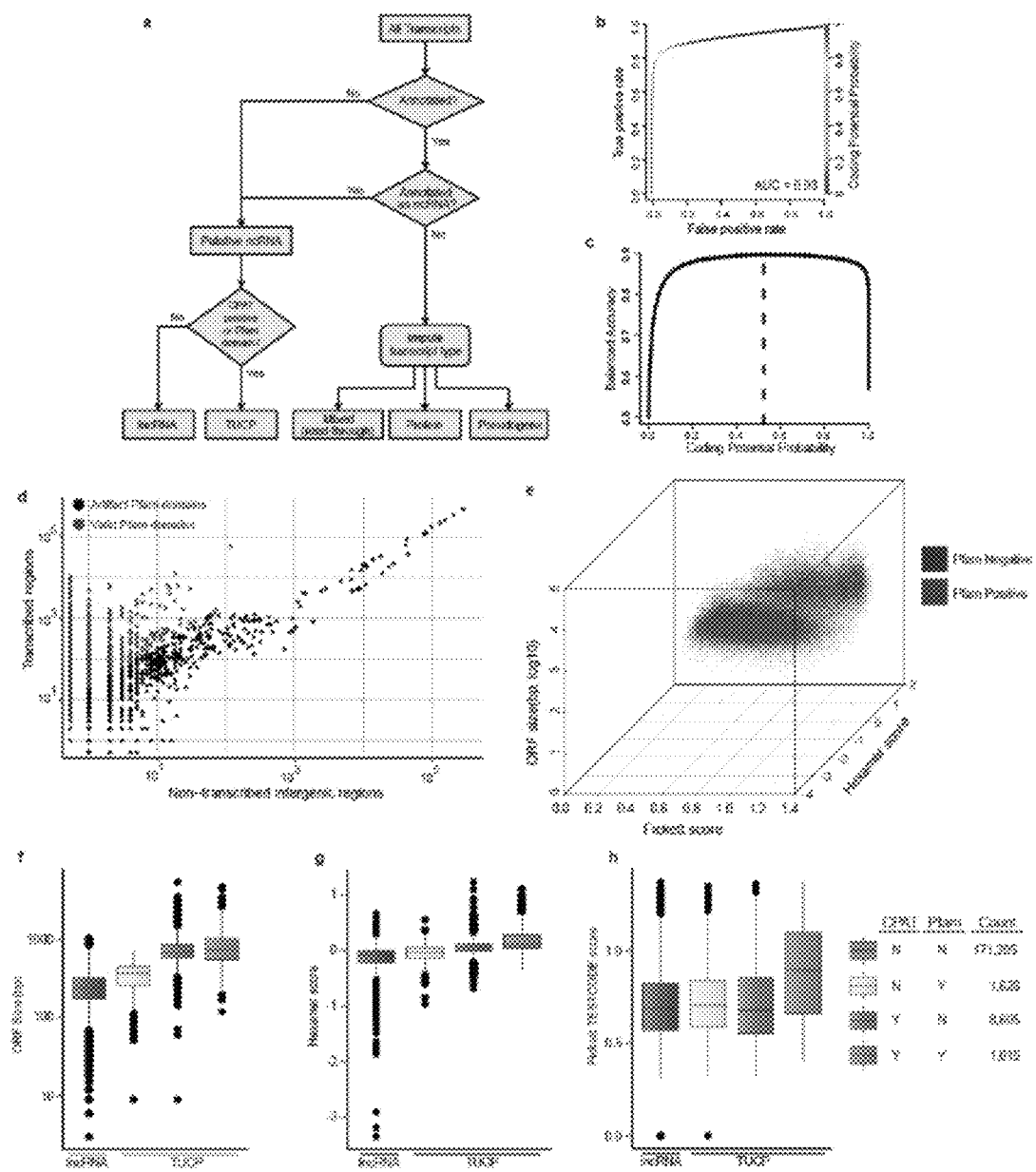
FIG. 9 shows classification of transcripts of unknown coding potential. a, Decision tree showing categorization of ab initio transcripts. b, ROC curve comparing false positive rate (x axis) with true positive rate (yaxis) for CPAT coding potential predictions of ncRNAs versus protein-coding genes. c, Curve comparing probability cutoff (x axis) with balanced accuracy (yaxis). d, Scatter plot comparing frequencies of Pfam domain occurrences in non-transcribed intergenic space versus transcribed regions. e, Three-dimensional scatter plot comparing Fickett score (x axis), ORF size (yaxis), and Hexamer score (z axis) for all transcripts. f,g,h Boxplots comparing ORF size (f), Hexamer score (g), and Fickett score (h).

Coding potential as predicted by integrating two sources of evidence: (1) predictions from the alignment-free Coding Potential Assessment Tool (CPAT) (Wang, L. et al. Nucleic acids research 41, e74, (2013)) and (2) searches for Pfam 27.0 matches (Finn, R. D. et al. Nucleic acids research 42, D222-230, (2014)). CPAT determines the coding probability of transcript sequences using a logistic regression model built from ORF size, Fickett TESTCODE statistic55, and hexamer usage bias. A CPAT probability cutoff was chosen by repeatedly randomly sampling 100,000 each of putative non-coding and protein-coding transcripts and optimizing on the balanced accuracy (average of sensitivity and specificity) metric (FIG. 9b,c). The average area-under-the-curve (AUC) across 100 iterations was 0.9310 (minimum 0.9302, maximum 0.9320), and the average optimal probability cutoff was 0.5242 (minimum 0.5090, maximum 0.5482). This cutoff value achieved accurate discrimination of lncRNAs and protein-coding genes (sensitivity: 0.84, specificity: 0.95, FDR: 0.076). Of the putative non-coding transcripts 9,903 (5.3%) exceeded the CPAT cutoff and met the criteria for TUCP.

As additional evidence of coding potential, all transcripts were scanned for Pfam A or B domains across the three translated reading frames for stranded transcripts and six frames for monoexonic transcripts of unknown strand. To control for false positives, non-transcribed intergenic regions were scanned in the same manner. 3,781,935 hits to 12,430 unique Pfam domains in transcribed regions were observed compared with 1,774,937 hits to 1,277 unique domains in non-transcribed intergenic space. The occurrences of each Pfam domain in transcribed versus non-transcribed regions were compared using Fisher's Exact Test and 750 domains with an odds ratio of less than 10.0 or p-value greater than 0.05 as likely artifacts were flagged (FIG. 9d). The remaining 11,726 Pfam domains were considered valid. This procedure filtered 2,972,629 artifact hits and retained 809,306 valid hits. Putative non-coding transcripts harbored only 4,674 (0.40%) of the valid Pfam domains.

The presence of Pfam domains provided strong support for CPAT coding predictions. The presence or absence of a Pfam domain stratified transcripts by the three features modeled by CPAT as well as overall coding probability (FIG. 9e). Transcripts possessing Pfam domains were much more likely to be predicted positive by CPAT than those lacking a Pfam domain (p-value<2.2e-16, odds ratio=90.3, Fisher's Exact Test). Given the complementary aspects of Pfam domain and CPAT prediction, putative non-coding transcripts with either a Pfam domain or a positive CPAT prediction as TUCP were designed. In total 11,603 uncharacterized transcripts were flagged as TUCPs, including 5,248 transcripts previously annotated as lncRNAs. There were 2,729 uncharacterized transcripts with at least one Pfam domain, including 1,700 that did meet the CPAT criteria. By contrast, 8,874 CPAT positive transcripts lacked a valid Pfam domain. Transcripts predicted by CPAT that also harbored valid Pfam domains had longer ORFs, higher hexamer scores, and higher Fickett TESTCODE scores than other TUCPs, indicating that the Pfam and CPAT calls may be complementary (FIG. 9f-h).

Coding Potential Assessment Tool (CPAT) version 1.2.1 was performed with default parameters and used the human hexamer table and logit model (Wang, L. et al. Nucleic acids research 41, e74, (2013)). Results were scanned for Pfam 27.0 (March 2013) A and B hits using the pfam_scan.pl utility built on HMMER 3.1b (Eddy, S. R. PLoS computational biology 7, e1002195, (2011); Finn, R. D. et al. Nucleic acids research 42, D222-230, (2014)). Receiver operating characteristic (ROC) analysis was performed using the ROCR package (Sing, et al., Bioinformatics 21, 3940-3941, (2005)).

Proteomics Analysis

Thermo .raw files were obtained from the PRIDE database. Adult_Kidney_Gel_Elite_55, Adult_Liver_Gel_Elite_56, Adult_Pancreas_Gel_Elite_60, Adult_Rectum_Gel_Elite_63, Adult_Urinarybladder_Gel_Elite_40, Fetal_Brain_Gel_Velos_16, Adult_Lung_Gel_Elite_56, and Adult_Prostate_Gel_Elite_62. The Thermo .raw fiels were transformed into mzXML using MSConverter and interrogated against human UniProt database V.15.11 using X!tandem search engine. The database was concatenated with all possible open reading frames longer than 7 amino acids from lncRNA database and with reversed sequences for determination of FDR. The X!Tandem search parameters were: fully tryptic cleavage, parent mass error 5 ppm, fragment mass error 0.5 Da, 2 allowed missed cleavages. Fixed modifications: Cys carbamidomethylation. Variable modifications: Met oxidation. X! Tandem output files were processed by PeptideProphet and ProteinProphet and for final output the data was filtered at peptide probability 0.5 and protein probability 0.9 to ensure protein FDR<1%.

Confidence Scoring System

After assembly of the MiTranscriptome, transcripts were subjected to an additional confidence evaluation. lncRNAs in the MiTranscriptome were categorized into tiers based on their annotation status and the degree of matching of splice junctions to the reference annotation. Tier 1 transcripts are all annotated and tier 2 transcripts are unannotated. An empirical cumulative distribution function was developed by profiling the second highest expression value (across all 6,503 samples) for each tier 1 transcript. The second highest value was used to control for outlier expression. The second highest expression value for each tier 2 transcript was then fed into the distribution function to produce the confidence score.

Validation of lncRNA Transcript by qRT-PCR 150 lncRNAs with at least 1 FPKM expression in either A549, LNCaP, or MCF7 cells were chosed for biological validation. For each transcript, primer pairs were designed using the Primer-BLAST tool. Primer pairs with the following parameters were selected: (1) amplicon length between 80-140 bp (2) primer GC content between 35-65%, and (3) primer length greater than 20 bp. Primers were blasted against the human genome to ensure specificity to the target gene, and primers designed against multiexonic transcripts spanned exon junctions. Regions of any transcript that directly overlapped an exon on the antisense strand were avoided. Primer pairs meeting these criteria could be designed for 100 out of 150 lncRNAs (38 monoexonic and 62 multiexonic). All oligonucleotide primers were obtained from Integrated DNA Technologies (Coralville, Iowa).

RNA was isolated from A549, LNCaP and MCF7 cells in Trizol (Invitrogen) using the RNeasy Mini Kit (Qiagen). Equal amount of RNA was converted into cDNA using random primer's and the Superscript III reverse transcription system (Invitrogen). Quantitative real-time PCR (qPCR) was performed using Power SYBR Green Mastermix (Applied Biosystems, Foster City, Calif.) on an Applied Biosystems 7900HT Real-Time PCR System. The housekeeping genes, CHMP2A, EMC7, GPI, PSMB2, PSMB4, RAB7A, REEP5, SNRPD3 were used as loading controls56. Data was normalized first to housekeeping genes and then to the median value of all samples using the delta-delta Ct method and plotted as fold change over median. To ensure the specificity of the primers, 20 amplicons were further analyzed by Sanger sequencing.

Cell Lines and Reagents:

All cell lines were obtained from the American Type Culture Collection (Manassas, Va.). Cell lines were maintained using standard conditions. Specifically, A549 were grown in F-12K plus 10% fetal bovine serum (FBS), LNCaP in RMPI1640 (Invitrogen) plus 10% FBS and 1% penicillin-streptomycin, and MCF7 in Eagle's Minimum Essential Media (EMEM) plus 10% FBS. All of the cell lines were grown at 37° C. degrees in a 5% CO2 cell culture incubator. To ensure identity, cell lines were genotyped at the University of Michigan Sequencing Core using
Profiler Plus (Applied Biosystems) and compared with the short tandem repeat (STR) profiles of respective cell lines available in the STR Profile Database (ATCC). All of the cell lines were routinely tested and found to be free of *Mycoplasma* contamination.

Evidence for Active Regulation of Transcriptional Start Sites

To conduct analysis of TSS intervals ENCODE project datasets were downloaded from the UCSC Genome Browser (Karolchik, D. et al. Nucleic acids research 42, D764-770, (2014)). For H3K4me3 analysis the Encode Project Broad Institute H3K4me3 ChIP-Seq peaks for cell lines GM12878, H1-hESC, HeLa-S3, HepG2, HMEC, HSMM, HSMMtube, HUVEC, K562, NH-A, NHDF-Ad, NHEK, and NHLF57 were used. For RNA polymerase II analysis POL2RA binding sites from the Encode Project Uniform TFBS master file version 3 for any of the cell lines with H3k4me3 data were used (Consortium, E. P. et al. Nature 489, 57-74, (2012)). Finally, for DNase hypersensitivity analysis the Encode Project combined UW and Duke DNaseI hypersensitivity regions were downloaded as a master file from EMBL-EBI, and filtered for any of the cell lines with H3k4me3 data. Peak enrichment files (BED format) were aggregated across all cell lines.

Intervals of +/−10 kilobases surrounding unique MiTranscriptome TSSs were generated using BEDTools 'slop' tool (Quinlan, A. R. & Hall, I. M. Bioinformatics 26, 841-842, (2010)). TSSs were filtered for expression in each cell line at RPKM>0.1. Basewise peak coverage was generated for each TSS interval using the BEDTools 'coverage' function and summarized across subsets of TSSs. Summed per-base coverage histograms were normalized by dividing by the number of expressed TSSs.

Conservation Analysis

The evolutionary conservation of transcripts in the assembly was studied using two metrics: (1) the fraction of significantly conserved bases (p<0.01, phyloP algorithm), and (2) the maximally conserved 200nt sliding window (phastCons scores averaged within each window). The former captures independently conserved elements within a transcript regardless of position, and the latter captures contiguous regions of high conservation. The 200nt sliding window size was chosen to aid in discovery of putative ultraconserved elements (Bejerano, G. et al. Science 304, 1321-1325, (2004)). As a negative control the conservation of non-transcribed regions was measured using these metrics by randomly sampling contiguous length-matched intervals from intergenic and intronic space. Non-transcribed interval sampling was restricted to regions with valid 46-way conservation data. The fractional basewise conservation and contiguous window conservation metrics were used to nominate highly conserved and ultraconserved transcripts, respectively. In both cases cutoffs for significant transcripts were determined by controlling the rate of observing elements with similar conservation levels within non-transcribed intergenic space at a level of 0.01. For fractional basewise conservation a score of 0.0947 (9.5% of transcript bases conserved at phyloP p-value<0.01) corresponded to a false discovery rate<0.01. At this cutoff the sensitivity for detecting protein-coding transcripts was 0.67. For contiguous sliding window conservation an average PhastCons probability of 0.9986 corresponded to a false discovery rate<0.01. At this cutoff the sensitivity for detecting true positive ultraconserved non-coding elements downloaded from UCNEbase was 0.6926. Applying these criteria to the assembly yielded 6,034 lncRNAs (3.4%) and 541 TUCPs (4.7%) with significant basewise conservation levels. Additionally, 1,686 lncRNAs (0.96%) and 121 TUCPs (0.01%) harbored contiguous ultraconserved regions.

GWAS Analysis

A list of GWAS SNPs was obtained from the National Human Genome Research Institute's GWAS catalog (Welter, D. et al. Nucleic acids research 42, D1001-1006, (2014)). SNP haplotypes were excluded from the SNP overlap analysis, and a list of 11,194 unique SNPs was obtained. The merged union of the RefSeq, UCSC, and GENCODE catalogs was used as a reference for comparison with MiTranscriptome.

Genomic conservation profiles generated by the phyloP (phylogenetic p-values) and PhastCons algorithms for multiple alignments of 45 vertebrate genomes to the human genome were downloaded from the UCSC genome browser (Karolchik, D. et al. Nucleic acids research 42, D764-770, (2014); Pollard, et al., Genome research 20, 110-121, (2010); Siepel, A. et al. Genome research 15, 1034-1050, (2005)). The 'wigFix' formatted files were converting into 'bigwig' formatted files using the 'wigToBigWig' binary utility program provided by the UCSC genome browser (Karolchik et al., supra). For each transcript a vector of conservation scores for each exon was extracted using the 'bigWigToBedGraph' utility and concatenated into a single vector. Conservation metrics were then computed from these vectors.

Intersections of GWAS SNPs with transcripts or exons was performed using the BEDtools 'intersect' tool, with the '-split' option invoked for quantification of exonic Overlap (4. The number of GWAS SNPs overlapping the entire assembly and individual transcript categories (lncRNA, TUCP, pseudogene, protein-coding, and read-through) was determined by BEDTools 'intersect' for both the whole transcript and for exonic regions (nGWAS). Subsequently, a set of all the SNPs from two popular SNP arrays (Illumina HumanHap550 and Affymetrix SNP6) was created, which was termed the "SNP background". The amount of SNPs from the SNP background overlapping the MiTranscriptome was calculated (nbackground), and the fraction of the number of overlapping GWAS SNPs to the number of overlapping SNPs from the SNP background (fracGWAS=nGWAS/nbackground) was then reported for each category. This fraction was also calculated using random shuffling of the MiTranscriptome and its components into noncoding regions of the genome (fracshuffle). One hundred shuffles were performed for each condition, and an odds ratio (ORGWAS=fracGWAS/fracshuffle) was determined for each shuffle. The purpose of using fracGWAS instead of simply using nGWAS in this analysis is to control for the possibility that during the shuffle, transcripts could be shuffled into regions not represented on SNP arrays (e.g., regions unable to possess GWAS SNPs), falsely lowering the amount of GWAS SNP overlap by the shuffle. If transcripts are shuffled into regions that are not represented by the SNP background, both nGWAS and nbackground will decrease together, with fracGWAS relatively unchanged.

Shuffling was performed using the BEDTools 'shuffle' tool. MiTranscriptome transcripts were grouped by transcription locus (e.g., regions of the genome that have contiguous transcription) prior to shuffling. Shuffling of transcript loci was performed to control for the fact that transcripts within a locus are spatially linked to one another. Shuffling without locus clustering would falsely elevate the amount of genome covered by transcripts, and subsequently elevate the number of SNPs overlapping the shuffled regions. A concatenation of the UCSC hg19 gaps file and the MiTranscriptome protien-coding transcripts was used as an exclusion file for these shuffles.

As a negative control, the entire above analysis was repeated using and equal number randomly selected SNPs (chosen from the Illumina HumanHap550 and Affymetrix SNP6 background) in place of the GWAS SNPs. The significance of enrichment for GWAS SNPs versus random SNPs was measured across identical shuffles of the transcript loci using paired Student's t-tests comparing the set of odds ratios for all shuffles. Similar analysis to determination of compendia enrichment was performed to identify enrichment of novel intergenic lncRNAs and TUCPs. The intergenic space was defined as all regions not covered by the merged reference. For this analysis, the shuffles were performed into the intergenic space, instead of all non-coding space. The exclusion file used by BEDtools 'shuffle' was a concatenation of the UCSC gaps file and the merged reference.

Transcript Expression Estimation

Figure 3:
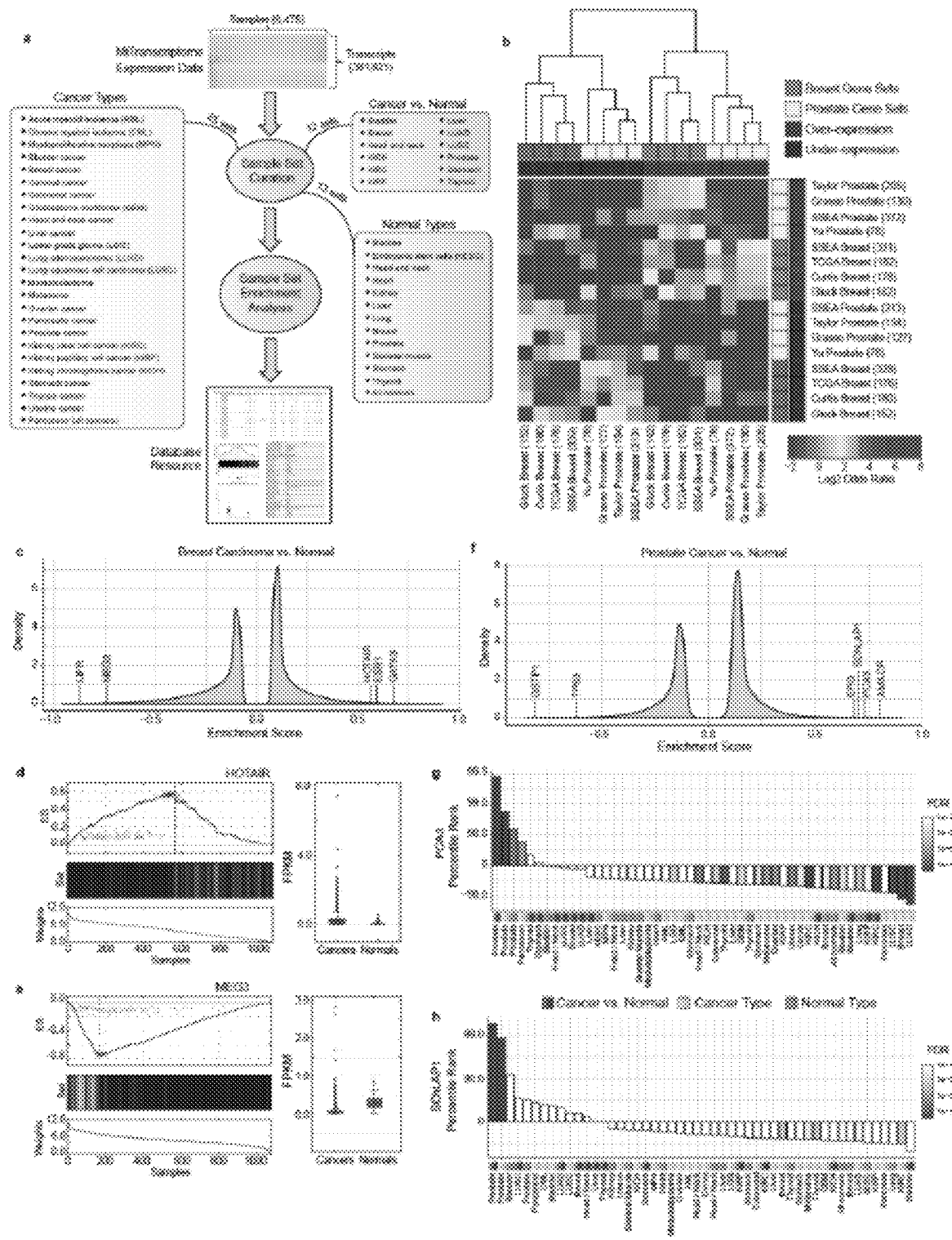
FIG. 3 shows exemplary methodology for discovering cancer-associated lncRNAs. (a) Transcript expression analysis workflow. (b) Heatmap showing concordance of SSEA algorithm with cancer gene signatures obtained from the Oncomine database. (c) Sample set enrichment density plots showing spectrum of transcript enrichment scores (ES) obtained from SSEA analysis of breast carcinomas versus corresponding normal samples. (d and e) SSEA enrichment plots and expression boxplots for the lncRNAs (d) HOTAIR and (e) MEG3. (f) Sample set enrichment density plots showing spectrum of transcript enrichment scores (ES) obtained from SSEA analysis of prostate carcinomas versus corresponding normal samples. (g and h) Transcript enrichment bar plots for prostate cancer-specific lncRNAs (g) PCA3 and (h) SChLAP1 across Cancer vs. Normal, Cancer Type and Normal Type sample sets.

Expression levels (FPKM) of the transcripts in the assembly were determined using Cufflinks (version 2.02 and 2.1.1)60. Normalized abundance estimates (FPKM) were computed for all MiTranscriptome transcripts, converted into approximate fragment count values, and aggregated into a matrix of expression data (FIG. 3a). Library size factors for expression normalization were computed by applying the geometric normalization method described by Anders and Huber (Genome biology 11, R106 (2010)).

The transcript abundances for all transcripts in the MiTranscriptome assembly were estimated using Cufflinks version 2.1.15 with the following parameters: '-maxfragmultihits=1', '-no-effective-length-correction', '-maxbundle-length 5000000', '-maxbundle-frags 20000000'. To convert normalized transcript abundance estimates (FPKM) to approximate fragment count values each FPKM is multiplied by the transcript length (in kilobases) and by the "Map Mass" value (divided by 1.0e6) reported in the Cufflinks log files. By some reverse engineering and assistance from the seqanswers online forum (seqanswers.com), it was determined that this factor was utilized in the normalization process. Abundance estimation for 28 libraries failed for technical reasons (corrupt BAM files) and these libraries were discarded from the expression analysis. Expression estimation for 2,246 transcripts yielded errors and/or zero-valued counts and were discarded.

Transcript Expression Enrichment Analysis

To analyze differential expression of transcripts relative to sample phenotypes a method called Sample Set Enrichment Analysis (SSEA) was developed. The source code for this software is available online. The method adapts the weighted Kolmorgorov-Smirnoff (KS) tests proposed by Gene Set Enrichment Analysis (GSEA). In contrast to GSEA, which tests for associations with gene sets, SSEA tests for associations between individual gene expression observations (which could be transcript or gene expression) and sample sets. Thus, SSEA is analogous to performing GSEA on a 'transposed' input dataset. However, SSEA incorporates important features not provided by GSEA: (1) methodology for non-parametric analysis of discrete count data (e.g. RNA-Seq count datasets), (2) engineering improvements to enable analysis of big datasets (here, a matrix of 381,731 rows and 6,475 columns was analyzed using less than 1 Gb of RAM), and (3) parallelization of the algorithm for use in high performance computing environments.

Differential expression testing was performed using the Sample Set Enrichment Analysis method developed as part of this study. SSEA was performed with 100 iterations of count resampling and 1,000 null permutations for each transcript (--resampling-iterations=100, --perms=1000). These parameters yielded a minimum FDR resolution of approximately 1e-7 for all sample sets. Weights for the KS-test were $\log(x+1)$-transformed normalized count values (--weight-hit=log, --weight-miss=log, --weight-param=1).

KS-Tests Using Normalized Count Data Vectors as Weights.

To convert count values into weights for a single KS-test the following steps are performed: (1) raw count values are normalized by library-specific size factors, (2) normalized count values are "resampled" from a Poisson distribution (lambda equals the observed count value) to mimic the effect of technical replication, and (3) random Poisson noise (by default, lambda equals 1) is added to the normalized, resampled count values to destabilize zero-valued counts and break ties. A power transform (exponential or logarithmic) is then applied to the weights (by default, a logtransformation is applied after incrementing normalized count values by 1). The choice of power transformation influences the relative importance of precision versus recall during enrichment testing. For example, users aiming to discover genes new in molecular subtypes of a disease would prioritize precision over sensitivity, whereas a user aiming to discover ideal biomarkers may value sensitivity over precision. Following count data normalization and power transformation, SSEA performs the weighted KS-test procedure described in GSEA28. The resulting enrichment score (ES) statistic describes the strength of association between the weights and the sample set.

To control for random sampling bias in count values (e.g. "shot noise") SSEA performs repeated enrichment tests using resampled count values to mimic observations from technical replicates and uses the median enrichment score (by default, 100 tests are performed). The basis for Poisson resampling as a legitimate model for technical replication was established by Marioni et al. 62 To test for significance, SSEA performs enrichment tests using randomly shuffled sample labels to derive a set of null enrichment scores with the same sign as the observed score (by default, 1000 null enrichment scores are computed). The nominal p value reported is the relative rank of the observed enrichment score within the null enrichment scores. To control for multiple hypothesis testing, SSEA maintains the null normalized enrichment score (NES) distributions for all transcripts in a sample set, and uses the null NES distribution to compute FDR q values in the same manner as proposed by Subramanian et al. (Proceedings of the National Academy of Sciences of the United States of America 102, 15545-15550, (2005)).

Benchmarking SSEA performance using microarray gene signatures

Gene signatures for the top 1% of overexpressed and underexpressed genes from three prostate cancer (Grasso, C. S. et al. Nature 487, 239-243, (2012); Taylor, B. S. et al. Cancer cell 18, 11-22, (2010); Yu, Y. P. et al. Journal of clinical oncology: official journal of the American Society of Clinical Oncology 22, 2790-2799, (2004)) and three breast cancer (Cancer Genome Atlas, N. Nature 490, 61-70, (2012); Curtis, C. et al. Nature 486, 346-352, (2012); Gluck, S. et al. Breast cancer research and treatment 132, 781-791, (2012).) microarray studies were obtained using Oncomine (Rhodes, D. R. et al. Neoplasia 9, 166-180 (2007).). The top 1% gene signatures as detected by SSEA in the MiTranscriptome breast and prostate cohorts were determined using prostate cancer versus normal and breast cancer versus normal sample sets (FIG. 3a). Given that the MiTranscriptome was produced from an ab initio assembly, transcript identity was assigned to the annotated reference gene with the greatest degree of concordance, where degree of splicing agreement was prioritized over degree of exonic same-stranded overlap. The most-enriched isoform for each gene was used to produce a gene signature.

Degree of overlap for all combinations of the 16 gene sets tested (3 published breast up-regulated sets, 3 published breast down-regulated sets, 3 published prostate up-regulated sets, 3 published prostate down-regulated sets, 1 SSEA-determined prostate up-regulated set, 1 SSEA-determined prostate down-regulated set, 1 SSEA-determined breast up-regulated and 1 SSEA-determined breast down-regulated set) was determined by calculating an odds ratio and performing a Fisher's exact test for each gene set pair. Each comparison was restricted to the set of genes assessed by both profiling platforms. Microarray chip annotation files were downloaded from the Molecular Signatures Database (MSigDB) web site (Subramanian, A. et al, supra). The set of all annotated genes (relative to RefSeq, UCSC, and GENCODE) was used as the annotation file for MiTranscriptome.

Discovery of Lineage-Specific and Cancer-Specific Transcripts

To generate enrichment test data for unsupervised clustering, transcripts were ranked within each SSEA sample set by normalized enrichment score (NES) and assigned fractional ranks (e.g. a fractional rank of 0.95 implies the transcript ranked in the top 5th percentile of all transcripts in the sample set). Only significant results (FDR<1e-7 for lineage analysis and FDR<1e-3 for cancer versus normal analysis) were used. Unsupervised clustering was performed using Pearson correlation of log-transformed fractional ranks as a distance metric and Ward's method. Transcripts that were significantly associated with multiple sample sets were grouped with the most strongly associated sample set. Heatmaps were produced using the 'heatmap.2' function from the 'gplots' package in R.

Guilt-by-Association GSEA Analysis

For each cancer and/or lineage associated lncRNA, expression levels of the target lncRNA were correlated to the expression of all protein-coding genes across all samples in the associated tissue cohort. For cancer cohorts (e.g. breast, prostate), correlations were performed (Spearman) using only the cancer samples (normal samples were excluded). To account for multiple isoforms of each The protein-coding genes were then ranked by the Rho value, and used in a weighted, pre-ranked GSEA analysis against a collection of cancer associated gene sets from MSigDB. Significant associations were determined for any gene set having an FWER p-value below 0.001.

Results

An Expanded Landscape of Human Transcription

The spectrum of human transcriptional diversity was investigated by curating 7,256 poly-A+ RNA-Seq libraries from 25 independent studies, including 5,847 from TCGA, 928 from the Michigan Center for Translational Pathology (MCTP), 67 libraries from the Encyclopedia of DNA Elements (ENCODE), and 414 samples from other public datasets (FIG. 5a). An automated transcriptome assembly pipeline was developed and employed to process the raw sequencing datasets into ab initio transcriptome assemblies (FIG. 5b). This bioinformatics pipeline utilized approximately 1,870 core-months (average 0.26 core-months per library) on high-performance computing environments.

Collectively the RNA-Seq data constituted 493 billion fragments; individual libraries averaged 67.9M total fragments and 55.5M successful alignments to human chromosomes. On average 86% of aligned bases from individual libraries corresponded to annotated RefSeq exons, while the remaining 14% fell within introns or intergenic space15. Coarse quality control measures were used to account for variations in sequencing throughput, run quality, and RNA content by removing 753 libraries with (1) fewer than 20 million total fragments, (2) fewer than 20 million total aligned reads, (3) read length less than 48 bp, or (4) fewer than 50% of aligned bases corresponding to RefSeq genes (FIGS. 5c,d). After coarse filtration, approximately 391 billion aligned fragments (43.69 terabases of sequence) were identified for subsequent analysis. The set of 6,503 libraries passing quality control filters included 6,280 datasets from human tissues and 223 samples from cell lines. Of the tissue libraries, 5,298 originated from primary tumor specimens, 281 from metastases, and 701 from normal or benign adjacent tissues (FIG. 5e). This set of samples is referred to as the MiTranscriptome compendium.

Upon processing the MiTranscriptome libraries, ab initio transcriptome were obtained reconstructions from 6,503 individual tumors, normal tissues, or cell lines. A computational methodology was developed to coalesce individual transcriptomes into a consensus transcriptome, a procedure known as 'meta-assembly'. Unlike previous methods for meta-assembly of expressed sequence tag (EST) data or small numbers of RNA-Seq experiments, the meta-assembly utilized in this study addressed computational and scalability challenges stemming from the magnitude of this study (Haas, B. J. et al. Nucleic acids research 31, 5654-5666 (2003); Trapnell, C. et al. Nature protocols 7, 562-578, (2012)).

To permit sensitive detection of lineage-specific transcription the libraries were partitioned into 18 cohorts by organ system (FIG. 1a), performed filtering and meta-assembly separately for each cohort, and re-merged the cohorts (FIG. 1b). The individual ab initio assemblies collectively totaled ~312M transcript predictions (transfrags) across all libraries. To perform filtering, short transfrags (<250 bp) and clipped short flanking exons (<15 bp) were removed, leaving ~304M transfrags (FIG. 6a). Whereas levels of annotated transfrags were relatively constant, fractions of unannotated intragenic and intergenic transcripts varied considerably across libraries (FIG. 6b). Almost one-third of all transfrags were unannotated (29.3%, or 89M), including 86.2M monoexonic and 2.8M multiexonic transfrags. Two sources of background noise in RNA-Seq experiments that could give rise to unannotated mono-exonic transfrags are incompletely processed RNA and genomic DNA contamination (FIG. 6c). To minimize this noise, a conservative filtering scheme was used (FIG. 6d). 60M mono-exonic transfrags within introns that could have arisen from incompletely processed RNA were discarded. A machine learning method was developed to discriminate recurrent antisense and intergenic transcription from possible genomic DNA contamination. The approach models the empirical distributions of relative transcript abundance and recurrence (number of independent samples in which the transcript was observed) to determine optimal library-specific thresholds for distinguishing annotated from unannotated transcription. The classifier achieved remarkable performance (average AUC of 0.89, range 0.77-0.96) and displayed no bias for cancer versus normal samples (FIG. 6e). Moreover, the classifier recovered test transcripts left out of the training process with 80% mean sensitivity (range 0.64-0.95, FIG. 6f). Ultimately 3.2M of the 86.2M (3.7%) mono-exonic intergenic or antisense transfrags were retained for a total of 6.0M unannotated transfrags (6.75% of the original 89M). The filtered collection of 221M annotated and unannotated transfrags was subjected to meta-assembly. The meta-assembly algorithm first collapses transfrags into a splice graph and utilizes transcript abundance information to prune intron-retentions and trim long first or last exons (FIG. 7a). Furthermore, the algorithm integrates splicing pattern information by constructing a splicing pattern graph and traverses the graph using a greedy dynamic programming algorithm to generate full-length transcript predictions (FIG. 7b). For example, meta-assembly of 7,471 transfrags in the chromosome 12 locus containing HOTAIR and HOXC11 produced just 17 transcripts, including transcripts that accurately matched annotated HOTAIR and HOXC11 isoforms (FIG. 7c). After merging meta-assemblies from 18 cohorts, a consensus set of 384,066 predicted transcripts designated as the MiTranscriptome assembly was identified.

Figure 8:
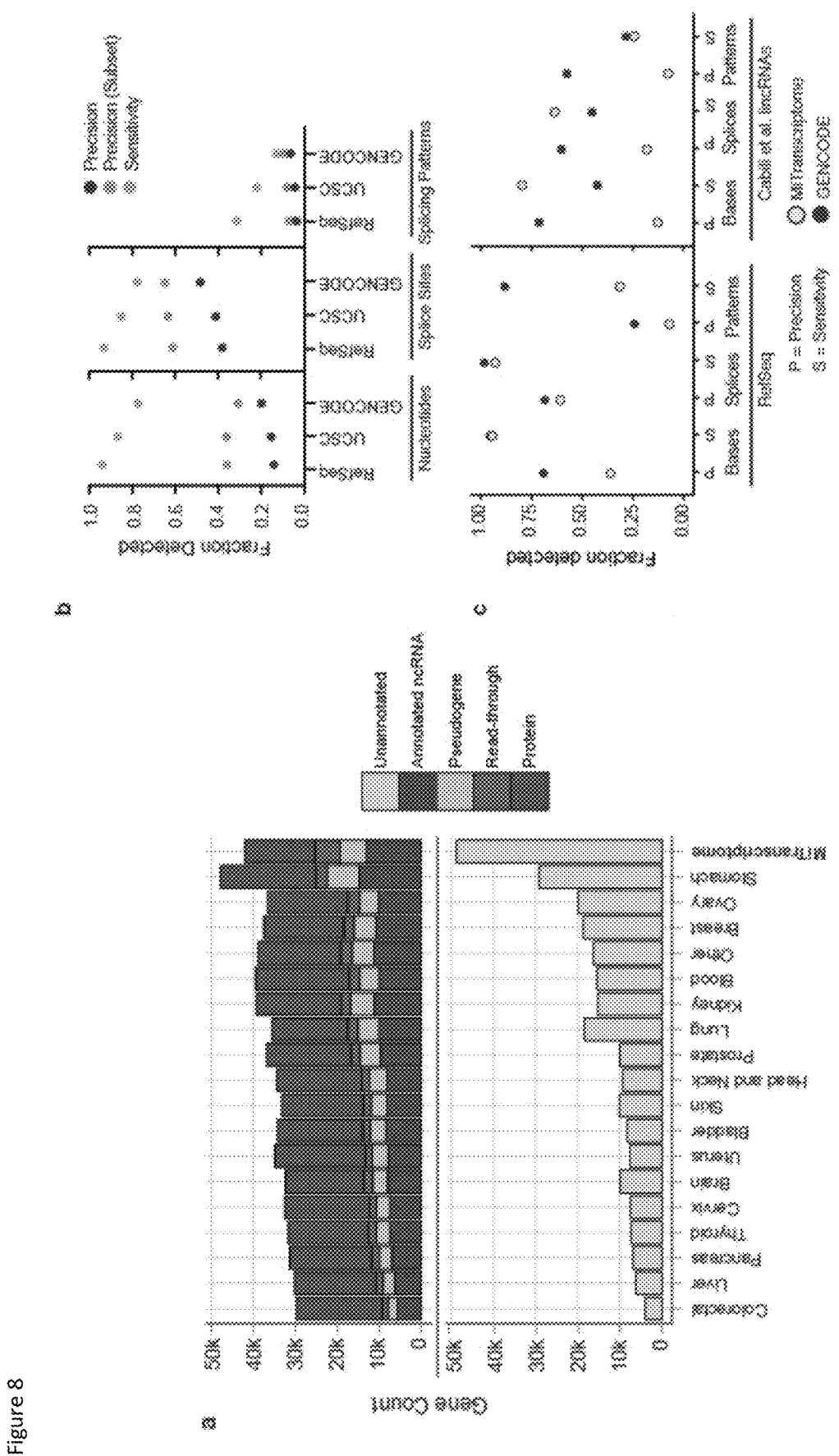
FIG. 8 shows characterization of unannotated transcripts. a, Bar plots comparing numbers of unannolated versus different dasses of annotated transcripts for each of the 18 cohorts. b, 001 plots depicting comparison of MiTransriptome with reference transcripts from RefSeq, UCSC, or GENCODE. c, Dot plots comparing the basewise, splice site, and splicing pattern precision and sensitivity of MiTranscriptome and GENCODE using RefSeq (left) or Cabili et al. LncRNAs (right)

To begin characterizing the assembly, comparisons with reference catalogs from RefSeq (December, 2013) (Pruitt, K. D. et al. Nucleic acids research 42, D756-763, (2014)), UCSC (December, 2013) (Karolchik, D. et al, supra), and GENCODE (Release 19) (Harrow, J. et al. Genome research 22, 1760-1774, (2012)). (FIG. 1c) were performed. In particular, increases in numbers of exons, splice sites, transcripts, and genes of 29%, 52%, 95%, and 57%, respectively, were observed relative to GENCODE, the most expansive of the three reference catalogs. To understand the source of the increases, the assembly was overlapped with a merged union of the three reference catalogs and the fraction of unannotated versus annotated transcripts were delineated for each cohort (FIG. 8a).

Analysis of the assemblies on the cohort level reveals that the majority of transcripts assembled within each lineage cohort overlapped annotated genes (range 62-88%, mean 75%). However, the fraction of annotated genes within the entire MiTranscriptome (a merger of the 18 individual cohorts) was just 46%, indicating the presence of much unannotated transcription unique to specific lineages. The sensitivity and precision for detecting annotated nucleotides, splice sites, and splicing patterns in the three reference catalogs and intergenic lncRNA predictions from the previous cataloguing study by Cabili et al. (Cabili, M. N. et al. Genes & development 25, 1915-1927, (2011)) were quantitated (FIG. 8b,c). The MiTranscriptome assembly was very sensitive to detection of annotated transcribed bases and splice sites. For example, the MiTranscriptome detected 94% and 93% of annotated RefSeq bases and splice sites, respectively. Detection of precise splicing patterns remains an ongoing challenge for in silico transcriptome reconstruction methods (Steijger, T. et al. Nature methods 10, 1177-1184, (2013)).

Coding Potential Assessment of Long RNA Transcripts

To facilitate further study of the assembly, transcripts were classified into one of five categories: (1) Protein-coding, (2) Read-through (implying a transcript overlapped multiple separate annotated genes), (3) Pseudogene, (4) lncRNA, and (5) Transcript of Unknown Coding Potential (TUCP) (FIG. 9a). The TUCP classification was originally described by Cabili et al. (supra) and pertains to long RNAs with features indicative of coding potential but not already annotated as protein coding. The ability to predict coding potential in silico using sequence features alone has important implications for ab initio transcript annotation studies. Here, TUCPs were predicted by incorporating two methods: (1) predictions from the Coding Potential Assessment Tool (CPAT) (Wang, L. et al. Nucleic acids research 41, e74, (2013)), which analyzes the sequence features of transcript open reading frames (ORFs), and (2) presence of a known Pfam domain (Finn, R. D. et al. Nucleic acids research 42, D222-230, (2014)) within a transcript ORF (FIG. 9b-h). Over sixty percent of all MiTranscriptome genes were classified as either lncRNAs or TUCPs (59% lncRNAs, 3.5% TUCPs, FIG. 2a). The majority of lncRNAs and TUCPs were unannotated relative to RefSeq, UCSC, and GENCODE genes (79% and 66%, respectively) and located within intergenic regions (72% and 60%, respectively) (FIG. 2b). 5,248 transcripts overlapping annotated lncRNAs were flagged as TUCPs, indicating that previous annotation attempts may have identified incomplete ostensibly noncoding fragments that may actually comprise transcripts possessing robust ORFs. For example, in a chromosome 16 intergenic locus, transcripts harboring a 418 amino acid ORF spanning 29 exons that overlapped three independent genes annotated by GENCODE as lncRNAs (LINC00514, LA16c-380H5.3, LA16c-380H5.4) were identified, indicating that the annotated GENCODE lncRNAs may be incomplete partial annotations of a larger protein-coding gene (FIG. 2c).

To further investigate the coding potential of these TUCP transcripts, a proteomics analysis was performed to search for reported peptides that may map to ORFs in the TUCPs. Recent proteomics studies have produced the most comprehensive analysis of the human proteome to date (Kim, M. S. et al. Nature 509, 575-581, (2014)). Using these data, it was assessed whether any novel, uniquely mapping peptides map to an ORF in any of the TUCP transcripts. Many novel and uniquely mapping peptides in various tissue types mapped to ORFs in the TUCP transcripts, with a total of 268 TUCP genes possessing matching peptides. These and other TUCP predictions exemplify the potential for MiTranscriptome to enhance reference transcript catalogs.

Characterization and Validation of Long RNA Transcripts

LncRNA and TUCP genes tended to have fewer exons than read-through or protein coding genes, but appreciable alternative splicing was observed for all classes of transcripts (Cabili et al, supra; Derrien, T. et al. Genome research 22, 1775-1789, (2012).) (FIG. 10a). Furthermore, it was observed that lncRNAs and TUCPs were expressed at lower levels than read-through or protein-coding transcripts, which is also consistent with previous studies (Prensner, J. R. et al.

Nature biotechnology 29, 742-749, (2011)); Cabili et al., supra; Derrien et al., supra; Guttman, M. et al. Nature biotechnology 28, 503-510, (2010)) (FIG. 2d).

To characterize transcription start sites (TSS), intervals surrounding TSSs with ENCODE histone 3 lysine 4 trimethylation (H3K4me3) ChIP-Seq, RNA polymerase II (PolII) binding sites, and DNase hypersensitivity data from 13 cell lines were compared. To control for expression, binding was only assessed for transcripts expressed in the cell lines being assayed, filtered TSSs for expression before intersection at a level of FPKM>0.1. LncRNA and TUCP promoters were enriched for these marks relative to randomly shuffled control regions, with maximal enrichment at the TSS (FIG. 2e-g). Enrichment was lower for lncRNA and TUCP promoters than for protein-coding genes, but much more enriched than pseudogenes, which may reflect their overall lower expression levels. These chromatin modification and polymerase binding data indicate that the assembled lncRNA and TUCP transcripts possess actively regulated promoters.

Figure 11:
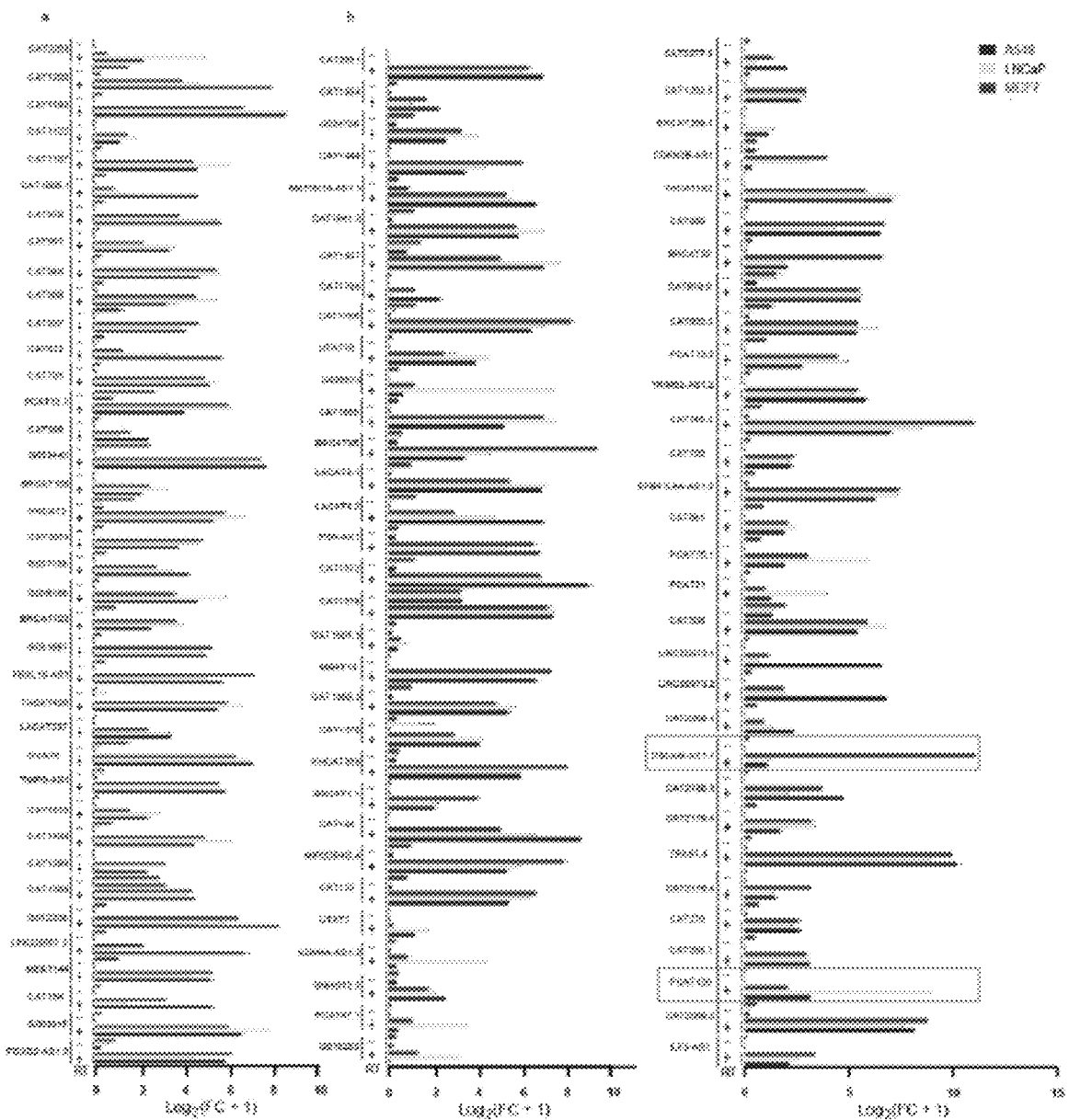
FIG. 11 shows validation of lncRNA transcripts.
Figure 12:
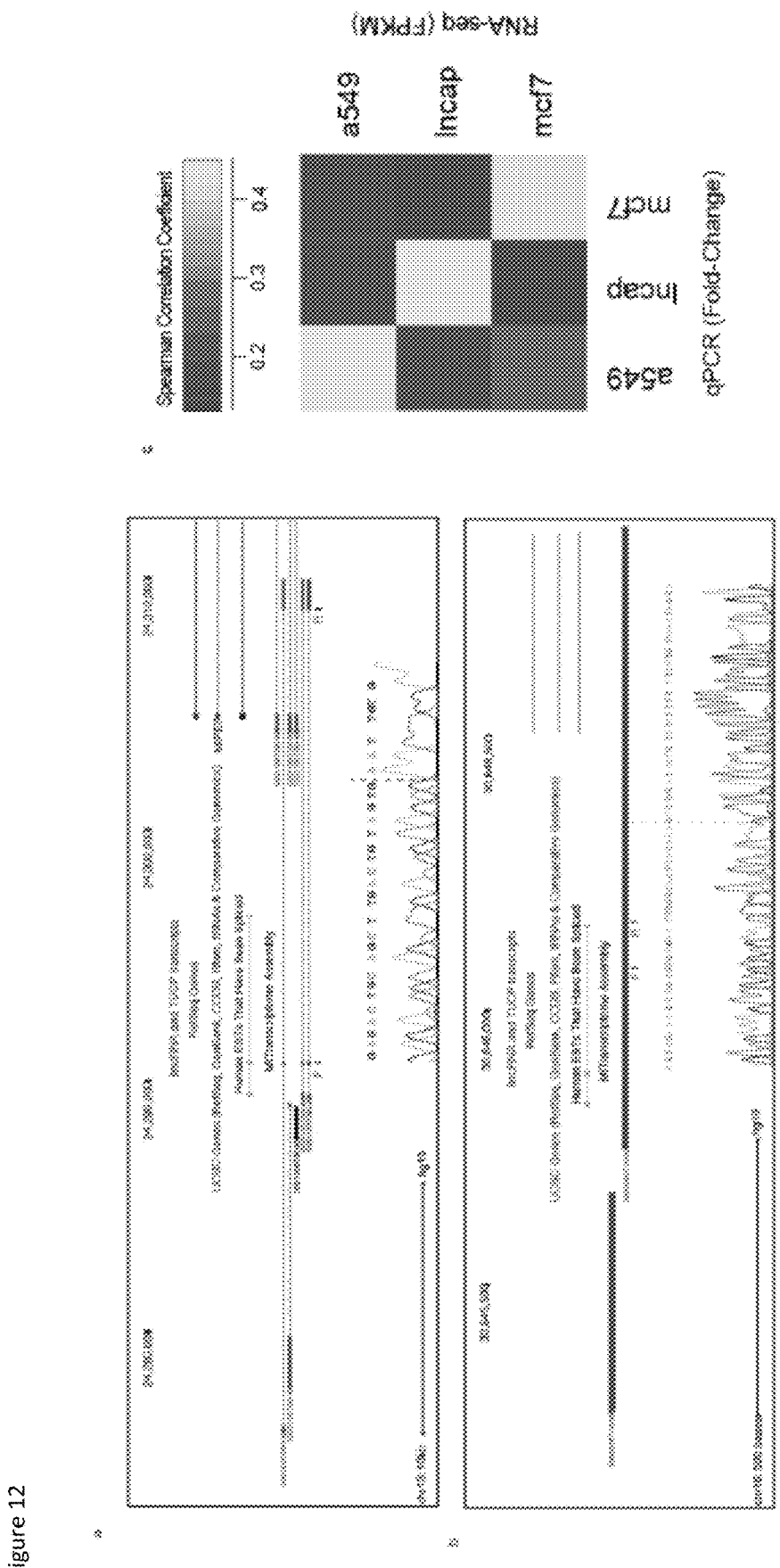
FIG. 12 shows validation of lncRNA transcripts. a, b, Representative example of two of twenty previously unannotated lncRNA transcripts that were analyzed by Sanger sequencing to ensure primer specificity with their associated chromatograms. c, Heatmap representation of the correlation between qPCR (fold change over median) with RNA-seq (FPKM) of 100 selected transcripts in cell lines A549, LNCaP, and MCF7.

During assembly of the MiTranscriptome, a first-pass filtering of low-confidence transfrags was performed via a machine-learning algorithm built using the expression level and recurrence of the transfrag (FIG. 6d). Millions of transfrags were removed at this step, and the resultant MiTranscriptome contains only transcripts that have met this first-pass confidence evaluation. To further stratify the confidence transcripts, a confidence score (CS) system was developed. lncRNAs were classified into two tiers based on their annotation status and the matching of splice junctions, and a cumulative distribution function was built using the expression levels for the annotated lncRNAs (tier 1). The expression level of each unannotated lncRNA (tier 2) was then fed into the cumulative distribution function to calculate a CS for each lncRNA (FIG. 10b). The CS profile of the tier 1 and tier 2 transcripts was largely similar, with a slight enrichment in low confidence transcripts among the unannotated transcripts (e.g. 32% of unannotated lncRNAs have CSs lower than the bottom 12.5th percentile of annotated lncRNAs). This phenomenon, however, can be explained by a discovery bias given that the confidence metric is expression based. To further strengthen confidence in the assembly transcripts, the predicted lncRNA expression was validated by qRT-PCR. qPCR primers were developed for 100 candidate lncRNAs. Three cell lines were selected representing lung cancer, prostate cancer and breast cancer (A549, LNCaP, MCF7, respectively), and lncRNAs with expression of at least 1 FPKM by RNAseq in at least one of the cell lines were selected for validation (38 monoexonic, 62 polyexonic). Given that genomic contamination can produce spurious monoexonic reads during assembly, an absence of reverse transcriptase (-RT) was used as a control for this study. Of the 100 lncRNAs tested, 95 had significantly higher expression with reverse transcriptase when compared to -RT (Student's t-test, p-value<0.05) in cell lines for which expression was expected via RNA-Seq (>1 FPKM) (FIG. 11). DSCAM-AS1 and PCAT130 are two examples of lncRNAs nominated by SSEA analysis to have cancer specificity (in breast and prostate, respectively) whose cell line expression profile by qRT-PCR reflects what is expected from the tissue SSEA analysis (FIG. 12, boxed genes).

To further ensure that the amplicon was from the expected gene, twenty of the most expressed transcripts across the three cell lines (according to the qRT-PCR data) were selected and their identity confirmed by Sanger sequencing. In eighteen of the twenty cases, the sequence of the exact gene of interest was amplified (FIG. 12a,b). Additionally, the expression values identified by qRT-PCR for each cell line were correlated to the RNA-seq FPKM values in each cell line. qRT-PCR was correlated best with RNA-seq expression from the same cell line (FIG. 12c).

LncRNAs Harboring Conserved Elements

The evolutionary conservation of lncRNAs has been a topic of ongoing conversation, with several reports indicating that lncRNAs are modestly conserved (Cabili et al, supra; Derrien et al. supra; Necsulea, A. et al. Nature 505, 635-640 (2014)). In agreement with previous reports, increases in both transcript and promoter conservation levels for lncRNAs and TUCPs relative to random control regions were observed (FIG. 10c-f). Shifts in the cumulative distributions of lncRNA and TUCP transcripts were greater for annotated transcripts relative to unannotated transcripts. This difference may reflect discovery bias favoring highly conserved genes detectable across multiple model systems. Despite observing increased conservation within the entire class of lncRNAs, the results indicated that human lncRNA conservation may be an exceptional phenomenon rather than a general one; therefore, lncRNAs harboring higher than expected basewise conservation were selected for focused study (FIG. 2h). 3,309 lncRNA genes (5.6% of all lncRNAs) that were highly conserved relative to random intergenic regions were selected (FIG. 10e). In addition, part of the noncoding genome includes ultraconserved elements (UCE), which are stretches of DNA>200nt with nearly perfect sequence identity across multiple organisms (Bejerano, G. et al. Science 304, 1321-1325, (2004); Dimitrieva, S. & Bucher, P.

Nucleic acids research 41, D101-109, (2013)). 597 intergenic lncRNAs (1.2% of all intergenic lncRNAs) harboring UCEs were designated as Highly Conserved Long Intergenic Non-Coding RNAs (HICLINCs) to promote further study of transcribed UCEs as a class (FIG. 10h). For example, THCAT126, a previously unannotated intergenic lncRNA on chromosome 2q24, contains elements in its final exons that are conserved in nearly all vertebrates including zebrafish (FIG. 2i). Moreover, THCAT126 is expressed widely across many tissue types, and is expressed in multiple cancers, with a significant association in the thyroid cancer versus normal analysis (FIG. 2j). Highly conserved lncRNAs such as THCAT126 (and many other cancer-associated HICLINCs described below) provide an avenue for in vivo study of the role of lncRNAs in development and cancer.

LncRNAs Overlapping Disease-Associated SNPs

Figure 13:
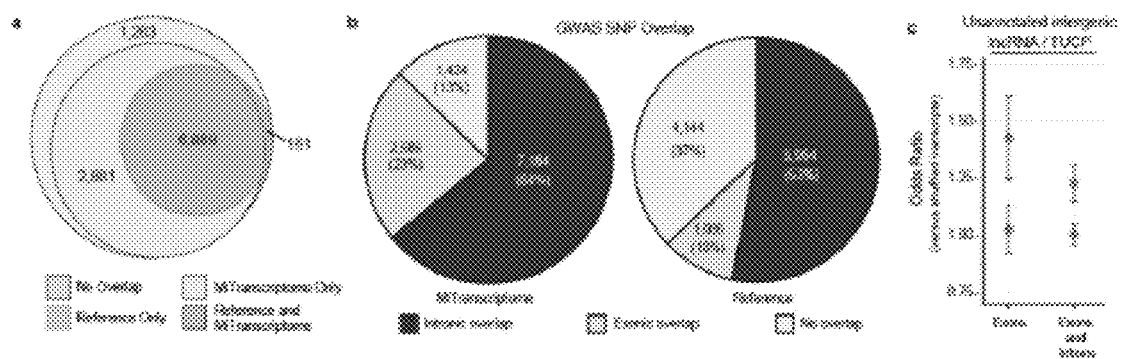
FIG. 13 shows enrichment of MiTranscriptome assembly for disease-associated regions. a, Venn diagram comparing coverage of disease or trait associated genomic regions for the MiTranscriptome assembly in comparison to reference catalog. b, Pie charts comparing distributions of intronic and exonic GWAS SNP coverage of the MiTranscriptome assembly (left) and reference catalogs (right). c, Dot plot showing enrichment of GWAS SNPs (cirde) versus random SNPs (diamond) for novel intergenic lncRNAs and TUCPs.

To investigate the relationship of the MiTranscriptome assembly with disease-associated regions of the genome, overlap of transcripts in the assembly was compared with 11,194 unique disease associated single nucleotide polymorphisms (SNPs) from a catalog of genome-wide association studies (GWAS) (Welter, D. et al. Nucleic acids research 42, D1001-1006, (2014)). MiTranscriptome transcripts overlapped 9,770 GWAS SNPs compared to just 7,050 SNPs overlapping GENCODE, UCSC, or RefSeq transcripts. Exonic overlap was 2,586 and 1,096 GWAS SNPs for the MiTranscriptome and aggregated reference catalogs, respectively (FIG. 13a,b). Altogether transcripts in the assembly coincided with 2,881 formerly intergenic SNPs located within 'gene deserts', and only missed 161 GWAS SNPs overlapping annotated genes. It was observed that the increased overlap with GWAS SNPs for MiTranscriptome transcripts and exons were significantly enriched for GWAS SNPs relative to random SNPs chosen from the same chip platform (paired t-test, p-value, 5.25e-135 and 1.15e-199, respectively, FIG. 2k). Moreover, unannotated intergenic lncRNAs and TUCPs were also significantly enriched for disease-associated regions, with exons more highly enriched than full-length transcripts (paired t-test, p-value, 9.90e-78 and 5.50e-50, for whole transcript and exon, respectively, FIG. 13c). These data indicate that a rigorous reevaluation of allele-specific gene expression regulation in regions proximal to GWAS SNPs yields informative biological associations with the new lncRNA transcripts identified in this study.

Detection of Cancer-Associated Transcription by Enrichment Analysis

The large-scale transcriptome reconstruction process unveiled tremendous transcriptional complexity highlighted by the presence of thousands of uncharacterized lncRNAs and TUCPs. To prioritize disease-associated and lineage-specific transcription, a nonparametric method for differential expression testing called Sample Set Enrichment Analysis (SSEA) was used. SSEA adapts the weighted Kolmorgorov-Smirnoff-like tests used by Gene Set Enrichment Analysis (GSEA) (Subramanian, A. et al. Proceedings of the National Academy of Sciences of the United States of America 102, 15545-15550, (2005)) to discover transcript expression changes associated with predefined sample sets. This method permits sensitive detection of differential expression within heterogeneous sample populations (e.g., tumor sub-types). Prior to running SSEA, isoform-level expression data for the entire MiTranscriptome assembly was re-computed and samples from the compendia were grouped into fifty sample sets. A sample set represents a single condition for evaluating differential transcript expression. The sets in the present study included various cancer types (e.g., prostate cancers versus all other MiTranscriptome samples), normal tissues or cell types, and cancer versus normal comparisons within a single tissue type (e.g., prostate cancers versus benign prostate samples) (FIG. 3a). All MiTranscriptome transcripts were tested against the fifty samples sets, and collectively, SSEA detected over two million significant associations (FDR<1e-3 for cancer versus normal analyses and FDR<1e-7 for lineage analyses) involving 267,726 of the 381,821 MiTranscriptome transcripts for which enrichment analysis was possible.

To validate the enrichment testing approach, its ability to rediscover known proteins up-regulated and down-regulated in prostate cancers and breast cancers was assessed by assessing the concordance between the top 1% positively and negatively enriched genes from each cancer type with cancer gene signatures obtained from the Oncomine database of microarray studies (Rhodes, D. R. et al. Neoplasia 9, 166-180 (2007); Cancer Genome Atlas, N. Nature 490, 61-70, (2012); Curtis, C. et al. Nature 486, 346-352, (2012); Gluck, S. et al. Breast cancer research and treatment 132, 781-791, (2012); Grasso, C. S. et al. Nature 487, 239-243, (2012); Taylor, B. S. et al. Cancer cell 18, 11-22, (2010); Yu, Y. P. et al. Journal of clinical oncology: official journal of the American Society of Clinical Oncology 22, 2790-2799, (2004)). A heatmap of the odds ratios of the gene signature associations revealed striking agreement between SSEA and the other studies for both cancer types, with SSEA often demonstrating equal or better concordance to each microarray study than comparison of the microarray studies to each other (FIG. 3b). Thus, isoform-level differential expression testing from the MiTranscritpome ab initio assembly of RNA-Seq data recapitulated the results from cancer microarray gene expression studies, supporting the SSEA method as a viable tool for detection of differential expression. To further credential the enrichment testing approach, the ability to detect positive control lncRNAs and protein-coding genes in breast cancers and prostate cancers was assesed. For example, SSEA correctly identified the oncogenic lncRNA HOTAIR7, estrogen receptor 1 (ESR1), and GATA binding protein 3 (GATA3) as highly positively enriched in breast cancers (Rhodes et al., 2007, supra; Cancer Genome Atlas, supra), and accurately nominated the tumor suppressor lncRNA MEG3 (Rhodes et al., 2007, supra; Cancer Genome Atlas, supra) and the metastasis suppressor LIFR (Chen, D. et al. Nature medicine 18, 1511-1517, (2012)) as highly negatively enriched (FIG. 3c-e). Similarly, in the prostate cancer set SSEA detected differential expression of lncRNAs and protein-coding genes consistent with the literature (FIG. 3f). Notably, the known prostate cancer lncRNAs Prostate Cancer Antigen-3 (PCA3) and SChLAP1 were strikingly enriched in a cancer-specific and prostate-specific manner relative to all other sample set analyses (FIG. 3g,h) (Taylor et al., supra; Presner et al., 2013, supra). Overall the ability of the enrichment testing approach to rediscover known cancer genes in an unbiased fashion indicates its utility for the analysis of the cancer association and lineage specificity within the panorama of uncharacterized transcription unveiled by MiTranscriptome.

Characterization of Lineage-Specific and Cancer-Specific lncRNA Transcription

Figure 14:
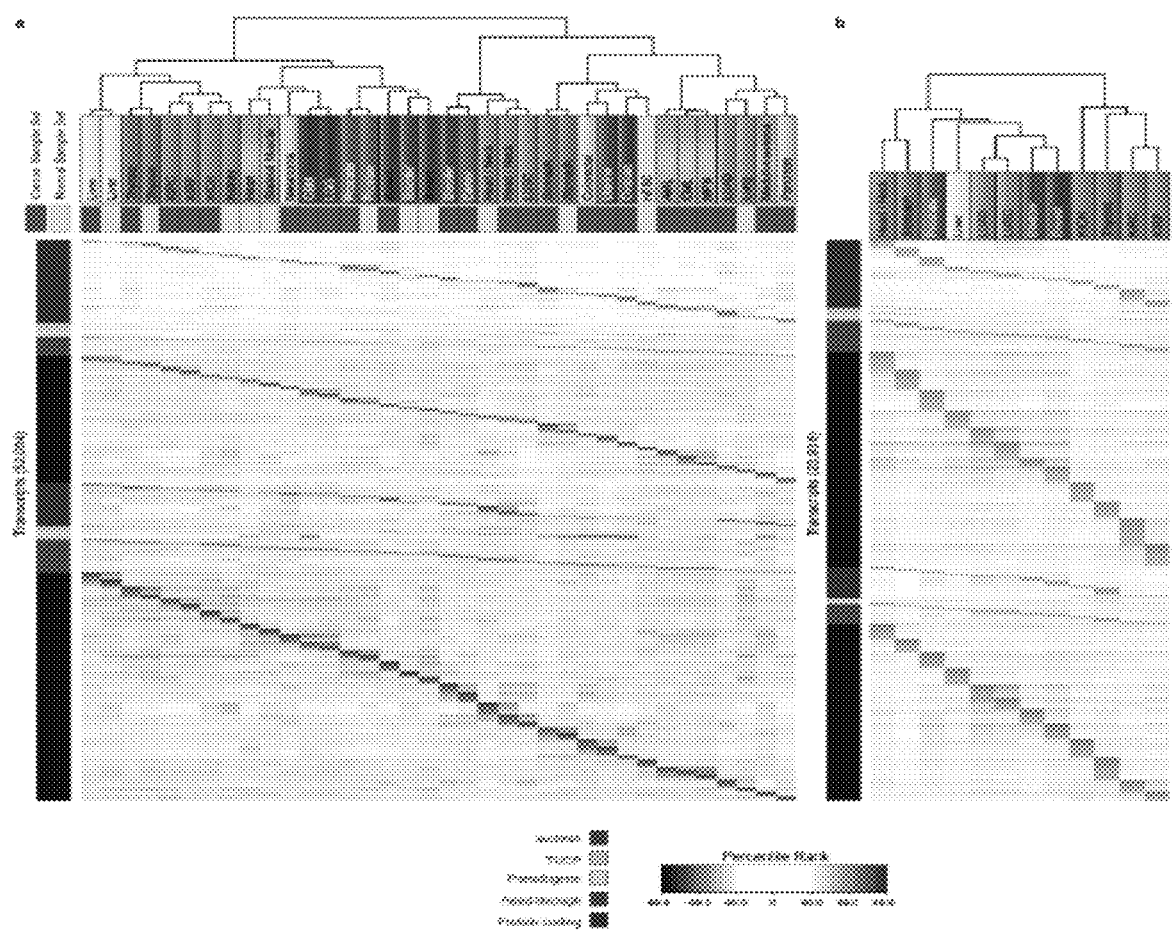
FIG. 14 shows discovery of lineage associated and cancer associated transcripts. a, Heatmap of lineage-specific transcripts (LATs) nominated by SSEA. b, Heatmap of cancer-specific transcripts (CATS) nominated by SSEA.

To extend the study beyond known cancer genes, the enrichment test results for lineage-specific and cancer-specific transcripts were mined in an unbiased manner. Lineage specificity was assayed using sample sets for each cancer or tissue type compared to all other samples in the MiTranscriptome compendium (FIG. 3a, "Cancer Types/Normal Types"), and SSEA results were utilized to determine the degree of enrichment for each transcript in the various cancer and tissue types. Unsupervised clustering of transcript percentile ranks for the top 1% of transcripts in each lineage demonstrated distinct signatures for each lineage while also described relationships among lineages and between cancer and normal sets from the same lineage (FIG. 14a). Examples of closely related lineage clusters include blood cancers (acute myeloid leukemia (AML), chronic myeloid leukemia (CML), and myeloproliferative neoplasia (MPN)), brain cancers (lower grade glioma (LGG) and glioblastome multiforme (GBM)), and muscle tissue (cardiac and skeletal). Additionally, a cluster comprising cervical cancer, head and neck cancer and normal lineages, lung squamous cell cancer, and bladder cancer emerged and indicated that primarily squamous (and transitional) cell carcinomas from distant primary sites share important gene expression relationships. Unsupervised clustering of only the lncRNAs in the top 1% of the SSEA analysis for lineage association recapitulated all of these relationships, indicating the capacity for lncRNAs to independently identify cancer and normal lineages (FIG. 4a).

Next, the dimension of cancer-specific transcriptional dynamics was investigated in twelve tissues with ample numbers of both cancer and normal samples (FIG. 3a, "Cancer vs. Normal"). Similar to above, unsupervised clustering of the top 1% cancer-associated lncRNAs demonstrated highly specific signatures for each cancer type, with the exception of lung cancers and kidney cancers (FIG. 4b and FIG. 14b). Lung squamous cell carcinomas (LUSC) and adenocarcinomas (LUAD) clustered together and shared numerous transcripts with cancer association. Similarly, renal clear cell (KIRC) and papillary cell (KIRP) carcinomas exhibited highly overlapping signatures, while renal chromophobe carcinomas (KICH) remained distinct from KIRC and KIRP.

Figure 2:
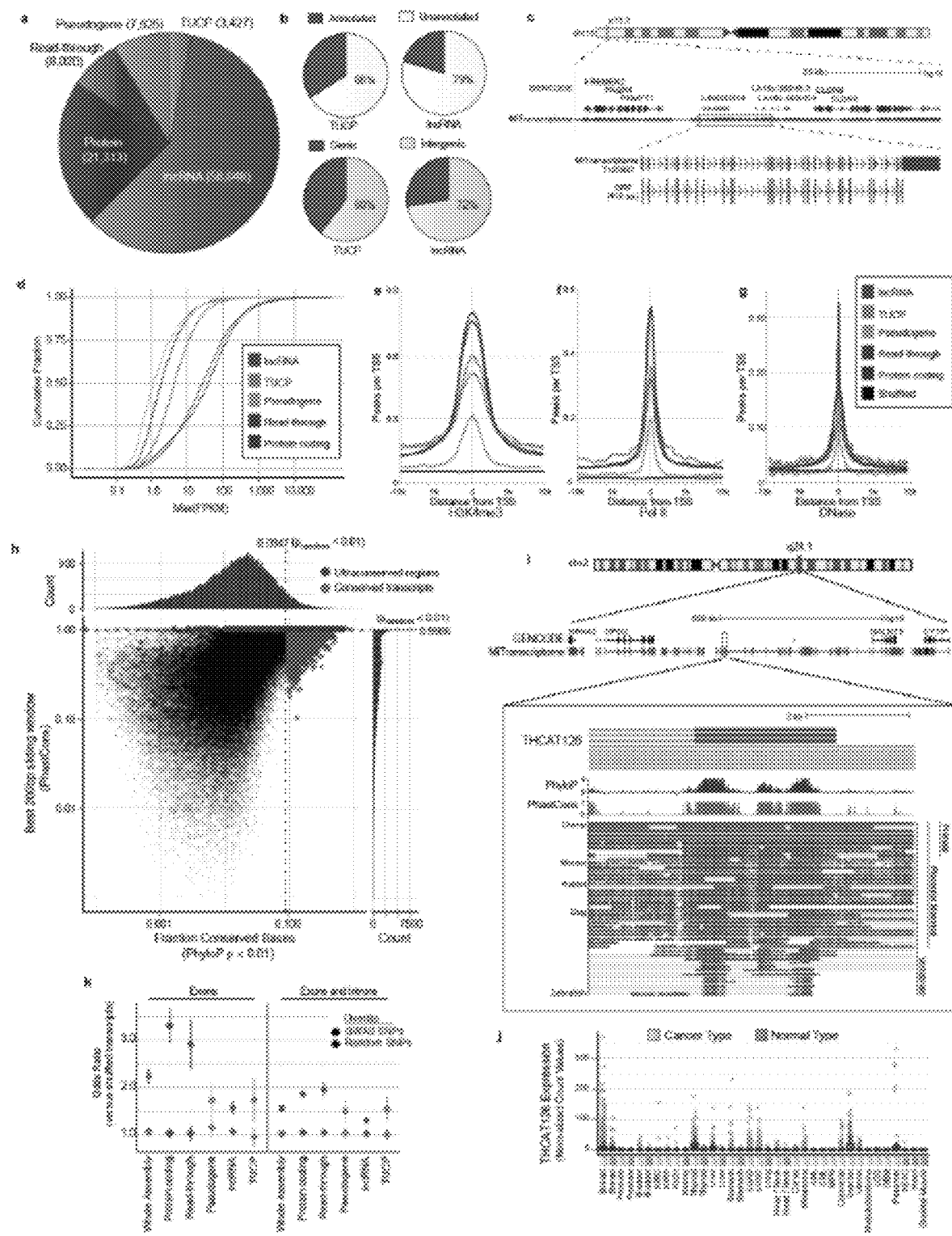
FIG. 2 shows characterization of the MiTranscriptome assembly. (a) Pie chart of composition and quantities of lncRNA, transcripts of unknown coding potential (TUCP), expressed pseudogene, read-through, and protein-coding genes in the MiTranscriptome assembly. (b) Pie charts of number of lncRNAs and TUCP genes (top) unannotated versus annotated relative to reference catalogs and (bottom) intragenic versus intergenic. (c) Genomic view of the chromosome 16p13.3 locus. (d) Empirical cumulative distribution plot comparing the maximum expression (FPKM) of the major isoform of each gene across gene categories. (e, f, and g) Plots of enrichment of 10 kb intervals surrounding expressed transcription start sites (TSSs with RPM>0.1) with aggregated ENCODE data from 13 cell lines for (e) H3K4me3 ChIP-Seq, PolII transcription factor binding sites, and (g) DNase hypersensitivity. (h) Scatter plot with marginal histograms depicting the distribution of full transcript conservation levels (x axis) and maximal 200 bp window conservation levels (y axis) for lncRNA and TUCP transcripts.
Figure 15:
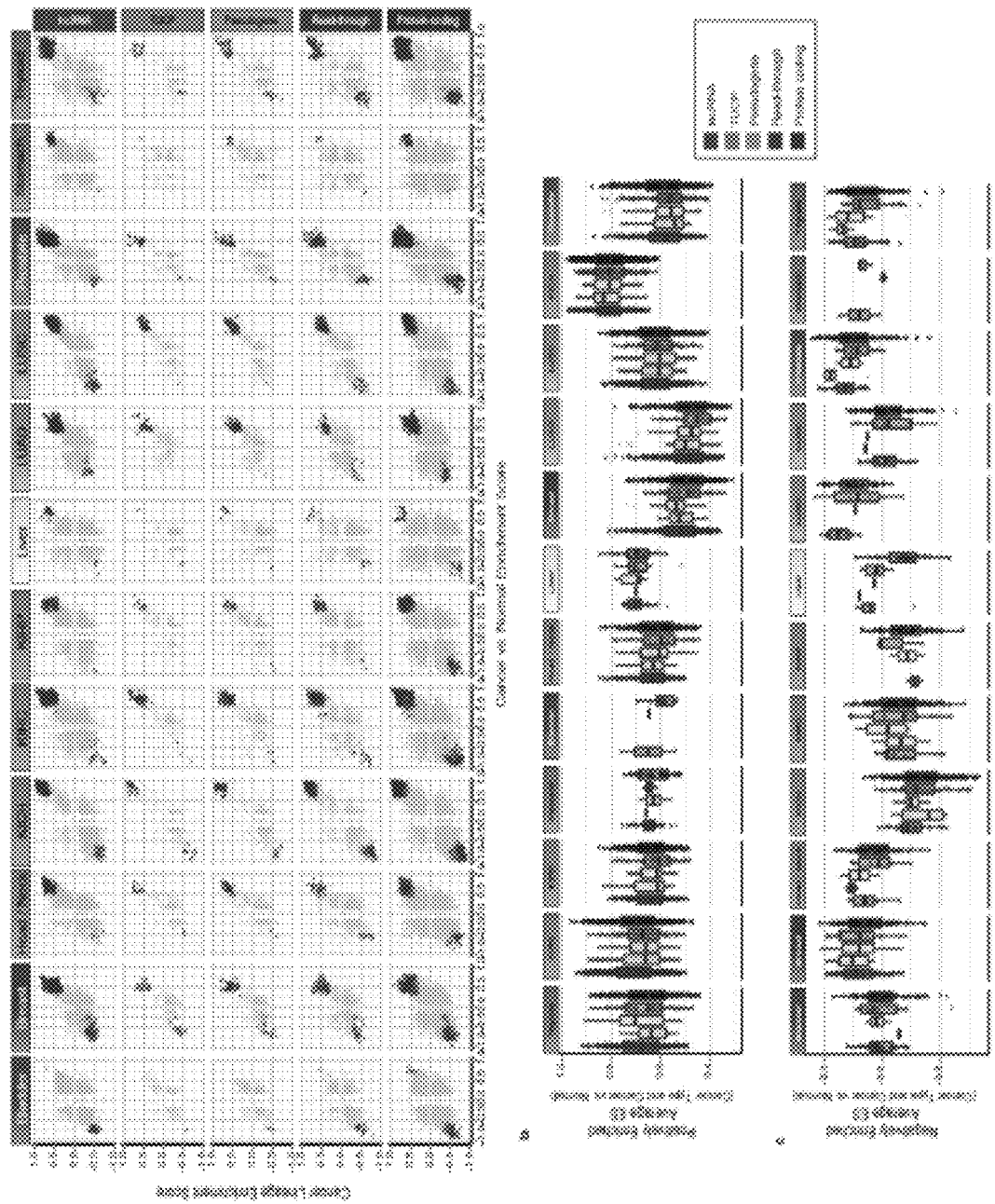
FIG. 15 shows lineage-specific and cancer-specific transcripts. a, Scatter plot grid showing lineage-specific and cancer-specific transcripts (CLATs) nominated by SSEA. b and c, Boxplots comparing the performance of (b) positively enriched CLATs and c) negatively enriched CLATs for each transcript category across 12 cancer types.

Finally, results from lineage and cancer analyses were intersected. Such transcripts have translational potential for use in non-invasive clinical tests, particularly for cancers that lack reliable biomarkers. Notable examples included the prostatespecific lncRNAs PCA3 and SChLAP1 presented earlier (FIG. 3g,h). A myriad of lncRNAs were detected as being lineage and cancer associated (i.e. in the top 5% of both analyses) for each of the cancer types analyzed (FIG. 4c, FIG. 15a). A direct comparison of lncRNAs and protein-coding transcripts revealed that both annotated and unannotated lncRNAs have the perform at a comparable level to protein-coding genes in lineage and cancer association and support a role for lncRNAs as cancer specificity markers (FIG. 4d and FIG. 15b,c). After applying stringent statistical cutoffs to nominate the most compelling associations, a cohort of 7,942 lncRNA or TUCP genes (11,478 transcripts) were nominated as cancer associated, lineage associated, or both. Many of these lncRNAs also possessed base-wise conservation or ultraconserved elements (FIG. 2, Table 1). Transcripts meeting the stringent cutoffs in the cancer versus normal analyses ("Cancer vs. Normal", FIG. 3a) were designated as having "cancer association". Those transcripts meeting stringent cutoffs for linage specificity in non-cancerous tissue (e.g. heart, skeletal muscle, embryonic stem cells) and in cancers lacking RNA-Seq data for benign tissue were designated as "lineage associated". Moreover, transcripts meeting the cutoffs for both the cancer versus normal and lineage specificity analyses were designated as having "cancer and lineage association" (Table 1). Transcripts with significant association in just one tissue type were given names according to that tissue type (Table 1), and transcripts with associations in multiple tissues were named "Cancer Associated Transcripts" (CATs). An additional 545 lncRNA genes (1634 transcripts) that possessed ultraconserved elements but did not meet the stringent lineage and cancer association cutoffs were designated as HICLINCs (Highly Conserved Long Intergenic Non-Coding RNA). Taken together, the cancer and/or lineage lncRNAs and HICLINCs comprise a set of 8,487 lncRNAs that bear strong functional potential. 7,804 of these lncRNAs did not possess an official gene name according to the HUGO Gene Nomenclature Committee, and were thus given names according to the convention described above and in Table 1.

Additional analyses were performed to provide more information about these transcripts for use in selecting candidates for subsequent experimentation. A comprehensive assessment of transcription factor binding to the promoters of these lncRNAs was performed using the ENCODE dataset for 161 transcription factors. Additionally, statistics describing the expression of each lncRNA in the different tissue cohorts is reported. For each TUCP transcript, the longest ORF, coding potential score, and presence of any pfam domain were identified.

Further interrogation of the relationship with GWAS SNPs was also performed, and all transcripts within 50 kb of a GWAS SNP implicated in disease of the same cancer or tissue as the transcript awere identified. These lncRNAs provide candidates for intergenic expression quantitative trait loci (eQTLs) analysis. For example, the lncRNA named Breast Cancer Associated Transcript-85, BRCAT49 is a breast cancer- and lineageassociated lncRNA (FIG. 4d) located ~45 kb downstream of a breast cancer SNP (rs13387042) that has been implicated by six independent GWAS studies (FIG. 4f) (Li, J. et al. Breast cancer research and treatment 126, 717-727, (2011); Michailidou, K. et al. Nature genetics 45, 353-361, 361e351-352, (2013); Stacey, S. N. et al. Nature genetics 39, 865-869, (2007); Thomas, G. et al. Nature genetics 41, 579-584, doi:10.1038/ng.353 (2009); Turnbull, C. et al. Nature genetics 42, 504-507, (2010)). The NHGRI GWAS catalog describes rs13387042 as an intergenic SNP with no reported associated gene (Welter, D. et al. Nucleic acids research 42, D1001-1006, (2014)). Given its breast cancer specificity (FIG. 4g), BRCAT49 provides a target for explaining the breast cancer association of this genomic region. Moreover, with further investigation and analysis, its cancer and lineage specificity support a role for BRCAT49 (and other similar cancer and lineage-specific lncRNAs) as a cancer specific transcriptional marker. Additional representative expression profiles for cancer- or lineage-specific lncRNAs in other tissue types are displayed in FIG. 16c,d.

Figure 16:
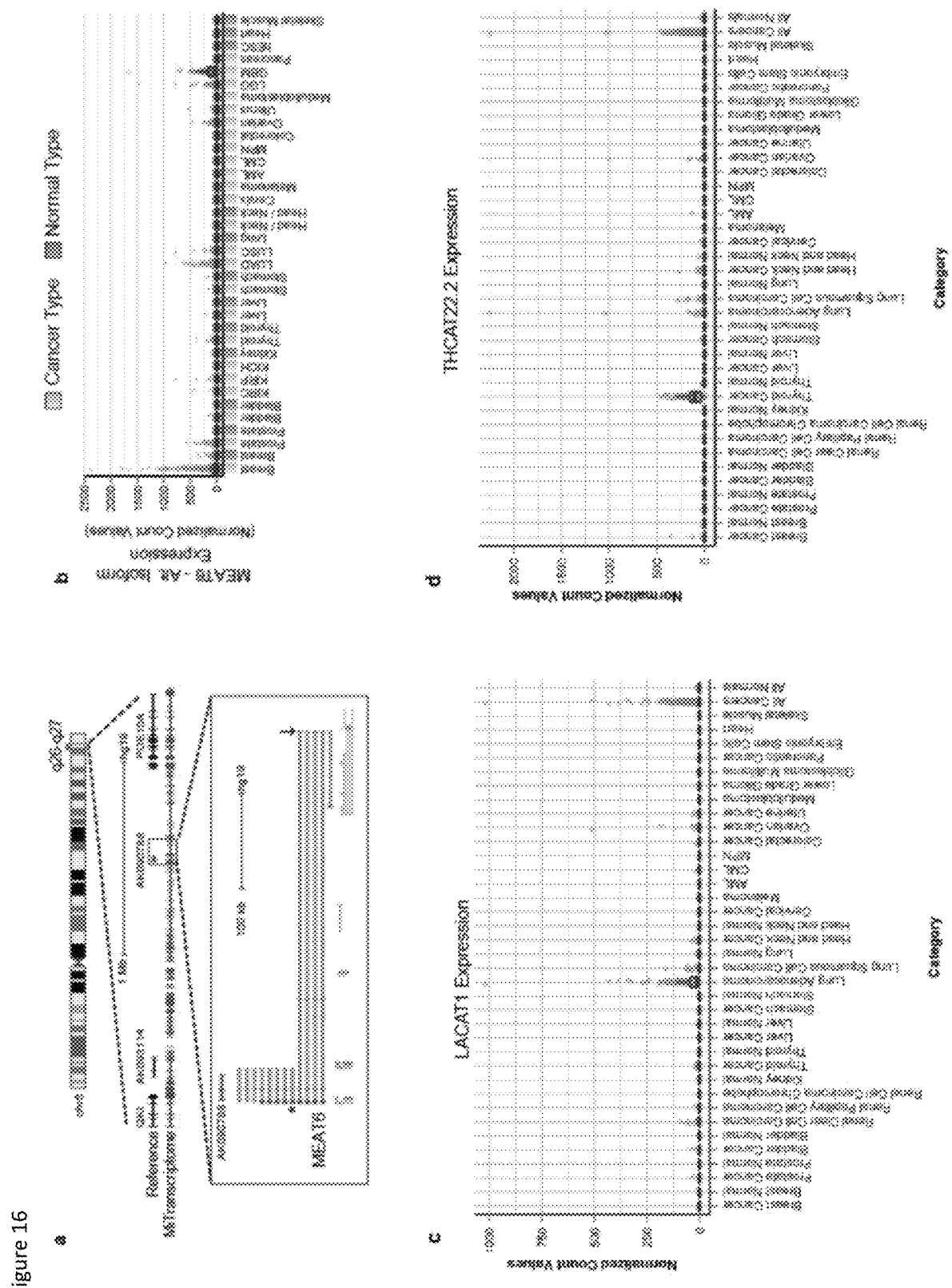
FIG. 16 shows examples of cancer and/or lineage associated transcripts). a, Genomic view of chromosome 6q26-q27locus. b, Expression data for MEAT6 (demarcated by asterisk in a). Expression profile for cancer and lineage assodated transcripts across all MiTraoscriptome tissue cohorts are shown for c, lung adenocarcinoma, and d, thyroid cancer

Because the MiTranscriptome represents such a comprehensive array of tissues and cancers (FIG. 1a), it is able to uncover an abundance of lineage and cancer specific transcription that has biological and clinical impact. A representative example of one such lineage specific lncRNA is a transcript was termed Melanoma Associated Transcript-7, MEAT6, which was found to be in the 99.8th percentile in the melanoma lineage SSEA analysis (FIG. 4a). Genomic investigation delineated MEAT6 as a partially annotated transcriptional variant of the UCSC lncRNA AK090788 lncRNA on chromosome 6q26 (FIG. 16a). However, MEAT6 utilizes an alternative start site and upstream exons absent from reference catalogs, highlighting the breadth and depth of transcriptome reconstruction effort. Expression of MEAT6 isoforms using the novel start site were highly specific to the melanoma samples in the MiTranscriptome cohort (FIG. 4e); however, isoforms lacking the MEAT6 start site had a dramatically different pan-cancer expression profile with almost no expression in melanoma (FIG. 16b). These findings manifest the ability of the assembly to provide a clear and consummate portrayal of the transcriptional activity that distinguishes disease types.

To further corroborate the differential expression analysis, a high-throughput "guilt-by association" analysis was performed for all of the lncRNAs meeting the stringent cutoffs. Expression of each transcript isoform was correlated to all annotated protein-coding genes for each relevant tissue cohort, and various cancer signatures were tested for enrichment with the most correlated or anti-correlated genes using the GSEA method. The gene sets were curated and categorized into cancer relevant categories: angiogenesis/hypoxia associated, metastasis associated, proliferation/cell-cycle associated, adhesion associated, DNA damage/repair associate, oncogenic association, and miscellaneous cancer association. In total over 14 thousand transcripts were analyzed with this method, and the significantly associated cancer gene sets are reported (Tables 2 and 3).

TABLE 1

Summary of lineage and/or cancer-specific lncRNAs nominated in this study.

| Tissue/Cancer Type (Naming Convention) | Total Associated Non-Coding Transcripts | # Cancer- & Tissue-Specific | # Conserved | # Containing Ultraconserved Element | # Classified as TUCP |
|---|---|---|---|---|---|
| Acute Myelogenous Leukemia Associated Transcripts (AMATs) | 373 | NA | 29 | 13 | 26 |
| Bladder Cancer Associated Transcripts (BLCATs) | 61 | 0 | 9 | 2 | 5 |
| Breast Cancer Associated Transcripts (BRCATs) | 1115 | 134 | 82 | 27 | 76 |
| Cervical Cancer Associated Transcripts (CVATs) | 162 | NA | 12 | 2 | 13 |
| Chronic Myelogenous Leukemia Associated Transcripts (CMATs) | 157 | NA | 16 | 3 | 11 |
| Colorectal Cancer Associated Transcripts (CRATs) | 163 | NA | 29 | 4 | 17 |
| Glioblastoma Multiforme Associated Transcripts (GBATs) | 161 | NA | 11 | 2 | 22 |
| Head and Neck Cancer Associated Transcripts (HNCATs) | 766 | 5 | 45 | 15 | 68 |
| Heart Tissue Associated Transcripts (HRATs) | 170 | NA | 16 | 1 | 12 |
| Human Embryonic Stem Cells Associated Transcripts (ESATs) | 205 | NA | 10 | 0 | 20 |
| Chromophobe Renal Cell Carcinoma Associated Transcripts (KCHCATs) | 1050 | 52 | 64 | 20 | 92 |
| Renal Clear Cell Carcinoma Associated Transcripts (KCCATs) | 1429 | 215 | 84 | 26 | 123 |
| Renal Papillary Cell Carcinoma Associated Transcripts (KPCATs) | 474 | 0 | 41 | 8 | 38 |
| Low Grade Glioma Associated Transcripts (LGATs) | 265 | NA | 31 | 10 | 23 |
| Liver Cancer Associated Transcripts (LVCATs) | 250 | 0 | 18 | 1 | 20 |
| Lung Adenocarcinoma Associated Transcripts (LACATs) | 953 | 19 | 64 | 19 | 61 |
| Lung Squamous Cell Carcinoma Associated Transcripts (LSCATs) | 1014 | 10 | 70 | 23 | 58 |
| Medulloblastoma Associated Transcripts (MBATs) | 312 | NA | 26 | 3 | 33 |
| Melanoma Associated Transcripts (MEATs) | 339 | NA | 24 | 2 | 34 |
| Myeloproliferative Neoplasia Associated Transcripts (MPATs) | 101 | NA | 12 | 1 | 8 |
| Ovarian Cancer Associated Transcripts (OVATs) | 163 | NA | 37 | 12 | 30 |
| Pancreatic Cancer Associated Transcripts (PNATs) | 247 | NA | 27 | 4 | 22 |
| Prostate Cancer Associated Transcripts (PCATs) | 727 | 38 | 49 | 14 | 62 |
| Skeletal Muscle Tissue Associated Transcripts (SMATs) | 123 | NA | 5 | 1 | 11 |
| Stomach Cancer Associated Transcripts (STCATs) | 95 | 0 | 10 | 1 | 10 |
| Thyroid Cancer Associated Transcripts (THCATs) | 1289 | 80 | 73 | 21 | 111 |
| Uterine Endometrial Carcinoma Associated Transcripts (UTATs) | 183 | NA | 31 | 1 | 16 |

TABLE 2

| func_name_final | tissue | transcript_length | tcat | SEQ ID NO |
|---|---|---|---|---|
| OVAT106.2 | ovarian | 1425 | lncrna | 1 |
| OVAT106.1 | ovarian | 2622 | lncrna | 2 |
| CAT14.1 | prostate | 2156 | lncrna | 3 |
| CAT14.1 | kich | 2156 | lncrna | 4 |
| CAT14.2 | luad | 996 | lncrna | 5 |
| CAT14.2 | kich | 996 | lncrna | 6 |
| CAT15 | uterine | 372 | lncrna | 7 |
| CAT15 | medulloblastoma | 372 | lncrna | 8 |
| THCAT66 | thyroid | 6340 | lncrna | 9 |
| THCAT66 | thyroid | 6340 | lncrna | 10 |
| CMAT37 | cml | 369 | lncrna | 11 |
| UTAT19 | Uterine | 3914 | tucp | 12 |
| SNHG12.1 | Kirc | 1478 | lncrna | 13 |
| SNHG12.1 | Uterine | 1478 | lncrna | 14 |

TABLE 2-continued

| func_name_final | tissue | transcript_length | tcat | SEQ ID NO |
|---|---|---|---|---|
| SNHG12.2 | Kirc | 2738 | lncrna | 15 |
| SNHG12.3 | cervical | 1508 | tucp | 16 |
| SNHG12.3 | Kirc | 1508 | tucp | 17 |
| CAT33 | Gbm | 2241 | lncrna | 18 |
| CAT33 | Breast | 2241 | lncrna | 19 |
| CAT34 | Thyroid | 496 | lncrna | 20 |
| CAT34 | Lusc | 496 | lncrna | 21 |
| CAT34 | prostate | 496 | lncrna | 22 |
| THCAT20 | Thyroid | 2421 | lncrna | 23 |
| CAT36 | head_neck | 2956 | lncrna | 24 |
| CAT36 | stomach | 2956 | lncrna | 25 |
| CAT36 | Breast | 2956 | lncrna | 26 |
| CAT36 | Luad | 2956 | lncrna | 27 |
| CAT36 | Liver | 2956 | lncrna | 28 |
| CAT36 | Thyroid | 2956 | lncrna | 29 |
| CAT44 | Kirc | 3336 | lncrna | 30 |
| CAT44 | Kirp | 3336 | lncrna | 31 |
| CAT57.1 | melanoma | 1816 | lncrna | 32 |
| CAT57.2 | ovarian | 2148 | lncrna | 33 |
| CAT57.2 | melanoma | 2148 | lncrna | 34 |
| CAT62.1 | Luad | 580 | lncrna | 35 |
| CAT62.1 | Lusc | 580 | lncrna | 36 |
| MBAT23 | medulloblastoma | 1714 | lncrna | 37 |
| LAMTOR5-AS1.2 | colorectal | 853 | lncrna | 38 |
| LAMTOR5-AS1.2 | Kirp | 853 | lncrna | 39 |
| LAMTOR5-AS1.2 | Kich | 853 | lncrna | 40 |
| ESAT85.1 | embryonic_stem_cells | 1082 | lncrna | 41 |
| ESAT85.2 | embryonic_stem_cells | 1336 | lncrna | 42 |
| ESAT40 | embryonic_stem_cells | 787 | tucp | 43 |
| THCAT22.1 | Thyroid | 2848 | lncrna | 44 |
| THCAT22.1 | Thyroid | 2848 | lncrna | 45 |
| THCAT22.4 | Thyroid | 2315 | lncrna | 46 |
| THCAT22.4 | Thyroid | 2315 | lncrna | 47 |
| THCAT22.3 | Thyroid | 3056 | lncrna | 48 |
| THCAT22.3 | Thyroid | 3056 | lncrna | 49 |
| CAT99.1 | colorectal | 3188 | lncrna | 50 |
| CAT99.1 | medulloblastoma | 3188 | lncrna | 51 |
| CAT99.2 | Gbm | 3526 | lncrna | 52 |
| CAT99.2 | Luad | 3526 | lncrna | 53 |
| CAT99.2 | Lusc | 3526 | lncrna | 54 |
| OVAT12 | ovarian | 653 | lncrna | 55 |
| BRCAT23 | Breast | 2635 | lncrna | 56 |
| CAT112.1 | Luad | 5210 | lncrna | 57 |
| CAT112.2 | cervical | 6470 | lncrna | 58 |
| CAT112.2 | Luad | 6470 | lncrna | 59 |
| CAT112.2 | skeletal_muscle | 6470 | lncrna | 60 |
| CAT115.1 | head_neck | 1032 | lncrna | 61 |
| CAT115.1 | Lusc | 1032 | lncrna | 62 |
| CAT115.2 | prostate | 1599 | lncrna | 63 |
| CAT118.1 | Lgg | 1658 | tucp | 64 |
| RUSC1-AS1.1 | Uterine | 1852 | tucp | 65 |
| RUSC1-AS1.1 | Aml | 1852 | tucp | 66 |
| RUSC1-AS1.2 | colorectal | 7499 | tucp | 67 |
| CAT122 | head_neck | 9412 | lncrna | 68 |
| CAT122 | Kirp | 9412 | lncrna | 69 |
| CAT122 | Liver | 9412 | lncrna | 70 |
| CAT122 | Luad | 9412 | lncrna | 71 |
| CAT122 | Kirc | 9412 | lncrna | 72 |
| PNAT1.2 | pancreatic | 902 | lncrna | 73 |
| CAT147.1 | medulloblastoma | 1533 | lncrna | 74 |
| MIR205HG.1 | Lusc | 4404 | lncrna | 75 |
| MIR205HG.1 | prostate | 4404 | lncrna | 76 |
| MIR205HG.2 | Lusc | 2753 | tucp | 77 |
| MIR205HG.2 | prostate | 2753 | tucp | 78 |
| MIR205HG.3 | Lusc | 2336 | lncrna | 79 |
| MIR205HG.3 | prostate | 2336 | lncrna | 80 |
| CAT171.1 | Breast | 741 | lncrna | 81 |
| CAT171.1 | Luad | 741 | lncrna | 82 |
| CAT179 | Thyroid | 475 | lncrna | 83 |
| CAT179 | Lusc | 475 | lncrna | 84 |
| CAT179 | Kirp | 475 | lncrna | 85 |
| CAT179 | Breast | 475 | lncrna | 86 |
| CAT179 | Luad | 475 | lncrna | 87 |
| CAT179 | prostate | 475 | lncrna | 88 |
| CAT179 | Kich | 475 | lncrna | 89 |
| CAT186.1 | Luad | 3863 | lncrna | 90 |
| CAT186.2 | prostate | 1661 | lncrna | 91 |
| CAT186.2 | Breast | 1661 | lncrna | 92 |

TABLE 2-continued

| func__name__final | tissue | transcript_length | tcat | SEQ ID NO |
|---|---|---|---|---|
| CAT186.2 | Luad | 1661 | lncrna | 93 |
| CAT186.2 | Lusc | 1661 | lncrna | 94 |
| CAT186.2 | Lgg | 1661 | lncrna | 95 |
| CAT187.1 | Heart | 4840 | lncrna | 96 |
| CAT187.2 | Aml | 9637 | lncrna | 97 |
| CAT187.2 | Kirc | 9637 | lncrna | 98 |
| ESAT33.2 | embryonic_stem_cells | 13412 | lncrna | 99 |
| ESAT33.1 | embryonic_stem_cells | 2024 | lncrna | 100 |
| CAT1224.1 | head_neck | 2502 | lncrna | 101 |
| CALML3-AS1.1 | prostate | 11669 | lncrna | 102 |
| CALML3-AS1.1 | Breast | 11669 | lncrna | 103 |
| CALML3-AS1.2 | Lusc | 8709 | tucp | 104 |
| GATA3-AS1.1 | Kirc | 7280 | lncrna | 105 |
| GATA3-AS1.2 | Breast | 9735 | lncrna | 106 |
| BRCAT1.1 | Breast | 6529 | lncrna | 107 |
| BRCAT1.1 | Breast | 6529 | lncrna | 108 |
| BRCAT1.4 | Breast | 26917 | lncrna | 109 |
| BRCAT1.4 | Breast | 26917 | lncrna | 110 |
| BRCAT1.3 | Breast | 1676 | lncrna | 111 |
| BRCAT1.3 | Breast | 1676 | lncrna | 112 |
| BRCAT1.5 | Breast | 8975 | lncrna | 113 |
| BRCAT1.5 | Breast | 8975 | lncrna | 114 |
| BRCAT1.2 | Breast | 32732 | lncrna | 115 |
| BRCAT1.2 | Breast | 32732 | lncrna | 116 |
| CAT1233 | Thyroid | 1709 | lncrna | 117 |
| CAT1233 | pancreatic | 1709 | lncrna | 118 |
| CAT1235.1 | melanoma | 3656 | lncrna | 119 |
| CAT1235.1 | Kirc | 3656 | lncrna | 120 |
| CAT1235.1 | Kirp | 3656 | lncrna | 121 |
| CAT1235.1 | ovarian | 3656 | lncrna | 122 |
| CAT1235.1 | prostate | 3656 | lncrna | 123 |
| CAT1235.1 | Breast | 3656 | lncrna | 124 |
| CAT1235.1 | Lusc | 3656 | lncrna | 125 |
| CAT1235.2 | Uterine | 4480 | lncrna | 126 |
| CAT1235.2 | Kirc | 4480 | lncrna | 127 |
| CAT1235.2 | cervical | 4480 | lncrna | 128 |
| CAT1235.2 | Breast | 4480 | lncrna | 129 |
| CAT1235.2 | Luad | 4480 | lncrna | 130 |
| CAT1235.2 | Lusc | 4480 | lncrna | 131 |
| ST8SIA6-AS1.1 | prostate | 1250 | lncrna | 132 |
| ST8SIA6-AS1.1 | Liver | 1250 | lncrna | 133 |
| ST8SIA6-AS1.2 | prostate | 10110 | lncrna | 134 |
| ST8SIA6-AS1.2 | Liver | 10110 | lncrna | 135 |
| LINC00948.1 | pancreatic | 1205 | lncrna | 136 |
| LINC00948.1 | Kirp | 1205 | lncrna | 137 |
| CAT1269 | Mpn | 9975 | lncrna | 138 |
| CAT1269 | Cml | 9975 | lncrna | 139 |
| CAT1269 | medulloblastoma | 9975 | lncrna | 140 |
| UNC5B-AS1.1 | ovarian | 1602 | lncrna | 141 |
| UNC5B-AS1.1 | Thyroid | 1602 | lncrna | 142 |
| UNC5B-AS1.2 | Thyroid | 915 | lncrna | 143 |
| UNC5B-AS1.2 | prostate | 915 | lncrna | 144 |
| KCCAT243 | Kirc | 1647 | lncrna | 145 |
| KCCAT243 | Kirc | 1647 | lncrna | 146 |
| OVAT44 | ovarian | 1283 | lncrna | 147 |
| CAT1284.1 | Kirc | 17882 | lncrna | 148 |
| CAT1284.1 | Kirp | 17882 | lncrna | 149 |
| CAT1284.1 | Lusc | 17882 | lncrna | 150 |
| CAT1284.1 | pancreatic | 17882 | lncrna | 151 |
| CAT1284.1 | prostate | 17882 | lncrna | 152 |
| CAT1284.1 | Kich | 17882 | lncrna | 153 |
| MEAT20.3 | melanoma | 1252 | lncrna | 154 |
| MEAT20.1 | melanoma | 1222 | lncrna | 155 |
| MEAT20.2 | melanoma | 1028 | lncrna | 156 |
| CAT1324 | colorectal | 1329 | tucp | 157 |
| CAT1324 | Uterine | 1329 | tucp | 158 |
| CAT1324 | head_neck | 1329 | tucp | 159 |
| CMAT6 | Cml | 540 | lncrna | 160 |
| CAT1337.1 | Lusc | 41069 | lncrna | 161 |
| CAT1337.1 | pancreatic | 41069 | lncrna | 162 |
| CAT1337.1 | prostate | 41069 | lncrna | 163 |
| LINC00958.1 | Lusc | 42272 | lncrna | 164 |
| LINC00958.1 | prostate | 42272 | lncrna | 165 |
| LINC00958.2 | Lusc | 38359 | lncrna | 166 |
| CAT1337.2 | head_neck | 2101 | lncrna | 167 |
| CAT1337.2 | Lusc | 2101 | lncrna | 168 |
| CAT1337.2 | pancreatic | 2101 | lncrna | 169 |
| CAT1337.2 | medulloblastoma | 2101 | lncrna | 170 |

TABLE 2-continued

| func_name_final | tissue | transcript_length | tcat | SEQ ID NO |
|---|---|---|---|---|
| CAT1337.2 | prostate | 2101 | lncrna | 171 |
| LINC00958.3 | Lusc | 30635 | lncrna | 172 |
| LINC00958.3 | pancreatic | 30635 | lncrna | 173 |
| LINC00958.4 | Lusc | 14161 | lncrna | 174 |
| LINC00958.4 | pancreatic | 14161 | lncrna | 175 |
| LINC00958.5 | Luad | 8665 | lncrna | 176 |
| CAT1345.1 | Luad | 1080 | lncrna | 177 |
| CAT1345.1 | Lusc | 1080 | lncrna | 178 |
| LINC00678.1 | embryonic_stem_cells | 471 | lncrna | 179 |
| WT1-AS.1 | ovarian | 4079 | lncrna | 180 |
| WT1-AS.2 | ovarian | 3132 | lncrna | 181 |
| WT1-AS.3 | ovarian | 3618 | lncrna | 182 |
| WT1-AS.3 | Kich | 3618 | lncrna | 183 |
| CAT1363.1 | Uterine | 2421 | lncrna | 184 |
| CAT1363.2 | Uterine | 2263 | lncrna | 185 |
| CAT1363.2 | Kich | 2263 | lncrna | 186 |
| CAT1363.2 | Lusc | 2263 | lncrna | 187 |
| UTAT10 | Uterine | 1287 | tucp | 188 |
| NEAT1 | Kich | 26332 | lncrna | 189 |
| MALAT1.2 | Heart | 7744 | lncrna | 190 |
| MALAT1.2 | Kich | 7744 | lncrna | 191 |
| CAT1373 | Breast | 3975 | lncrna | 192 |
| CAT1373 | Luad | 3975 | lncrna | 193 |
| CAT1373 | Lusc | 3975 | lncrna | 194 |
| CAT1373 | skeletal_muscle | 3975 | lncrna | 195 |
| CAT1373 | Gbm | 3975 | lncrna | 196 |
| CAT1373 | Lgg | 3975 | lncrna | 197 |
| CAT1373 | medulloblastoma | 3975 | lncrna | 198 |
| CAT1373 | Kirc | 3975 | lncrna | 199 |
| CAT1376 | Uterine | 8904 | tucp | 200 |
| CAT1376 | Kich | 8904 | tucp | 201 |
| CAT1376 | medulloblastoma | 8904 | tucp | 202 |
| OVAT47 | ovarian | 833 | lncrna | 203 |
| ANO1-AS1 | head_neck | 10628 | tucp | 204 |
| ANO1-AS1 | Kirc | 10628 | tucp | 205 |
| ANO1-AS1 | Cml | 10628 | tucp | 206 |
| ANO1-AS1 | Gbm | 10628 | tucp | 207 |
| ANO1-AS1 | Lgg | 10628 | tucp | 208 |
| ANO1-AS1 | medulloblastoma | 10628 | tucp | 209 |
| ANO1-AS1 | prostate | 10628 | tucp | 210 |
| CAT1385.1 | Thyroid | 8545 | lncrna | 211 |
| CAT1385.1 | head_neck | 8545 | lncrna | 212 |
| CAT1385.2 | Thyroid | 3095 | lncrna | 213 |
| CAT1385.2 | head_neck | 3095 | lncrna | 214 |
| CAT1385.2 | Breast | 3095 | lncrna | 215 |
| CAT1385.2 | Luad | 3095 | lncrna | 216 |
| CAT1385.2 | Aml | 3095 | lncrna | 217 |
| CAT1385.3 | medulloblastoma | 4221 | lncrna | 218 |
| CAT1391 | Cml | 7090 | lncrna | 219 |
| CAT1391 | Aml | 7090 | lncrna | 220 |
| CAT1391 | Kirc | 7090 | lncrna | 221 |
| CAT1399 | Thyroid | 6255 | lncrna | 222 |
| CAT1399 | stomach | 6255 | lncrna | 223 |
| CAT1399 | head_neck | 6255 | lncrna | 224 |
| CAT1399 | Kirp | 6255 | lncrna | 225 |
| CAT1399 | Luad | 6255 | lncrna | 226 |
| CAT1399 | Kirc | 6255 | lncrna | 227 |
| CAT1399 | Mpn | 6255 | lncrna | 228 |
| CAT1399 | Aml | 6255 | lncrna | 229 |
| CAT1399 | Lgg | 6255 | lncrna | 230 |
| CAT1425.1 | Kirc | 1151 | lncrna | 231 |
| CAT1425.1 | Lusc | 1151 | lncrna | 232 |
| CAT1425.1 | Breast | 1151 | lncrna | 233 |
| CAT1425.1 | Liver | 1151 | lncrna | 234 |
| CAT1425.2 | Kirc | 5627 | lncrna | 235 |
| CAT1425.2 | Breast | 5627 | lncrna | 236 |
| CAT1425.2 | Liver | 5627 | lncrna | 237 |
| CAT1434 | ovarian | 637 | lncrna | 238 |
| CAT1434 | Uterine | 637 | lncrna | 239 |
| CAT1434 | Kich | 637 | lncrna | 240 |
| ESAT80 | embryonic_stem_cells | 4806 | lncrna | 241 |
| CAT1452.1 | Kich | 3332 | tucp | 242 |
| CAT1452.1 | prostate | 3332 | tucp | 243 |
| CAT1452.1 | Luad | 3332 | tucp | 244 |
| CAT1452.1 | Lusc | 3332 | tucp | 245 |
| CAT1464 | Kich | 7157 | lncrna | 246 |
| CAT1464 | Gbm | 7157 | lncrna | 247 |
| CAT1464 | melanoma | 7157 | lncrna | 248 |

TABLE 2-continued

| func_name_final | tissue | transcript_length | tcat | SEQ ID NO |
|---|---|---|---|---|
| CAT1464 | Lgg | 7157 | lncrna | 249 |
| ESAT3 | embryonic_stem_cells | 2056 | lncrna | 250 |
| MEAT11 | melanoma | 1006 | lncrna | 251 |
| CAT1468 | Kirc | 2243 | lncrna | 252 |
| CAT1468 | medulloblastoma | 2243 | lncrna | 253 |
| CAT1469 | head_neck | 2125 | lncrna | 254 |
| CAT1469 | Lusc | 2125 | lncrna | 255 |
| CAT1472.1 | Lusc | 1709 | lncrna | 256 |
| DDX11-AS1.1 | Kirp | 2011 | lncrna | 257 |
| DDX11-AS1.1 | Liver | 2011 | lncrna | 258 |
| DDX11-AS1.1 | Lusc | 2011 | lncrna | 259 |
| CAT1501.1 | Kich | 3920 | lncrna | 260 |
| CAT1501.1 | Thyroid | 3920 | lncrna | 261 |
| CAT1501.2 | ovarian | 4652 | lncrna | 262 |
| CAT1528 | Heart | 2528 | lncrna | 263 |
| CAT1528 | Kich | 2528 | lncrna | 264 |
| CAT1528 | Thyroid | 2528 | lncrna | 265 |
| MEAT10 | melanoma | 1589 | lncrna | 266 |
| CRAT16 | colorectal | 1650 | lncrna | 267 |
| HNCAT4 | head_neck | 764 | lncrna | 268 |
| CAT1547 | Mpn | 3302 | lncrna | 269 |
| CAT1547 | Cml | 3302 | lncrna | 270 |
| CAT1547 | Kirc | 3302 | lncrna | 271 |
| CAT1547 | embryonic_stem_cells | 3302 | lncrna | 272 |
| CAT1547 | skeletal_muscle | 3302 | lncrna | 273 |
| CAT1564 | Aml | 4645 | tucp | 274 |
| CAT1564 | Kirc | 4645 | tucp | 275 |
| ESAT56.3 | embryonic_stem_cells | 8304 | lncrna | 276 |
| ESAT56.2 | embryonic_stem_cells | 7622 | lncrna | 277 |
| ESAT56.1 | embryonic_stem_cells | 7755 | lncrna | 278 |
| LINC00428 | embryonic_stem_cells | 7715 | lncrna | 279 |
| LINC00458.2 | embryonic_stem_cells | 2657 | lncrna | 280 |
| LINC00458.1 | embryonic_stem_cells | 1021 | lncrna | 281 |
| ESAT23 | embryonic_stem_cells | 1747 | lncrna | 282 |
| LINC00458.3 | embryonic_stem_cells | 2948 | lncrna | 283 |
| ESAT13.3 | embryonic_stem_cells | 1855 | lncrna | 284 |
| ESAT13.1 | embryonic_stem_cells | 878 | lncrna | 285 |
| ESAT34 | embryonic_stem_cells | 923 | lncrna | 286 |
| ESAT36.1 | embryonic_stem_cells | 10586 | lncrna | 287 |
| ESAT36.4 | embryonic_stem_cells | 11133 | lncrna | 288 |
| ESAT36.2 | embryonic_stem_cells | 11103 | lncrna | 289 |
| ESAT36.3 | embryonic_stem_cells | 13928 | lncrna | 290 |
| MEAT69 | melanoma | 2031 | lncrna | 291 |
| DOCK9-AS2 | thyroid | 2091 | lncrna | 292 |
| DOCK9-AS2 | thyroid | 2091 | lncrna | 293 |
| CAT1629.1 | medulloblastoma | 5852 | lncrna | 294 |
| CAT1629.2 | luad | 3834 | lncrna | 295 |
| CAT1629.2 | lusc | 3834 | lncrna | 296 |
| CAT1629.2 | pancreatic | 3834 | lncrna | 297 |
| CAT1629.2 | kirc | 3834 | lncrna | 298 |
| CAT1631 | kirc | 1210 | lncrna | 299 |
| CAT1631 | medulloblastoma | 1210 | lncrna | 300 |
| GBAT25.1 | gbm | 3520 | lncrna | 301 |
| SMAT25 | skeletal_muscle | 6343 | tucp | 302 |
| CAT1636.1 | head_neck | 1465 | lncrna | 303 |
| CAT1636.1 | uterine | 1465 | lncrna | 304 |
| CAT1641 | colorectal | 3474 | lncrna | 305 |
| CAT1641 | stomach | 3474 | lncrna | 306 |
| CAT1641 | kich | 3474 | lncrna | 307 |
| CAT1641 | liver | 3474 | lncrna | 308 |
| UTAT29 | uterine | 322 | lncrna | 309 |
| OVAT48 | ovarian | 650 | lncrna | 310 |
| ESAT39.3 | embryonic_stem_cells | 8927 | lncrna | 311 |
| CAT1658 | head_neck | 835 | lncrna | 312 |
| CAT1658 | lusc | 835 | lncrna | 313 |
| CAT1659.1 | breast | 1250 | lncrna | 314 |
| CAT1659.2 | embryonic_stem_cells | 15089 | lncrna | 315 |
| CAT1659.2 | breast | 15089 | lncrna | 316 |
| CAT1659.3 | embryonic_stem_cells | 1255 | lncrna | 317 |
| CAT1659.4 | embryonic_stem_cells | 13866 | lncrna | 318 |
| CAT1683.1 | kich | 1006 | lncrna | 319 |
| CAT1683.1 | embryonic_stem_cells | 1006 | lncrna | 320 |
| OVAT5 | ovarian | 288 | lncrna | 321 |
| CAT1723 | aml | 2435 | tucp | 322 |
| CAT1723 | head_neck | 2435 | tucp | 323 |
| CAT1723 | luad | 2435 | tucp | 324 |
| CAT1723 | lusc | 2435 | tucp | 325 |
| CAT1723 | gbm | 2435 | tucp | 326 |

TABLE 2-continued

| func_name_final | tissue | transcript_length | tcat | SEQ ID NO |
|---|---|---|---|---|
| CAT1728 | heart | 3209 | tucp | 327 |
| CAT1728 | thyroid | 3209 | tucp | 328 |
| CAT1728 | breast | 3209 | tucp | 329 |
| CAT1728 | luad | 3209 | tucp | 330 |
| CAT1728 | lusc | 3209 | tucp | 331 |
| CAT1735 | breast | 850 | lncrna | 332 |
| CAT1735 | luad | 850 | lncrna | 333 |
| CAT1735 | lusc | 850 | lncrna | 334 |
| CAT1735 | thyroid | 850 | lncrna | 335 |
| CAT1735 | kirp | 850 | lncrna | 336 |
| CAT1736.1 | thyroid | 1229 | lncrna | 337 |
| CAT1736.1 | luad | 1229 | lncrna | 338 |
| CAT1760.1 | melanoma | 6162 | lncrna | 339 |
| CAT1760.1 | lgg | 6162 | lncrna | 340 |
| CAT1760.1 | prostate | 6162 | lncrna | 341 |
| CAT1760.2 | kirc | 7244 | lncrna | 342 |
| CAT1760.2 | melanoma | 7244 | lncrna | 343 |
| USP3-AS1.3 | colorectal | 477 | lncrna | 344 |
| USP3-AS1.3 | uterine | 477 | lncrna | 345 |
| USP3-AS1.3 | melanoma | 477 | lncrna | 346 |
| CAT1768.1 | prostate | 6771 | lncrna | 347 |
| CAT1768.1 | kirp | 6771 | lncrna | 348 |
| CAT1773 | melanoma | 834 | lncrna | 349 |
| CAT1773 | thyroid | 834 | lncrna | 350 |
| CAT1773 | kirc | 834 | lncrna | 351 |
| CAT1773 | liver | 834 | lncrna | 352 |
| CAT1773 | cml | 834 | lncrna | 353 |
| CAT1777 | thyroid | 11399 | tucp | 354 |
| CAT1777 | cervical | 11399 | tucp | 355 |
| CAT1777 | luad | 11399 | tucp | 356 |
| CAT1777 | lusc | 11399 | tucp | 357 |
| CAT1784 | lgg | 2795 | lncrna | 358 |
| CAT1784 | head_neck | 2795 | lncrna | 359 |
| CAT1784 | kirp | 2795 | lncrna | 360 |
| CAT1784 | breast | 2795 | lncrna | 361 |
| CAT1784 | kirc | 2795 | lncrna | 362 |
| UTAT4 | uterine | 650 | lncrna | 363 |
| CAT1785 | heart | 852 | lncrna | 364 |
| CAT1785 | embryonic_stem_cells | 852 | lncrna | 365 |
| CAT1796 | thyroid | 3587 | lncrna | 366 |
| CAT1796 | prostate | 3587 | lncrna | 367 |
| CAT1796 | breast | 3587 | lncrna | 368 |
| KCCAT209 | kirc | 3196 | lncrna | 369 |
| KCCAT11.2 | kirc | 2905 | lncrna | 370 |
| KCCAT11.2 | kirc | 2905 | lncrna | 371 |
| KCCAT11.1 | kirc | 1577 | lncrna | 372 |
| KCCAT11.1 | kirc | 1577 | lncrna | 373 |
| AMAT59 | aml | 4948 | lncrna | 374 |
| KCCAT71 | kirc | 1442 | lncrna | 375 |
| CAT1825 | thyroid | 1672 | lncrna | 376 |
| CAT1825 | kich | 1672 | lncrna | 377 |
| CAT1825 | lgg | 1672 | lncrna | 378 |
| CAT1825 | embryonic_stem_cells | 1672 | lncrna | 379 |
| CAT1837.1 | cervical | 605 | lncrna | 380 |
| CAT1837.2 | aml | 1853 | lncrna | 381 |
| CAT1841.1 | kirc | 2864 | lncrna | 382 |
| CAT1841.1 | kirp | 2864 | lncrna | 383 |
| CAT1841.1 | breast | 2864 | lncrna | 384 |
| CAT1841.1 | ovarian | 2864 | lncrna | 385 |
| CAT1841.1 | skeletal_muscle | 2864 | lncrna | 386 |
| CAT1841.1 | uterine | 2864 | lncrna | 387 |
| CAT1843 | kirc | 1519 | lncrna | 388 |
| CAT1843 | liver | 1519 | lncrna | 389 |
| CAT1844 | lgg | 2653 | lncrna | 390 |
| CAT1844 | thyroid | 2653 | lncrna | 391 |
| CRNDE.1 | kirp | 10743 | lncrna | 392 |
| CRNDE.2 | colorectal | 10057 | lncrna | 393 |
| CAT1871.1 | gbm | 5165 | lncrna | 394 |
| CAT1871.1 | lgg | 5165 | lncrna | 395 |
| CAT1871.2 | lgg | 7095 | lncrna | 396 |
| VPS9D1-AS1.1 | prostate | 2428 | lncrna | 397 |
| VPS9D1-AS1.1 | lusc | 2428 | lncrna | 398 |
| VPS9D1-AS1.2 | prostate | 3100 | lncrna | 399 |
| VPS9D1-AS1.2 | luad | 3100 | lncrna | 400 |
| VPS9D1-AS1.2 | lusc | 3100 | lncrna | 401 |
| VPS9D1-AS1.3 | prostate | 2710 | lncrna | 402 |
| VPS9D1-AS1.3 | lusc | 2710 | lncrna | 403 |
| CAT1889 | melanoma | 925 | lncrna | 404 |

TABLE 2-continued

| func_name_final | tissue | transcript_length | tcat | SEQ ID NO |
|---|---|---|---|---|
| CAT1889 | head_neck | 925 | lncrna | 405 |
| CAT1889 | kirp | 925 | lncrna | 406 |
| CAT1889 | breast | 925 | lncrna | 407 |
| CAT1889 | luad | 925 | lncrna | 408 |
| PITPNA-AS1 | gbm | 356 | lncrna | 409 |
| CAT1892.1 | uterine | 2087 | lncrna | 410 |
| CAT1893 | ovarian | 990 | lncrna | 411 |
| CAT1893 | kich | 990 | lncrna | 412 |
| CAT1909.1 | gbm | 2569 | tucp | 413 |
| CAT1909.1 | colorectal | 2569 | tucp | 414 |
| CAT1909.1 | uterine | 2569 | tucp | 415 |
| CAT1909.1 | liver | 2569 | tucp | 416 |
| CAT1909.2 | pancreatic | 3180 | tucp | 417 |
| CAT1909.2 | cervical | 3180 | tucp | 418 |
| CAT1909.2 | kirc | 3180 | tucp | 419 |
| CAT1915 | uterine | 1314 | lncrna | 420 |
| CAT1915 | cml | 1314 | lncrna | 421 |
| CAT1928 | colorectal | 4160 | tucp | 422 |
| CAT1928 | thyroid | 4160 | tucp | 423 |
| CAT1928 | head_neck | 4160 | tucp | 424 |
| CAT1928 | kirp | 4160 | tucp | 425 |
| CAT1940 | gbm | 578 | lncrna | 426 |
| CAT1940 | kirp | 578 | lncrna | 427 |
| CAT1940 | kich | 578 | lncrna | 428 |
| CAT1944 | uterine | 749 | lncrna | 429 |
| CAT1944 | luad | 749 | lncrna | 430 |
| CAT1949 | colorectal | 2817 | lncrna | 431 |
| CAT1949 | uterine | 2817 | lncrna | 432 |
| CAT1949 | mpn | 2817 | lncrna | 433 |
| CAT1949 | kirc | 2817 | lncrna | 434 |
| MPAT8 | mpn | 952 | lncrna | 435 |
| CAT1957.1 | lusc | 1013 | lncrna | 436 |
| CAT1957.1 | head_neck | 1013 | lncrna | 437 |
| CAT1957.1 | breast | 1013 | lncrna | 438 |
| CAT1957.1 | luad | 1013 | lncrna | 439 |
| CAT1957.1 | kirc | 1013 | lncrna | 440 |
| CAT1957.1 | liver | 1013 | lncrna | 441 |
| CAT1964.1 | kirc | 9319 | lncrna | 442 |
| CAT1964.1 | cervical | 9319 | lncrna | 443 |
| CAT1964.1 | medulloblastoma | 9319 | lncrna | 444 |
| CAT1964.1 | breast | 9319 | lncrna | 445 |
| CAT1964.1 | luad | 9319 | lncrna | 446 |
| CAT1964.1 | lusc | 9319 | lncrna | 447 |
| CAT1964.2 | kirc | 3949 | lncrna | 448 |
| CAT1964.2 | embryonic_stem_cells | 3949 | lncrna | 449 |
| CAT1964.2 | ovarian | 3949 | lncrna | 450 |
| CAT1964.2 | medulloblastoma | 3949 | lncrna | 451 |
| CAT1964.2 | breast | 3949 | lncrna | 452 |
| CAT1964.2 | luad | 3949 | lncrna | 453 |
| CAT1964.2 | lusc | 3949 | lncrna | 454 |
| CAT1967.1 | lusc | 2747 | lncrna | 455 |
| CAT1967.1 | mpn | 2747 | lncrna | 456 |
| CAT1967.1 | thyroid | 2747 | lncrna | 457 |
| CAT1967.1 | prostate | 2747 | lncrna | 458 |
| CAT1968.1 | kirc | 17122 | tucp | 459 |
| CAT1968.2 | gbm | 3663 | tucp | 460 |
| CAT1968.2 | lgg | 3663 | tucp | 461 |
| CAT1968.2 | colorectal | 3663 | tucp | 462 |
| CAT1968.2 | prostate | 3663 | tucp | 463 |
| LINC00511.1 | luad | 13352 | tucp | 464 |
| LINC00511.2 | lusc | 7531 | lncrna | 465 |
| LINC00511.3 | thyroid | 5973 | lncrna | 466 |
| LINC00511.3 | luad | 5973 | lncrna | 467 |
| LINC00511.3 | lusc | 5973 | lncrna | 468 |
| CAT1977 | gbm | 1001 | lncrna | 469 |
| CAT1977 | melanoma | 1001 | lncrna | 470 |
| CAT1977 | lgg | 1001 | lncrna | 471 |
| CAT1977 | kirc | 1001 | lncrna | 472 |
| MEAT77 | melanoma | 1767 | lncrna | 473 |
| MEAT75 | melanoma | 4785 | tucp | 474 |
| CAT1984 | uterine | 3024 | lncrna | 475 |
| CAT1984 | thyroid | 3024 | lncrna | 476 |
| CAT1984 | breast | 3024 | lncrna | 477 |
| CAT1984 | liver | 3024 | lncrna | 478 |
| UTAT3 | uterine | 2710 | tucp | 479 |
| MAFG-AS1.1 | lusc | 4227 | tucp | 480 |
| MAFG-AS1.1 | kirp | 4227 | tucp | 481 |
| MAFG-AS1.1 | breast | 4227 | tucp | 482 |

TABLE 2-continued

| func_name_final | tissue | transcript_length | tcat | SEQ ID NO |
|---|---|---|---|---|
| MAFG-AS1.1 | luad | 4227 | tucp | 483 |
| MAFG-AS1.1 | prostate | 4227 | tucp | 484 |
| MAFG-AS1.1 | liver | 4227 | tucp | 485 |
| MAFG-AS1.1 | mpn | 4227 | tucp | 486 |
| MAFG-AS1.2 | breast | 4434 | tucp | 487 |
| MAFG-AS1.2 | luad | 4434 | tucp | 488 |
| MAFG-AS1.2 | lusc | 4434 | tucp | 489 |
| LINC00668.1 | head_neck | 3547 | lncrna | 490 |
| LINC00668.1 | lusc | 3547 | lncrna | 491 |
| LINC00668.2 | lusc | 3153 | lncrna | 492 |
| UTAT6 | uterine | 532 | lncrna | 493 |
| LINC00669 | luad | 439 | lncrna | 494 |
| LINC00669 | lusc | 439 | lncrna | 495 |
| ESAT59 | embryonic_stem_cells | 954 | lncrna | 496 |
| CAT2045.1 | lusc | 4504 | lncrna | 497 |
| CAT2045.2 | colorectal | 825 | lncrna | 498 |
| CAT2045.2 | kich | 825 | lncrna | 499 |
| CAT2045.2 | cml | 825 | lncrna | 500 |
| CAT2045.2 | aml | 825 | lncrna | 501 |
| CAT2045.2 | kirp | 825 | lncrna | 502 |
| CAT2045.2 | luad | 825 | lncrna | 503 |
| MIR7-3HG.7 | pancreatic | 3602 | lncrna | 504 |
| MIR7-3HG.10 | pancreatic | 3029 | lncrna | 505 |
| MIR7-3HG.22 | pancreatic | 3219 | lncrna | 506 |
| MIR7-3HG.6 | pancreatic | 2963 | lncrna | 507 |
| MIR7-3HG.19 | pancreatic | 2698 | lncrna | 508 |
| MIR7-3HG.16 | pancreatic | 3067 | lncrna | 509 |
| MIR7-3HG.20 | pancreatic | 2737 | lncrna | 510 |
| MIR7-3HG.23 | pancreatic | 3021 | lncrna | 511 |
| MIR7-3HG.3 | pancreatic | 2895 | lncrna | 512 |
| MIR7-3HG.1 | pancreatic | 3596 | lncrna | 513 |
| MIR7-3HG.2 | pancreatic | 3598 | lncrna | 514 |
| MIR7-3HG.18 | pancreatic | 3581 | lncrna | 515 |
| CAT2059 | kirc | 8226 | lncrna | 516 |
| CAT2059 | kirc | 8226 | lncrna | 517 |
| CAT2059 | breast | 8226 | lncrna | 518 |
| CAT2069.1 | colorectal | 786 | tucp | 519 |
| UTAT37 | uterine | 1498 | lncrna | 520 |
| CAT2082.1 | embryonic_stem_cells | 8633 | tucp | 521 |
| CAT2082.1 | breast | 8633 | tucp | 522 |
| CAT2082.1 | cervical | 8633 | tucp | 523 |
| LINC00906.1 | kich | 27059 | lncrna | 524 |
| CAT2092.1 | kich | 3077 | lncrna | 525 |
| CAT2092.1 | thyroid | 3077 | lncrna | 526 |
| CAT2092.2 | kich | 2061 | lncrna | 527 |
| CAT2092.2 | thyroid | 2061 | lncrna | 528 |
| LINC00906.2 | kich | 36082 | tucp | 529 |
| CAT2095 | kirc | 11872 | tucp | 530 |
| CAT2095 | kich | 11872 | tucp | 531 |
| MBAT15 | medulloblastoma | 5173 | lncrna | 532 |
| LINC00665.1 | prostate | 1615 | lncrna | 533 |
| LINC00665.1 | luad | 1615 | lncrna | 534 |
| LINC00665.1 | colorectal | 1615 | lncrna | 535 |
| LINC00665.2 | prostate | 6207 | lncrna | 536 |
| LINC00665.2 | colorectal | 6207 | lncrna | 537 |
| LINC00665.3 | embryonic_stem_cells | 1519 | lncrna | 538 |
| LINC00665.4 | prostate | 4249 | lncrna | 539 |
| LINC00665.5 | prostate | 10952 | lncrna | 540 |
| LINC00665.5 | colorectal | 10952 | lncrna | 541 |
| HRAT8 | heart | 333 | lncrna | 542 |
| CAT2118.1 | thyroid | 1437 | lncrna | 543 |
| CAT2118.1 | breast | 1437 | lncrna | 544 |
| CAT2118.1 | breast | 1437 | lncrna | 545 |
| CAT2118.1 | ovarian | 1437 | lncrna | 546 |
| CAT2118.1 | medulloblastoma | 1437 | lncrna | 547 |
| CAT2118.2 | thyroid | 2401 | lncrna | 548 |
| CAT2118.2 | breast | 2401 | lncrna | 549 |
| CAT2120 | cml | 2146 | lncrna | 550 |
| CAT2120 | kirc | 2146 | lncrna | 551 |
| CAT2120 | embryonic_stem_cells | 2146 | lncrna | 552 |
| CAT2120 | luad | 2146 | lncrna | 553 |
| CAT2120 | lusc | 2146 | lncrna | 554 |
| HNCAT3.1 | head_neck | 6262 | lncrna | 555 |
| CAT201.1 | embryonic_stem_cells | 3565 | lncrna | 556 |
| CAT201.2 | kich | 1898 | lncrna | 557 |
| MEAT48.1 | melanoma | 2063 | lncrna | 558 |
| CAT219.1 | colorectal | 4360 | lncrna | 559 |
| CAT219.1 | uterine | 4360 | lncrna | 560 |

TABLE 2-continued

| func_name_final | tissue | transcript_length | tcat | SEQ ID NO |
|---|---|---|---|---|
| CAT219.2 | head_neck | 4284 | lncrna | 561 |
| CAT219.2 | lusc | 4284 | lncrna | 562 |
| CAT219.3 | colorectal | 7435 | lncrna | 563 |
| CAT219.3 | uterine | 7435 | lncrna | 564 |
| CAT226.1 | melanoma | 1445 | lncrna | 565 |
| CAT226.2 | melanoma | 2173 | lncrna | 566 |
| CAT226.3 | melanoma | 2427 | lncrna | 567 |
| CAT226.4 | kich | 12408 | lncrna | 568 |
| CAT226.5 | kirc | 7403 | lncrna | 569 |
| CAT226.5 | kirc | 7403 | lncrna | 570 |
| CAT226.6 | kirc | 27140 | lncrna | 571 |
| CAT226.6 | kirc | 27140 | lncrna | 572 |
| CAT227.1 | kirc | 2216 | lncrna | 573 |
| CAT227.1 | kirc | 2216 | lncrna | 574 |
| CAT227.2 | kirc | 8010 | lncrna | 575 |
| CAT227.2 | kirc | 8010 | lncrna | 576 |
| CAT227.3 | kirc | 21694 | lncrna | 577 |
| CAT227.3 | kirc | 21694 | lncrna | 578 |
| CAT227.3 | kich | 21694 | lncrna | 579 |
| OVAT114.6 | ovarian | 1428 | lncrna | 580 |
| CAT249.1 | skeletal_muscle | 1566 | lncrna | 581 |
| CAT249.1 | kich | 1566 | lncrna | 582 |
| CAT249.1 | breast | 1566 | lncrna | 583 |
| CAT252.1 | liver | 660 | lncrna | 584 |
| CAT255.1 | head_neck | 2682 | tucp | 585 |
| CAT255.1 | luad | 2682 | tucp | 586 |
| CAT255.1 | lusc | 2682 | tucp | 587 |
| CAT255.1 | gbm | 2682 | tucp | 588 |
| CAT255.2 | lusc | 10836 | lncrna | 589 |
| LINC00152.1 | head_neck | 17432 | lncrna | 590 |
| LINC00152.1 | stomach | 17432 | lncrna | 591 |
| LINC00152.2 | luad | 3471 | lncrna | 592 |
| GBAT19 | gbm | 736 | lncrna | 593 |
| MIR4435-1HG.1 | stomach | 7049 | lncrna | 594 |
| MIR4435-1HG.2 | kirc | 7670 | lncrna | 595 |
| CAT313.1 | kirc | 4601 | lncrna | 596 |
| CAT313.2 | colorectal | 414 | lncrna | 597 |
| CAT313.3 | kirc | 1782 | lncrna | 598 |
| CAT313.4 | kirc | 3674 | lncrna | 599 |
| CAT313.5 | kirc | 3554 | lncrna | 600 |
| CAT313.5 | lusc | 3554 | lncrna | 601 |
| CERS6-AS1 | breast | 3097 | lncrna | 602 |
| CERS6-AS1 | luad | 3097 | lncrna | 603 |
| CERS6-AS1 | lusc | 3097 | lncrna | 604 |
| CERS6-AS1 | breast | 3097 | lncrna | 605 |
| PRCAT44 | prostate | 1046 | lncrna | 606 |
| PRCAT44 | prostate | 1046 | lncrna | 607 |
| HOXD-AS1 | liver | 3808 | lncrna | 608 |
| HOXD-AS1 | kirc | 3808 | lncrna | 609 |
| HOXD-AS1 | kirp | 3808 | lncrna | 610 |
| HOXD-AS1 | lusc | 3808 | lncrna | 611 |
| TTN-AS1.2 | heart | 1538 | lncrna | 612 |
| TTN-AS1.3 | skeletal_muscle | 1559 | lncrna | 613 |
| PRCAT122 | prostate | 4816 | lncrna | 614 |
| PRCAT122 | prostate | 4816 | lncrna | 615 |
| ESAT86 | embryonic_stem_cells | 8125 | lncrna | 616 |
| CAT350 | kirc | 2633 | lncrna | 617 |
| CAT350 | medulloblastoma | 2633 | lncrna | 618 |
| CAT350 | luad | 2633 | lncrna | 619 |
| CAT355.1 | colorectal | 5090 | lncrna | 620 |
| CAT355.1 | uterine | 5090 | lncrna | 621 |
| CAT355.1 | head_neck | 5090 | lncrna | 622 |
| CAT355.2 | heart | 4143 | lncrna | 623 |
| CAT355.2 | pancreatic | 4143 | lncrna | 624 |
| CAT355.2 | head_neck | 4143 | lncrna | 625 |
| CAT359.1 | kich | 774 | lncrna | 626 |
| CAT359.1 | kich | 774 | lncrna | 627 |
| CAT359.1 | kirp | 774 | lncrna | 628 |
| CAT366.1 | thyroid | 1533 | lncrna | 629 |
| PNAT34 | pancreatic | 1634 | lncrna | 630 |
| ESAT94.1 | embryonic_stem_cells | 7212 | lncrna | 631 |
| OVAT30 | ovarian | 2756 | lncrna | 632 |
| CAT2158 | embryonic_stem_cells | 5319 | lncrna | 633 |
| CAT2158 | head_neck | 5319 | lncrna | 634 |
| CAT2158 | stomach | 5319 | lncrna | 635 |
| CAT2160.1 | head_neck | 478 | lncrna | 636 |
| CAT2160.2 | kich | 511 | lncrna | 637 |
| CAT2160.2 | pancreatic | 511 | lncrna | 638 |

TABLE 2-continued

| func_name_final | tissue | transcript_length | tcat | SEQ ID NO |
|---|---|---|---|---|
| CAT2160.2 | medulloblastoma | 511 | lncrna | 639 |
| CAT2160.2 | lusc | 511 | lncrna | 640 |
| PNAT11.3 | pancreatic | 10140 | lncrna | 641 |
| PNAT11.2 | pancreatic | 7906 | lncrna | 642 |
| PNAT11.1 | pancreatic | 8471 | lncrna | 643 |
| PNAT11.4 | pancreatic | 8912 | lncrna | 644 |
| OSER1-AS1.1 | gbm | 2198 | lncrna | 645 |
| OSER1-AS1.1 | lgg | 2198 | lncrna | 646 |
| OSER1-AS1.2 | uterine | 4658 | lncrna | 647 |
| OSER1-AS1.3 | mpn | 4342 | lncrna | 648 |
| CAT2176.1 | head_neck | 1893 | lncrna | 649 |
| ZFAS1.1 | thyroid | 2921 | lncrna | 650 |
| ZFAS1.1 | kirc | 2921 | lncrna | 651 |
| ZFAS1.2 | kirc | 3006 | lncrna | 652 |
| ZFAS1.2 | kirp | 3006 | lncrna | 653 |
| ZFAS1.3 | thyroid | 4202 | lncrna | 654 |
| ZFAS1.3 | kirc | 4202 | lncrna | 655 |
| ZFAS1.3 | heart | 4202 | lncrna | 656 |
| ZFAS1.3 | uterine | 4202 | lncrna | 657 |
| ZFAS1.4 | embryonic_stem_cells | 5507 | lncrna | 658 |
| ZFAS1.4 | kirc | 5507 | lncrna | 659 |
| CAT2180.1 | luad | 1833 | lncrna | 660 |
| CAT2180.2 | luad | 1960 | tucp | 661 |
| CAT2180.2 | lusc | 1960 | tucp | 662 |
| MEAT44 | melanoma | 1645 | lncrna | 663 |
| CAT2186.1 | melanoma | 1000 | lncrna | 664 |
| OVAT65.1 | ovarian | 1284 | lncrna | 665 |
| OVAT65.2 | ovarian | 1052 | lncrna | 666 |
| OVAT65.4 | ovarian | 867 | lncrna | 667 |
| IL10RB-AS1.2 | kirc | 3951 | lncrna | 668 |
| PRCAT38 | prostate | 2598 | lncrna | 669 |
| PRCAT38 | prostate | 2598 | lncrna | 670 |
| PRCAT23 | prostate | 98 | lncrna | 671 |
| PRCAT23 | prostate | 98 | lncrna | 672 |
| CAT2215.1 | melanoma | 10845 | lncrna | 673 |
| CAT2215.2 | prostate | 9282 | lncrna | 674 |
| UTAT36 | uterine | 732 | lncrna | 675 |
| DGCR5.1 | kirc | 12734 | tucp | 676 |
| DGCR10.1 | kirc | 19778 | tucp | 677 |
| DGCR10.1 | kirc | 19778 | tucp | 678 |
| DGCR5.2 | kirc | 6204 | tucp | 679 |
| DGCR5.2 | kirp | 6204 | tucp | 680 |
| DGCR5.2 | kirc | 6204 | tucp | 681 |
| DGCR5.3 | kirc | 1170 | lncrna | 682 |
| DGCR5.3 | kirc | 1170 | lncrna | 683 |
| DGCR10.2 | kirc | 18135 | tucp | 684 |
| DGCR5.4 | kirc | 2794 | tucp | 685 |
| DGCR5.4 | kirc | 2794 | tucp | 686 |
| DGCR5.5 | kirc | 13853 | tucp | 687 |
| DGCR5.5 | kirc | 13853 | tucp | 688 |
| DGCR5.6 | kirc | 1384 | lncrna | 689 |
| DGCR5.6 | kirc | 1384 | lncrna | 690 |
| PRCAT104.4 | prostate | 6446 | tucp | 691 |
| PRCAT104.4 | prostate | 6446 | tucp | 692 |
| PRCAT104.3 | prostate | 11062 | tucp | 693 |
| PRCAT104.3 | prostate | 11062 | tucp | 694 |
| PRCAT104.6 | prostate | 2283 | lncrna | 695 |
| PRCAT104.6 | prostate | 2283 | lncrna | 696 |
| TUG1.1 | thyroid | 8722 | lncrna | 697 |
| TUG1.2 | thyroid | 8736 | lncrna | 698 |
| TUG1.3 | head_neck | 8597 | lncrna | 699 |
| KHCAT21.2 | kich | 4229 | lncrna | 700 |
| KHCAT21.1 | kich | 4310 | lncrna | 701 |
| ESAT27 | embryonic_stem_cells | 908 | lncrna | 702 |
| CAT2248 | kirc | 1515 | lncrna | 703 |
| CAT2248 | kirp | 1515 | lncrna | 704 |
| CAT2248 | prostate | 1515 | lncrna | 705 |
| CAT2248 | breast | 1515 | lncrna | 706 |
| CAT2251.1 | luad | 6597 | lncrna | 707 |
| HRAT18 | heart | 546 | lncrna | 708 |
| FGD5-AS1.2 | gbm | 3826 | tucp | 709 |
| FGD5-AS1.2 | lgg | 3826 | tucp | 710 |
| FGD5-AS1.2 | kirc | 3826 | tucp | 711 |
| FGD5-AS1.2 | prostate | 3826 | tucp | 712 |
| FGD5-AS1.2 | luad | 3826 | tucp | 713 |
| FGD5-AS1.2 | lusc | 3826 | tucp | 714 |
| FGD5-AS1.3 | kirc | 3840 | tucp | 715 |
| FGD5-AS1.4 | luad | 3882 | tucp | 716 |

TABLE 2-continued

| func_name_final | tissue | transcript_length | tcat | SEQ ID NO |
|---|---|---|---|---|
| LVCAT12 | liver | 4522 | lncrna | 717 |
| GBAT1 | gbm | 1849 | lncrna | 718 |
| ESRG.1 | embryonic_stem_cells | 4629 | lncrna | 719 |
| ESRG.1 | lusc | 4629 | lncrna | 720 |
| ESRG.2 | embryonic_stem_cells | 7300 | lncrna | 721 |
| ESRG.3 | ovarian | 5685 | lncrna | 722 |
| ESRG.4 | ovarian | 10753 | lncrna | 723 |
| ESRG.5 | ovarian | 6373 | lncrna | 724 |
| H1FX-AS1.1 | ovarian | 3535 | lncrna | 725 |
| H1FX-AS1.1 | uterine | 3535 | lncrna | 726 |
| ESAT16.4 | embryonic_stem_cells | 3076 | lncrna | 727 |
| CAT474.1 | embryonic_stem_cells | 5036 | tucp | 728 |
| ESAT19.2 | embryonic_stem_cells | 1639 | lncrna | 729 |
| ESAT19.3 | embryonic_stem_cells | 870 | lncrna | 730 |
| ESAT19.1 | embryonic_stem_cells | 996 | lncrna | 731 |
| MFI2-AS1.1 | lusc | 1268 | lncrna | 732 |
| MFI2-AS1.2 | lusc | 1504 | lncrna | 733 |
| KPCAT2.1 | kirp | 6514 | tucp | 734 |
| LINC00504 | aml | 673 | lncrna | 735 |
| LINC00504 | head_neck | 673 | lncrna | 736 |
| LINC00504 | luad | 673 | lncrna | 737 |
| LINC00504 | lusc | 673 | lncrna | 738 |
| KCCAT215 | kirc | 6566 | lncrna | 739 |
| UGDH-AS1.3 | aml | 5875 | tucp | 740 |
| UGDH-AS1.3 | lusc | 5875 | tucp | 741 |
| CAT558.1 | luad | 837 | lncrna | 742 |
| CAT558.1 | lusc | 837 | lncrna | 743 |
| CAT558.1 | prostate | 837 | lncrna | 744 |
| CAT558.2 | lusc | 757 | lncrna | 745 |
| CAT565 | thyroid | 1574 | lncrna | 746 |
| CAT565 | luad | 1574 | lncrna | 747 |
| CAT565 | cml | 1574 | lncrna | 748 |
| CAT565 | gbm | 1574 | lncrna | 749 |
| CAT565 | melanoma | 1574 | lncrna | 750 |
| CAT565 | skeletal_muscle | 1574 | lncrna | 751 |
| CAT565 | medulloblastoma | 1574 | lncrna | 752 |
| CAT565 | liver | 1574 | lncrna | 753 |
| LINC01094 | gbm | 10936 | lncrna | 754 |
| LINC01094 | lgg | 10936 | lncrna | 755 |
| LINC01094 | kirc | 10936 | lncrna | 756 |
| LINC01094 | kirp | 10936 | lncrna | 757 |
| LINC01094 | breast | 10936 | lncrna | 758 |
| CAT566.1 | gbm | 11030 | lncrna | 759 |
| CAT566.1 | kirc | 11030 | lncrna | 760 |
| CAT566.1 | kirp | 11030 | lncrna | 761 |
| ESAT72.2 | embryonic_stem_cells | 7755 | lncrna | 762 |
| ESAT72.1 | embryonic_stem_cells | 8076 | lncrna | 763 |
| CAT573.1 | kich | 3527 | lncrna | 764 |
| CAT573.1 | ovarian | 3527 | lncrna | 765 |
| CAT573.2 | lusc | 3652 | lncrna | 766 |
| ESAT31.3 | embryonic_stem_cells | 3369 | tucp | 767 |
| ESAT31.4 | embryonic_stem_cells | 3469 | lncrna | 768 |
| ESAT83 | embryonic_stem_cells | 319 | lncrna | 769 |
| CAT576 | head_neck | 450 | lncrna | 770 |
| CAT576 | lusc | 450 | lncrna | 771 |
| CAT577 | luad | 522 | tucp | 772 |
| CAT577 | lusc | 522 | tucp | 773 |
| ESAT2 | embryonic_stem_cells | 1293 | tucp | 774 |
| PRCAT42.2 | prostate | 2702 | lncrna | 775 |
| UTAT51.1 | uterine | 2030 | lncrna | 776 |
| CAT605 | kirc | 1119 | lncrna | 777 |
| CAT605 | thyroid | 1119 | lncrna | 778 |
| LSCAT1.4 | lusc | 1983 | lncrna | 779 |
| LSCAT1.3 | lusc | 4287 | lncrna | 780 |
| ESAT32.3 | embryonic_stem_cells | 9967 | lncrna | 781 |
| ESAT22.2 | embryonic_stem_cells | 1094 | lncrna | 782 |
| ESAT22.1 | embryonic_stem_cells | 1442 | lncrna | 783 |
| ESAT22.3 | embryonic_stem_cells | 4028 | lncrna | 784 |
| ESAT22.5 | embryonic_stem_cells | 11693 | lncrna | 785 |
| ESAT22.4 | embryonic_stem_cells | 749 | lncrna | 786 |
| CAT659 | kirc | 2559 | lncrna | 787 |
| CAT659 | breast | 2559 | lncrna | 788 |
| CAT664.1 | thyroid | 2750 | lncrna | 789 |
| CAT664.1 | skeletal_muscle | 2750 | lncrna | 790 |
| CAT664.1 | medulloblastoma | 2750 | lncrna | 791 |
| CAT681 | thyroid | 12569 | lncrna | 792 |
| CAT681 | prostate | 12569 | lncrna | 793 |
| CAT681 | medulloblastoma | 12569 | lncrna | 794 |

TABLE 2-continued

| func_name_final | tissue | transcript_length | tcat | SEQ ID NO |
|---|---|---|---|---|
| CAT682.1 | breast | 4267 | lncrna | 795 |
| EPB41L4A-AS1.1 | kirc | 827 | lncrna | 796 |
| EPB41L4A-AS1.1 | head_neck | 827 | lncrna | 797 |
| CAT713 | thyroid | 1282 | lncrna | 798 |
| CAT713 | kirc | 1282 | lncrna | 799 |
| CAT713 | mpn | 1282 | lncrna | 800 |
| CAT713 | embryonic_stem_cells | 1282 | lncrna | 801 |
| PNAT54 | pancreatic | 2598 | tucp | 802 |
| CAT721 | prostate | 2544 | tucp | 803 |
| UTAT1 | uterine | 949 | lncrna | 804 |
| ESAT17 | embryonic_stem_cells | 1601 | lncrna | 805 |
| MEAT2 | melanoma | 8677 | lncrna | 806 |
| CAT742.1 | kich | 5635 | lncrna | 807 |
| CAT742.1 | kich | 5635 | lncrna | 808 |
| CAT742.1 | kirp | 5635 | lncrna | 809 |
| CAT742.2 | kich | 4481 | lncrna | 810 |
| CAT742.2 | kirp | 4481 | lncrna | 811 |
| CAT742.3 | kich | 6941 | lncrna | 812 |
| CAT742.3 | kich | 6941 | lncrna | 813 |
| CAT743 | aml | 6575 | lncrna | 814 |
| CAT743 | kirc | 6575 | lncrna | 815 |
| CAT743 | medulloblastoma | 6575 | lncrna | 816 |
| CAT749.1 | kirc | 10675 | lncrna | 817 |
| LINC00518.1 | melanoma | 2922 | lncrna | 818 |
| LINC00518.7 | melanoma | 3083 | lncrna | 819 |
| LINC00518.2 | melanoma | 3019 | lncrna | 820 |
| LINC00518.3 | melanoma | 3188 | lncrna | 821 |
| LINC00518.6 | melanoma | 2806 | lncrna | 822 |
| LINC00518.5 | melanoma | 3289 | lncrna | 823 |
| CAT773.1 | embryonic_stem_cells | 399 | lncrna | 824 |
| ZSCAN16-AS1 | heart | 2914 | lncrna | 825 |
| ZSCAN16-AS1 | kich | 2914 | lncrna | 826 |
| CAT789 | mpn | 1491 | lncrna | 827 |
| CAT789 | cml | 1491 | lncrna | 828 |
| CAT789 | kirc | 1491 | lncrna | 829 |
| CAT789 | embryonic_stem_cells | 1491 | lncrna | 830 |
| CAT789 | skeletal_muscle | 1491 | lncrna | 831 |
| PRCAT30.2 | prostate | 5371 | lncrna | 832 |
| PRCAT30.1 | prostate | 5396 | lncrna | 833 |
| PRCAT15.1 | prostate | 1663 | lncrna | 834 |
| PRCAT15.2 | prostate | 2719 | lncrna | 835 |
| CAT793.1 | lgg | 9738 | lncrna | 836 |
| CAT793.1 | cervical | 9738 | lncrna | 837 |
| CAT793.1 | kirp | 9738 | lncrna | 838 |
| CAT793.1 | breast | 9738 | lncrna | 839 |
| CAT793.1 | luad | 9738 | lncrna | 840 |
| AMAT92 | aml | 7843 | lncrna | 841 |
| CAT800.1 | prostate | 561 | lncrna | 842 |
| CAT800.2 | prostate | 650 | lncrna | 843 |
| CAT828.1 | head_neck | 5239 | lncrna | 844 |
| CAT828.1 | luad | 5239 | lncrna | 845 |
| CAT828.1 | lusc | 5239 | lncrna | 846 |
| CAT837 | cml | 3351 | lncrna | 847 |
| CAT837 | breast | 3351 | lncrna | 848 |
| CAT840.1 | kich | 9492 | lncrna | 849 |
| CAT840.2 | kich | 9162 | lncrna | 850 |
| CAT840.3 | embryonic_stem_cells | 5951 | lncrna | 851 |
| CAT840.4 | kich | 1448 | lncrna | 852 |
| CAT840.5 | kich | 8137 | lncrna | 853 |
| CMAT40 | cml | 6761 | lncrna | 854 |
| KCCAT167 | kirc | 8975 | lncrna | 855 |
| CAT862.1 | embryonic_stem_cells | 21097 | lncrna | 856 |
| CAT862.2 | embryonic_stem_cells | 602 | lncrna | 857 |
| CAT862.2 | breast | 602 | lncrna | 858 |
| CAT862.3 | embryonic_stem_cells | 6909 | lncrna | 859 |
| CAT870.1 | lusc | 2047 | tucp | 860 |
| CAT870.2 | gbm | 1381 | lncrna | 861 |
| CAT870.2 | lusc | 1381 | lncrna | 862 |
| CAT878.1 | prostate | 2322 | lncrna | 863 |
| CAT878.2 | prostate | 2286 | lncrna | 864 |
| CAT878.3 | ovarian | 1126 | lncrna | 865 |
| CAT878.3 | colorectal | 1126 | lncrna | 866 |
| PNAT3 | pancreatic | 3222 | lncrna | 867 |
| CAT905 | head_neck | 912 | lncrna | 868 |
| CAT905 | lusc | 912 | lncrna | 869 |
| CAT906 | head_neck | 1465 | lncrna | 870 |
| CAT906 | lusc | 1465 | lncrna | 871 |
| LINC00265.1 | kich | 5240 | tucp | 872 |

TABLE 2-continued

| func_name_final | tissue | transcript_length | tcat | SEQ ID NO |
|---|---|---|---|---|
| CAT932.1 | kirp | 2798 | lncrna | 873 |
| CAT932.1 | medulloblastoma | 2798 | lncrna | 874 |
| CAT932.2 | head_neck | 2795 | lncrna | 875 |
| PNAT63.1 | pancreatic | 1608 | lncrna | 876 |
| PNAT63.2 | pancreatic | 1717 | lncrna | 877 |
| HNCAT59 | head_neck | 3151 | lncrna | 878 |
| ESAT63.2 | embryonic_stem_cells | 1968 | lncrna | 879 |
| CAT962 | embryonic_stem_cells | 3877 | lncrna | 880 |
| CAT962 | kich | 3877 | lncrna | 881 |
| CAT962 | luad | 3877 | lncrna | 882 |
| CAT962 | lusc | 3877 | lncrna | 883 |
| HRAT17.4 | heart | 1064 | lncrna | 884 |
| OVAT20.3 | ovarian | 695 | lncrna | 885 |
| OVAT20.4 | ovarian | 5210 | lncrna | 886 |
| OVAT20.1 | ovarian | 4908 | lncrna | 887 |
| OVAT20.5 | ovarian | 5017 | lncrna | 888 |
| CAT972.1 | kirc | 18548 | tucp | 889 |
| CAT972.1 | kirp | 18548 | tucp | 890 |
| CAT972.1 | kirc | 18548 | tucp | 891 |
| CAT972.1 | kich | 18548 | tucp | 892 |
| CAT979 | kirc | 1053 | lncrna | 893 |
| CAT979 | kich | 1053 | lncrna | 894 |
| CAT979 | lusc | 1053 | lncrna | 895 |
| CAT989 | gbm | 1262 | tucp | 896 |
| CAT989 | prostate | 1262 | tucp | 897 |
| ESAT10.4 | embryonic_stem_cells | 2160 | lncrna | 898 |
| ESAT10.1 | embryonic_stem_cells | 1879 | lncrna | 899 |
| ESAT10.2 | embryonic_stem_cells | 3150 | lncrna | 900 |
| ESAT10.3 | embryonic_stem_cells | 3206 | lncrna | 901 |
| CAT1012.1 | thyroid | 4788 | lncrna | 902 |
| CAT1012.1 | lusc | 4788 | lncrna | 903 |
| CAT1015 | cml | 2519 | lncrna | 904 |
| CAT1015 | kirc | 2519 | lncrna | 905 |
| CAT1015 | kirp | 2519 | lncrna | 906 |
| MEAT62.2 | melanoma | 4917 | lncrna | 907 |
| CAT1022 | thyroid | 2380 | lncrna | 908 |
| CAT1022 | kirc | 2380 | lncrna | 909 |
| CAT1022 | luad | 2380 | lncrna | 910 |
| CAT1043.1 | uterine | 2970 | lncrna | 911 |
| CAT1043.2 | uterine | 3416 | lncrna | 912 |
| CAT1043.3 | ovarian | 1582 | lncrna | 913 |
| CAT1043.4 | ovarian | 1246 | lncrna | 914 |
| ESAT18.1 | embryonic_stem_cells | 7795 | lncrna | 915 |
| ESAT18.2 | embryonic_stem_cells | 14742 | lncrna | 916 |
| ESAT18.3 | embryonic_stem_cells | 8468 | lncrna | 917 |
| CAT1055 | luad | 460 | lncrna | 918 |
| CAT1055 | lusc | 460 | lncrna | 919 |
| CASC9.1 | head_neck | 715 | lncrna | 920 |
| CASC9.1 | lusc | 715 | lncrna | 921 |
| CASC9.2 | head_neck | 6268 | lncrna | 922 |
| CASC9.2 | lusc | 6268 | lncrna | 923 |
| CASC9.3 | head_neck | 5793 | lncrna | 924 |
| CASC9.3 | luad | 5793 | lncrna | 925 |
| CASC9.3 | lusc | 5793 | lncrna | 926 |
| CAT1060 | kich | 5618 | lncrna | 927 |
| CAT1060 | kich | 5618 | lncrna | 928 |
| CAT1060 | kirp | 5618 | lncrna | 929 |
| CAT1060 | prostate | 5618 | lncrna | 930 |
| CAT1070 | gbm | 1299 | lncrna | 931 |
| CAT1070 | kirc | 1299 | lncrna | 932 |
| CAT1079.1 | gbm | 1843 | lncrna | 933 |
| CAT1079.2 | gbm | 1009 | lncrna | 934 |
| AMAT6 | aml | 4515 | tucp | 935 |
| ESAT52.4 | embryonic_stem_cells | 5974 | lncrna | 936 |
| ESAT52.1 | embryonic_stem_cells | 13333 | lncrna | 937 |
| ESAT52.5 | embryonic_stem_cells | 16180 | lncrna | 938 |
| ESAT52.3 | embryonic_stem_cells | 19387 | lncrna | 939 |
| ESAT52.2 | embryonic_stem_cells | 8455 | lncrna | 940 |
| CAT1089.1 | gbm | 12863 | lncrna | 941 |
| CAT1089.1 | melanoma | 12863 | lncrna | 942 |
| CAT1089.1 | lgg | 12863 | lncrna | 943 |
| CAT1089.1 | skeletal_muscle | 12863 | lncrna | 944 |
| CAT1089.2 | melanoma | 4663 | lncrna | 945 |
| CAT1089.3 | colorectal | 676 | lncrna | 946 |
| CAT1089.3 | breast | 676 | lncrna | 947 |
| CAT1089.3 | cml | 676 | lncrna | 948 |
| CAT1089.3 | melanoma | 676 | lncrna | 949 |
| CAT1089.3 | aml | 676 | lncrna | 950 |

TABLE 2-continued

| func_name_final | tissue | transcript_length | tcat | SEQ ID NO |
|---|---|---|---|---|
| CAT1089.3 | skeletal_muscle | 676 | lncrna | 951 |
| CAT1089.3 | gbm | 676 | lncrna | 952 |
| CAT1089.3 | lgg | 676 | lncrna | 953 |
| CAT1089.3 | medulloblastoma | 676 | lncrna | 954 |
| CAT1089.3 | kirc | 676 | lncrna | 955 |
| THCAT4.1 | thyroid | 1631 | lncrna | 956 |
| RNF139-AS1.1 | thyroid | 15042 | lncrna | 957 |
| RNF139-AS1.2 | head_neck | 1914 | lncrna | 958 |
| RNF139-AS1.2 | breast | 1914 | lncrna | 959 |
| ESAT82.1 | embryonic_stem_cells | 3858 | lncrna | 960 |
| CAT1109 | head_neck | 1243 | lncrna | 961 |
| CAT1109 | skeletal_muscle | 1243 | lncrna | 962 |
| CAT1109 | colorectal | 1243 | lncrna | 963 |
| CAT1115.1 | lusc | 5792 | lncrna | 964 |
| CAT1115.2 | ovarian | 1126 | lncrna | 965 |
| HNCAT56 | head_neck | 621 | lncrna | 966 |
| FAM83H-AS1.1 | prostate | 5530 | tucp | 967 |
| FAM83H-AS1.1 | breast | 5530 | tucp | 968 |
| FAM83H-AS1.1 | luad | 5530 | tucp | 969 |
| FAM83H-AS1.1 | lusc | 5530 | tucp | 970 |
| FAM83H-AS1.1 | heart | 5530 | tucp | 971 |
| FAM83H-AS1.1 | melanoma | 5530 | tucp | 972 |
| FAM83H-AS1.1 | mpn | 5530 | tucp | 973 |
| FAM83H-AS1.1 | gbm | 5530 | tucp | 974 |
| FAM83H-AS1.1 | lgg | 5530 | tucp | 975 |
| FAM83H-AS1.1 | medulloblastoma | 5530 | tucp | 976 |
| FAM83H-AS1.2 | lusc | 6435 | tucp | 977 |
| FAM83H-AS1.2 | gbm | 6435 | tucp | 978 |
| FAM83H-AS1.2 | melanoma | 6435 | tucp | 979 |
| FAM83H-AS1.3 | gbm | 6637 | tucp | 980 |
| FAM83H-AS1.3 | melanoma | 6637 | tucp | 981 |
| FAM83H-AS1.3 | medulloblastoma | 6637 | tucp | 982 |
| FAM83H-AS1.4 | prostate | 3087 | lncrna | 983 |
| FAM83H-AS1.4 | breast | 3087 | lncrna | 984 |
| FAM83H-AS1.4 | luad | 3087 | lncrna | 985 |
| FAM83H-AS1.4 | lusc | 3087 | lncrna | 986 |
| FAM83H-AS1.4 | gbm | 3087 | lncrna | 987 |
| FAM83H-AS1.4 | melanoma | 3087 | lncrna | 988 |
| FAM83H-AS1.4 | lgg | 3087 | lncrna | 989 |
| FAM83H-AS1.4 | medulloblastoma | 3087 | lncrna | 990 |
| CAT1129 | aml | 7255 | lncrna | 991 |
| CAT1129 | embryonic_stem_cells | 7255 | lncrna | 992 |
| CAT1129 | thyroid | 7255 | lncrna | 993 |
| CAT1129 | kirp | 7255 | lncrna | 994 |
| CAT1129 | breast | 7255 | lncrna | 995 |
| CAT1129 | luad | 7255 | lncrna | 996 |
| CAT1129 | liver | 7255 | lncrna | 997 |
| CAT1141.1 | heart | 4172 | tucp | 998 |
| CAT1141.2 | medulloblastoma | 4670 | tucp | 999 |
| CAT1147.1 | prostate | 1890 | lncrna | 1000 |
| CAT1147.1 | luad | 1890 | lncrna | 1001 |
| CAT1147.1 | lusc | 1890 | lncrna | 1002 |
| CAT1147.2 | heart | 1112 | lncrna | 1003 |
| CAT1147.2 | prostate | 1112 | lncrna | 1004 |
| CAT1147.2 | luad | 1112 | lncrna | 1005 |
| CAT1147.2 | lusc | 1112 | lncrna | 1006 |
| CAT1147.3 | heart | 15070 | lncrna | 1007 |
| CAT1147.3 | prostate | 15070 | lncrna | 1008 |
| CAT1147.3 | luad | 15070 | lncrna | 1009 |
| CAT1147.3 | lusc | 15070 | lncrna | 1010 |
| CAT1160 | head_neck | 2191 | lncrna | 1011 |
| CAT1160 | lusc | 2191 | lncrna | 1012 |
| CAT1162 | kirc | 1292 | lncrna | 1013 |
| CAT1162 | melanoma | 1292 | lncrna | 1014 |
| CAT1162 | thyroid | 1292 | lncrna | 1015 |
| THCAT39.7 | thyroid | 8539 | lncrna | 1016 |
| THCAT39.7 | thyroid | 8539 | lncrna | 1017 |
| THCAT39.1 | thyroid | 6408 | lncrna | 1018 |
| THCAT39.9 | thyroid | 1265 | lncrna | 1019 |
| THCAT39.9 | thyroid | 1265 | lncrna | 1020 |
| THCAT39.17 | thyroid | 13258 | lncrna | 1021 |
| THCAT39.14 | thyroid | 3327 | lncrna | 1022 |
| MIR181A2HG.2 | thyroid | 849 | lncrna | 1023 |
| MIR181A2HG.1 | thyroid | 922 | lncrna | 1024 |
| MIR181A2HG.1 | thyroid | 922 | lncrna | 1025 |
| CAT1195.1 | kich | 10727 | lncrna | 1026 |
| CAT1195.1 | kirp | 10727 | lncrna | 1027 |
| CAT1195.2 | kirp | 6079 | lncrna | 1028 |

TABLE 2-continued

| func_name_final | tissue | transcript_length | tcat | SEQ ID NO |
|---|---|---|---|---|
| CAT1201 | cervical | 868 | lncrna | 1029 |
| CAT1201 | lgg | 868 | lncrna | 1030 |
| CAT1204.1 | ovarian | 1049 | lncrna | 1031 |
| CAT1204.1 | kirc | 1049 | lncrna | 1032 |
| CAT1204.1 | kirp | 1049 | lncrna | 1033 |
| CAT1204.1 | prostate | 1049 | lncrna | 1034 |
| CAT1204.1 | kich | 1049 | lncrna | 1035 |
| CAT1204.2 | cervical | 4425 | lncrna | 1036 |
| CAT1204.3 | lusc | 1795 | lncrna | 1037 |
| CAT1204.3 | prostate | 1795 | lncrna | 1038 |
| CAT1204.4 | lusc | 1313 | lncrna | 1039 |
| CAT1204.4 | prostate | 1313 | lncrna | 1040 |
| CAT1212 | colorectal | 877 | lncrna | 1041 |
| CAT1212 | lusc | 877 | lncrna | 1042 |
| CAT1212 | liver | 877 | lncrna | 1043 |
| CAT1212 | luad | 877 | lncrna | 1044 |
| CAT1212 | prostate | 877 | lncrna | 1045 |
| CAT1212 | kich | 877 | lncrna | 1046 |
| CAT1212 | breast | 877 | lncrna | 1047 |
| CAT2275.1 | prostate | 5925 | lncrna | 1048 |
| CAT2275.2 | prostate | 2443 | lncrna | 1049 |
| CAT2275.2 | kich | 2443 | lncrna | 1050 |
| CMAT1 | cml | 3108 | lncrna | 1051 |
| MBAT1 | medulloblastoma | 7147 | lncrna | 1052 |
| ESAT92.2 | embryonic_stem_cells | 386 | lncrna | 1053 |
| ESAT92.1 | embryonic_stem_cells | 26348 | tucp | 1054 |
| ESAT92.3 | embryonic_stem_cells | 32499 | tucp | 1055 |
| MEAT16 | melanoma | 662 | lncrna | 1056 |
| CAT2277.1 | melanoma | 1373 | lncrna | 1057 |
| CAT2277.2 | uterine | 1238 | lncrna | 1058 |
| CAT2277.3 | breast | 504 | lncrna | 1059 |
| CAT2277.3 | melanoma | 504 | lncrna | 1060 |
| MPAT1 | mpn | 569 | lncrna | 1061 |
| ATP6V0E2-AS1.1 | thyroid | 3969 | lncrna | 1062 |
| ATP6V0E2-AS1.2 | kich | 2679 | lncrna | 1063 |
| ATP6V0E2-AS1.2 | thyroid | 2679 | lncrna | 1064 |
| HNCAT1 | head_neck | 1495 | lncrna | 1065 |
| CAT566.2 | kirc | 11102 | lncrna | 1066 |
| CAT264.1 | prostate | 5674 | lncrna | 1067 |
| CAT264.1 | medulloblastoma | 5674 | lncrna | 1068 |
| CAT264.2 | thyroid | 5252 | lncrna | 1069 |
| CAT264.2 | kirc | 5252 | lncrna | 1070 |
| CAT264.2 | prostate | 5252 | lncrna | 1071 |
| CAT264.2 | breast | 5252 | lncrna | 1072 |
| CAT1495.1 | thyroid | 8833 | lncrna | 1073 |
| CAT1495.1 | kirp | 8833 | lncrna | 1074 |
| CAT1495.2 | thyroid | 7437 | lncrna | 1075 |
| CAT1495.3 | thyroid | 7646 | lncrna | 1076 |
| CAT1496.1 | thyroid | 5209 | lncrna | 1077 |
| CAT1496.1 | kirp | 5209 | lncrna | 1078 |
| CAT1496.1 | head_neck | 5209 | lncrna | 1079 |
| CAT1496.2 | thyroid | 4778 | lncrna | 1080 |
| CAT1496.2 | kirp | 4778 | lncrna | 1081 |
| CAT1496.3 | thyroid | 5016 | lncrna | 1082 |
| CAT1496.3 | kirp | 5016 | lncrna | 1083 |
| CAT1496.3 | thyroid | 5016 | lncrna | 1084 |
| CAT1496.3 | head_neck | 5016 | lncrna | 1085 |
| CAT1383.1 | kirc | 1507 | lncrna | 1086 |
| CAT1382.1 | kirc | 1663 | lncrna | 1087 |
| CAT1382.1 | breast | 1663 | lncrna | 1088 |
| CAT1382.2 | kirc | 930 | lncrna | 1089 |
| CAT1382.2 | breast | 930 | lncrna | 1090 |
| GBAT2 | gbm | 666 | lncrna | 1091 |
| KCCAT148.1 | kirc | 2950 | lncrna | 1092 |
| KCCAT148.1 | kirc | 2950 | lncrna | 1093 |
| CAT329 | kirc | 1343 | lncrna | 1094 |
| CAT329 | luad | 1343 | lncrna | 1095 |
| CAT329 | lusc | 1343 | lncrna | 1096 |
| LINC00511.4 | lusc | 12087 | lncrna | 1097 |
| SBF2-AS1.2 | kich | 955 | lncrna | 1098 |
| SBF2-AS1.3 | kich | 1210 | lncrna | 1099 |
| SBF2-AS1.4 | liver | 1216 | lncrna | 1100 |
| SBF2-AS1.4 | luad | 1216 | lncrna | 1101 |
| SBF2-AS1.4 | lusc | 1216 | lncrna | 1102 |
| VCAN-AS1 | pancreatic | 522 | lncrna | 1103 |
| VCAN-AS1 | kirp | 522 | lncrna | 1104 |
| VCAN-AS1 | stomach | 522 | lncrna | 1105 |
| VCAN-AS1 | breast | 522 | lncrna | 1106 |

TABLE 2-continued

| func_name_final | tissue | transcript_length | tcat | SEQ ID NO |
|---|---|---|---|---|
| GATA3-AS1.3 | breast | 1059 | lncrna | 1107 |
| GATA3-AS1.3 | breast | 1059 | lncrna | 1108 |
| GATA3-AS1.3 | kirc | 1059 | lncrna | 1109 |
| GATA3-AS1.3 | prostate | 1059 | lncrna | 1110 |
| GATA3-AS1.4 | breast | 4620 | lncrna | 1111 |
| GATA3-AS1.4 | kirc | 4620 | lncrna | 1112 |
| GATA3-AS1.5 | breast | 4613 | lncrna | 1113 |
| GATA3-AS1.5 | breast | 4613 | lncrna | 1114 |
| GATA3-AS1.5 | prostate | 4613 | lncrna | 1115 |
| CAT800.3 | kich | 638 | lncrna | 1116 |
| HRAT70 | heart | 674 | lncrna | 1117 |
| CAT162.1 | skeletal_muscle | 8558 | lncrna | 1118 |
| CAT162.1 | aml | 8558 | lncrna | 1119 |
| CAT162.1 | colorectal | 8558 | lncrna | 1120 |
| CAT162.1 | prostate | 8558 | lncrna | 1121 |
| CAT162.1 | kich | 8558 | lncrna | 1122 |
| CAT162.1 | luad | 8558 | lncrna | 1123 |
| CAT162.1 | breast | 8558 | lncrna | 1124 |
| CAT162.2 | skeletal_muscle | 8749 | lncrna | 1125 |
| CAT162.2 | cml | 8749 | lncrna | 1126 |
| CAT162.2 | prostate | 8749 | lncrna | 1127 |
| CAT162.2 | kich | 8749 | lncrna | 1128 |
| CAT162.2 | luad | 8749 | lncrna | 1129 |
| CAT162.2 | breast | 8749 | lncrna | 1130 |
| CAT1852.1 | thyroid | 4821 | lncrna | 1131 |
| CAT1852.2 | thyroid | 9499 | tucp | 1132 |
| CAT1852.2 | head_neck | 9499 | tucp | 1133 |
| CAT1852.2 | liver | 9499 | tucp | 1134 |
| CAT1852.2 | kirc | 9499 | tucp | 1135 |
| CAT1852.2 | prostate | 9499 | tucp | 1136 |
| CAT1852.2 | kich | 9499 | tucp | 1137 |
| CAT1852.2 | breast | 9499 | tucp | 1138 |
| LINC00545 | embryonic_stem_cells | 677 | lncrna | 1139 |
| CAT664.2 | kich | 4397 | lncrna | 1140 |
| CAT2064 | thyroid | 2859 | lncrna | 1141 |
| CAT2064 | kirp | 2859 | lncrna | 1142 |
| CAT2064 | prostate | 2859 | lncrna | 1143 |
| CAT2064 | breast | 2859 | lncrna | 1144 |
| CAT2064 | gbm | 2859 | lncrna | 1145 |
| CAT2064 | lgg | 2859 | lncrna | 1146 |
| CAT2064 | skeletal_muscle | 2859 | lncrna | 1147 |
| CAT1591 | aml | 16567 | lncrna | 1148 |
| CAT1591 | kirc | 16567 | lncrna | 1149 |
| CAT793.2 | ovarian | 8428 | lncrna | 1150 |
| THCAT36.1 | thyroid | 1195 | lncrna | 1151 |
| THCAT36.1 | thyroid | 1195 | lncrna | 1152 |
| MIR205HG.4 | lusc | 2515 | lncrna | 1153 |
| MIR205HG.4 | gbm | 2515 | lncrna | 1154 |
| MIR205HG.4 | prostate | 2515 | lncrna | 1155 |
| MIR205HG.4 | breast | 2515 | lncrna | 1156 |
| THCAT36.4 | thyroid | 1355 | lncrna | 1157 |
| THCAT36.4 | thyroid | 1355 | lncrna | 1158 |
| MIR205HG.5 | lusc | 2829 | lncrna | 1159 |
| CAT969.1 | thyroid | 1371 | lncrna | 1160 |
| MIR205HG.6 | lusc | 3963 | lncrna | 1161 |
| CAT1664 | thyroid | 605 | lncrna | 1162 |
| CAT1664 | lusc | 605 | lncrna | 1163 |
| CAT1664 | kirp | 605 | lncrna | 1164 |
| CAT1664 | luad | 605 | lncrna | 1165 |
| CAT1664 | kirc | 605 | lncrna | 1166 |
| CAT1664 | kich | 605 | lncrna | 1167 |
| SMAT24 | skeletal_muscle | 531 | lncrna | 1168 |
| CAT2176.2 | breast | 2212 | lncrna | 1169 |
| CAT2176.3 | breast | 671 | lncrna | 1170 |
| CAT2176.3 | breast | 671 | lncrna | 1171 |
| CAT2157 | head_neck | 2017 | lncrna | 1172 |
| CAT2157 | lusc | 2017 | lncrna | 1173 |
| CAT1546 | kirc | 860 | lncrna | 1174 |
| CAT1546 | kirp | 860 | lncrna | 1175 |
| MYO16-AS1 | luad | 4439 | lncrna | 1176 |
| WT1-AS.4 | ovarian | 10678 | lncrna | 1177 |
| WT1-AS.5 | ovarian | 9901 | lncrna | 1178 |
| WT1-AS.6 | ovarian | 10532 | lncrna | 1179 |
| LINC00087 | kich | 5585 | tucp | 1180 |
| LINC00087 | colorectal | 5585 | tucp | 1181 |
| LINC00087 | thyroid | 5585 | tucp | 1182 |
| LINC00087 | kirp | 5585 | tucp | 1183 |
| LINC00087 | bladder | 5585 | tucp | 1184 |

TABLE 2-continued

| func_name_final | tissue | transcript_length | tcat | SEQ ID NO |
|---|---|---|---|---|
| LINC00087 | breast | 5585 | tucp | 1185 |
| LINC00087 | luad | 5585 | tucp | 1186 |
| LINC00087 | kirc | 5585 | tucp | 1187 |
| LINC00087 | prostate | 5585 | tucp | 1188 |
| LINC00152.3 | thyroid | 3019 | lncrna | 1189 |
| LINC00152.3 | kirc | 3019 | lncrna | 1190 |
| LINC00152.3 | liver | 3019 | lncrna | 1191 |
| LINC00152.3 | luad | 3019 | lncrna | 1192 |
| ESAT15.2 | embryonic_stem_cells | 1906 | lncrna | 1193 |
| LSCAT1.2 | lusc | 6456 | tucp | 1194 |
| CAT171.2 | stomach | 36752 | lncrna | 1195 |
| CAT171.3 | thyroid | 6660 | lncrna | 1196 |
| THCAT39.3 | thyroid | 695 | lncrna | 1197 |
| THCAT39.3 | thyroid | 695 | lncrna | 1198 |
| THCAT39.11 | thyroid | 1445 | lncrna | 1199 |
| CAT2071 | mpn | 4868 | lncrna | 1200 |
| CAT2071 | colorectal | 4868 | lncrna | 1201 |
| CAT2071 | kirc | 4868 | lncrna | 1202 |
| CAT2071 | luad | 4868 | lncrna | 1203 |
| CAT2071 | lusc | 4868 | lncrna | 1204 |
| PRCAT102.2 | prostate | 667 | lncrna | 1205 |
| MEAT1.1 | melanoma | 1700 | lncrna | 1206 |
| CAT1325 | kich | 6235 | lncrna | 1207 |
| CAT1325 | medulloblastoma | 6235 | lncrna | 1208 |
| CAT1947.1 | head_neck | 2165 | lncrna | 1209 |
| CAT1947.1 | prostate | 2165 | lncrna | 1210 |
| CAT1947.2 | head_neck | 3123 | tucp | 1211 |
| CAT742.4 | kirp | 4914 | lncrna | 1212 |
| CAT742.5 | kich | 4909 | lncrna | 1213 |
| CAT742.5 | kich | 4909 | lncrna | 1214 |
| HNCAT25.1 | head_neck | 1733 | lncrna | 1215 |
| HNCAT25.3 | head_neck | 1168 | lncrna | 1216 |
| HNCAT25.2 | head_neck | 784 | lncrna | 1217 |
| PRCAT101 | prostate | 2254 | lncrna | 1218 |
| GBAT18 | gbm | 2013 | lncrna | 1219 |
| THCAT3 | thyroid | 2016 | lncrna | 1220 |
| CAT1768.2 | prostate | 1209 | lncrna | 1221 |
| TRPC7-AS1 | pancreatic | 5009 | lncrna | 1222 |
| CAT828.2 | head_neck | 15379 | lncrna | 1223 |
| CAT828.2 | luad | 15379 | lncrna | 1224 |
| CAT828.2 | lusc | 15379 | lncrna | 1225 |
| CAT1284.2 | kich | 5397 | lncrna | 1226 |
| CAT1284.3 | kirc | 2413 | lncrna | 1227 |
| CAT1284.3 | lusc | 2413 | lncrna | 1228 |
| CAT1284.3 | pancreatic | 2413 | lncrna | 1229 |
| CAT1284.3 | prostate | 2413 | lncrna | 1230 |
| LBX2-AS1.1 | head_neck | 4528 | lncrna | 1231 |
| LBX2-AS1.1 | breast | 4528 | lncrna | 1232 |
| LBX2-AS1.1 | kirc | 4528 | lncrna | 1233 |
| LBX2-AS1.2 | thyroid | 1086 | lncrna | 1234 |
| LBX2-AS1.2 | kirc | 1086 | lncrna | 1235 |
| LBX2-AS1.2 | kirp | 1086 | lncrna | 1236 |
| LBX2-AS1.2 | luad | 1086 | lncrna | 1237 |
| ESAT51 | embryonic_stem_cells | 7090 | lncrna | 1238 |
| CAT2176.4 | breast | 2564 | lncrna | 1239 |
| CAT2176.4 | breast | 2564 | lncrna | 1240 |
| CAT1946 | uterine | 700 | lncrna | 1241 |
| CAT1946 | ovarian | 700 | lncrna | 1242 |
| ESAT4 | embryonic_stem_cells | 1072 | lncrna | 1243 |
| HRAT1 | heart | 323 | lncrna | 1244 |
| PNAT13.2 | pancreatic | 1430 | lncrna | 1245 |
| CAT1489 | head_neck | 277 | lncrna | 1246 |
| CAT1489 | lusc | 277 | lncrna | 1247 |
| CAT682.2 | breast | 4292 | lncrna | 1248 |
| CAT682.2 | luad | 4292 | lncrna | 1249 |
| CAT682.2 | breast | 4292 | lncrna | 1250 |
| CAT682.2 | kirc | 4292 | lncrna | 1251 |
| CAT682.2 | kirp | 4292 | lncrna | 1252 |
| CAT682.2 | kich | 4292 | lncrna | 1253 |
| LSCAT1.5 | lusc | 4306 | lncrna | 1254 |
| GBAT8 | gbm | 1276 | lncrna | 1255 |
| CAT1919 | uterine | 655 | lncrna | 1256 |
| CAT1919 | luad | 655 | lncrna | 1257 |
| ESAT31.2 | embryonic_stem_cells | 5275 | lncrna | 1258 |
| ESAT31.5 | embryonic_stem_cells | 5977 | lncrna | 1259 |
| ESAT31.1 | embryonic_stem_cells | 6396 | lncrna | 1260 |
| CAT1858 | colorectal | 567 | lncrna | 1261 |
| CAT1858 | kirc | 567 | lncrna | 1262 |

TABLE 2-continued

| func_name_final | tissue | transcript_length | tcat | SEQ ID NO |
|---|---|---|---|---|
| CAT1393 | colorectal | 816 | lncrna | 1263 |
| CAT1393 | kirc | 816 | lncrna | 1264 |
| CAT1393 | skeletal_muscle | 816 | lncrna | 1265 |
| CAT1393 | prostate | 816 | lncrna | 1266 |
| CMAT2 | cml | 1201 | lncrna | 1267 |
| CAT1957.2 | head_neck | 494 | lncrna | 1268 |
| CAT1957.2 | breast | 494 | lncrna | 1269 |
| CAT1957.2 | luad | 494 | lncrna | 1270 |
| CAT1957.2 | lusc | 494 | lncrna | 1271 |
| CMAT28 | cml | 1214 | lncrna | 1272 |
| CAT1195.3 | kich | 8390 | lncrna | 1273 |
| CAT2186.2 | head_neck | 4333 | lncrna | 1274 |
| PRCAT104.7 | prostate | 7804 | tucp | 1275 |
| PRCAT104.7 | prostate | 7804 | tucp | 1276 |
| PRCAT104.1 | prostate | 7781 | tucp | 1277 |
| PRCAT104.1 | prostate | 7781 | tucp | 1278 |
| CAT2227 | prostate | 9019 | lncrna | 1279 |
| CAT2227 | prostate | 9019 | lncrna | 1280 |
| CAT2227 | thyroid | 9019 | lncrna | 1281 |
| PRCAT104.2 | prostate | 4575 | lncrna | 1282 |
| PRCAT104.2 | prostate | 4575 | lncrna | 1283 |
| PRCAT104.5 | prostate | 10052 | tucp | 1284 |
| PRCAT104.5 | prostate | 10052 | tucp | 1285 |
| UTAT18 | uterine | 557 | lncrna | 1286 |
| MIR205HG.7 | lusc | 2018 | lncrna | 1287 |
| MIR205HG.7 | prostate | 2018 | lncrna | 1288 |
| CAT1472.2 | kirp | 6055 | lncrna | 1289 |
| CAT1472.2 | lusc | 6055 | lncrna | 1290 |
| CAT1897 | uterine | 622 | lncrna | 1291 |
| CAT1897 | kirc | 622 | lncrna | 1292 |
| CAT366.2 | thyroid | 1512 | lncrna | 1293 |
| CAT366.3 | thyroid | 2528 | lncrna | 1294 |
| CAT366.3 | stomach | 2528 | lncrna | 1295 |
| CAT366.3 | lusc | 2528 | lncrna | 1296 |
| CAT366.3 | head_neck | 2528 | lncrna | 1297 |
| CAT366.3 | breast | 2528 | lncrna | 1298 |
| CAT366.3 | luad | 2528 | lncrna | 1299 |
| THCAT39.4 | thyroid | 1747 | lncrna | 1300 |
| THCAT39.4 | thyroid | 1747 | lncrna | 1301 |
| THCAT39.6 | thyroid | 18125 | lncrna | 1302 |
| THCAT39.6 | thyroid | 18125 | lncrna | 1303 |
| THCAT39.13 | thyroid | 1507 | lncrna | 1304 |
| THCAT39.13 | thyroid | 1507 | lncrna | 1305 |
| THCAT39.8 | thyroid | 8126 | lncrna | 1306 |
| THCAT39.8 | thyroid | 8126 | lncrna | 1307 |
| THCAT39.16 | thyroid | 1140 | lncrna | 1308 |
| THCAT39.12 | thyroid | 1375 | lncrna | 1309 |
| UTAT40 | uterine | 4336 | tucp | 1310 |
| UTAT2 | uterine | 535 | lncrna | 1311 |
| CAT1023.1 | breast | 1144 | lncrna | 1312 |
| CAT1023.1 | lusc | 1144 | lncrna | 1313 |
| TTN-AS1.4 | heart | 1146 | lncrna | 1314 |
| CAT612.1 | lusc | 5363 | lncrna | 1315 |
| CAT612.2 | head_neck | 9926 | tucp | 1316 |
| CAT612.2 | lusc | 9926 | tucp | 1317 |
| CAT932.3 | stomach | 4148 | lncrna | 1318 |
| CAT2267 | head_neck | 2709 | lncrna | 1319 |
| CAT2267 | kirp | 2709 | lncrna | 1320 |
| CAT2267 | breast | 2709 | lncrna | 1321 |
| CAT2267 | luad | 2709 | lncrna | 1322 |
| CAT2267 | kirc | 2709 | lncrna | 1323 |
| HRAT40.1 | heart | 3737 | lncrna | 1324 |
| HRAT40.2 | heart | 4209 | lncrna | 1325 |
| ESAT63.3 | embryonic_stem_cells | 3502 | lncrna | 1326 |
| ESAT63.1 | embryonic_stem_cells | 996 | lncrna | 1327 |
| LINC00678.6 | embryonic_stem_cells | 5446 | lncrna | 1328 |
| CAT1860 | cml | 4554 | lncrna | 1329 |
| CAT1860 | kirc | 4554 | lncrna | 1330 |
| CAT1860 | kich | 4554 | lncrna | 1331 |
| CAT229 | kirc | 1780 | lncrna | 1332 |
| CAT229 | kirc | 1780 | lncrna | 1333 |
| CAT229 | kich | 1780 | lncrna | 1334 |
| CAT2268 | prostate | 6181 | lncrna | 1335 |
| CAT2268 | cervical | 6181 | lncrna | 1336 |
| CAT2268 | ovarian | 6181 | lncrna | 1337 |
| CAT1370 | breast | 642 | lncrna | 1338 |
| CAT1370 | luad | 642 | lncrna | 1339 |
| CAT1370 | lusc | 642 | lncrna | 1340 |

TABLE 2-continued

| func_name_final | tissue | transcript_length | tcat | SEQ ID NO |
|---|---|---|---|---|
| PCAT6 | luad | 1849 | lncrna | 1341 |
| PCAT6 | lusc | 1849 | lncrna | 1342 |
| CAT152.1 | thyroid | 1963 | lncrna | 1343 |
| CAT152.1 | breast | 1963 | lncrna | 1344 |
| CAT152.1 | luad | 1963 | lncrna | 1345 |
| CAT152.1 | lusc | 1963 | lncrna | 1346 |
| CAT152.2 | kirp | 2167 | lncrna | 1347 |
| CAT152.2 | prostate | 2167 | lncrna | 1348 |
| CAT152.2 | breast | 2167 | lncrna | 1349 |
| CAT152.2 | luad | 2167 | lncrna | 1350 |
| CAT152.2 | lusc | 2167 | lncrna | 1351 |
| CAT76.1 | kirc | 1119 | lncrna | 1352 |
| CAT2067 | uterine | 1391 | lncrna | 1353 |
| CAT2067 | head_neck | 1391 | lncrna | 1354 |
| CAT2067 | breast | 1391 | lncrna | 1355 |
| CAT2067 | medulloblastoma | 1391 | lncrna | 1356 |
| HNCAT13 | head_neck | 1471 | lncrna | 1357 |
| MIR22HG.1 | mpn | 2041 | lncrna | 1358 |
| MIR22HG.1 | heart | 2041 | lncrna | 1359 |
| MIR22HG.1 | embryonic_stem_cells | 2041 | lncrna | 1360 |
| MIR22HG.1 | thyroid | 2041 | lncrna | 1361 |
| MIR22HG.1 | stomach | 2041 | lncrna | 1362 |
| MIR22HG.1 | lusc | 2041 | lncrna | 1363 |
| MIR22HG.1 | kirp | 2041 | lncrna | 1364 |
| MIR22HG.1 | bladder | 2041 | lncrna | 1365 |
| MIR22HG.1 | liver | 2041 | lncrna | 1366 |
| MIR22HG.1 | luad | 2041 | lncrna | 1367 |
| MIR22HG.1 | prostate | 2041 | lncrna | 1368 |
| MIR22HG.1 | breast | 2041 | lncrna | 1369 |
| MIR22HG.2 | prostate | 2158 | lncrna | 1370 |
| KCCAT40 | kirc | 56307 | lncrna | 1371 |
| ESAT13.2 | embryonic_stem_cells | 515 | lncrna | 1372 |
| SNHG12.4 | kirc | 1934 | lncrna | 1373 |
| CAT2082.2 | thyroid | 3487 | lncrna | 1374 |
| CAT342.1 | prostate | 1241 | lncrna | 1375 |
| CAT342.2 | lusc | 107308 | lncrna | 1376 |
| THCAT39.2 | thyroid | 1199 | lncrna | 1377 |
| THCAT39.2 | thyroid | 1199 | lncrna | 1378 |
| THCAT39.15 | thyroid | 5673 | lncrna | 1379 |
| LINC00518.4 | melanoma | 2704 | lncrna | 1380 |
| ESAT66 | embryonic_stem_cells | 11196 | lncrna | 1381 |
| LINC00371.1 | embryonic_stem_cells | 823 | tucp | 1382 |
| LINC00371.2 | embryonic_stem_cells | 1126 | lncrna | 1383 |
| TTN-AS1.5 | heart | 1744 | lncrna | 1384 |
| CAT2039.1 | breast | 1624 | lncrna | 1385 |
| BRCAT19 | breast | 4385 | tucp | 1386 |
| CAT2039.2 | breast | 1464 | lncrna | 1387 |
| KCCAT4 | kirc | 5015 | lncrna | 1388 |
| CAT1967.2 | thyroid | 1099 | lncrna | 1389 |
| CAT1967.2 | prostate | 1099 | lncrna | 1390 |
| CAT655.1 | head_neck | 7282 | lncrna | 1391 |
| CAT655.1 | kirc | 7282 | lncrna | 1392 |
| CAT655.2 | head_neck | 21099 | lncrna | 1393 |
| CAT655.2 | kirp | 21099 | lncrna | 1394 |
| CAT655.2 | luad | 21099 | lncrna | 1395 |
| MIR7-3HG.12 | pancreatic | 3802 | lncrna | 1396 |
| MIR7-3HG.21 | pancreatic | 1964 | lncrna | 1397 |
| MIR7-3HG.8 | pancreatic | 1967 | lncrna | 1398 |
| MIR7-3HG.4 | pancreatic | 1627 | lncrna | 1399 |
| MIR7-3HG.5 | pancreatic | 1572 | lncrna | 1400 |
| MIR7-3HG.13 | pancreatic | 3273 | lncrna | 1401 |
| MEAT1.3 | melanoma | 15524 | tucp | 1402 |
| MEAT1.2 | melanoma | 1006 | lncrna | 1403 |
| UTAT51.2 | uterine | 3938 | lncrna | 1404 |
| CAT2218 | kirp | 630 | lncrna | 1405 |
| CAT2218 | medulloblastoma | 630 | lncrna | 1406 |
| MBAT8 | medulloblastoma | 2035 | lncrna | 1407 |
| CAT313.6 | kirc | 3210 | lncrna | 1408 |
| CAT313.7 | kirc | 2984 | lncrna | 1409 |
| MEAT20.4 | melanoma | 875 | lncrna | 1410 |
| KHCAT98 | kich | 2408 | lncrna | 1411 |
| THCAT39.5 | thyroid | 6854 | lncrna | 1412 |
| THCAT39.5 | thyroid | 6854 | lncrna | 1413 |
| CAT1272 | mpn | 8184 | lncrna | 1414 |
| CAT1272 | cml | 8184 | lncrna | 1415 |
| CAT1272 | kirc | 8184 | lncrna | 1416 |
| CAT1272 | breast | 8184 | lncrna | 1417 |
| CAT773.2 | breast | 1293 | lncrna | 1418 |

TABLE 2-continued

| func_name_final | tissue | transcript_length | tcat | SEQ ID NO |
|---|---|---|---|---|
| CAT773.2 | breast | 1293 | lncrna | 1419 |
| CAT868 | thyroid | 1970 | lncrna | 1420 |
| CAT868 | lusc | 1970 | lncrna | 1421 |
| CAT868 | gbm | 1970 | lncrna | 1422 |
| CAT868 | lgg | 1970 | lncrna | 1423 |
| CAT868 | prostate | 1970 | lncrna | 1424 |
| CAT868 | liver | 1970 | lncrna | 1425 |
| CAT1485 | kirc | 1501 | lncrna | 1426 |
| CAT1485 | mpn | 1501 | lncrna | 1427 |
| CAT1485 | cml | 1501 | lncrna | 1428 |
| CAT1485 | embryonic_stem_cells | 1501 | lncrna | 1429 |
| CAT1485 | medulloblastoma | 1501 | lncrna | 1430 |
| CAT1485 | prostate | 1501 | lncrna | 1431 |
| CAT1485 | breast | 1501 | lncrna | 1432 |
| CAT1580 | ovarian | 515 | lncrna | 1433 |
| CAT1580 | medulloblastoma | 515 | lncrna | 1434 |
| ESAT37 | embryonic_stem_cells | 4865 | lncrna | 1435 |
| LINC00668.3 | head_neck | 2625 | lncrna | 1436 |
| LINC00668.3 | lusc | 2625 | lncrna | 1437 |
| KCCAT200 | kirc | 2339 | lncrna | 1438 |
| CAT1828 | kirc | 2309 | lncrna | 1439 |
| CAT1828 | prostate | 2309 | lncrna | 1440 |
| CAT1828 | breast | 2309 | lncrna | 1441 |
| CAT1828 | luad | 2309 | lncrna | 1442 |
| MEAT48.2 | melanoma | 24636 | lncrna | 1443 |
| MEAT48.3 | melanoma | 24396 | lncrna | 1444 |
| CAT969.2 | breast | 3312 | lncrna | 1445 |
| CAT969.2 | luad | 3312 | lncrna | 1446 |
| KCCAT131.1 | kirc | 2547 | lncrna | 1447 |
| KCCAT131.1 | kirc | 2547 | lncrna | 1448 |
| KCCAT131.3 | kirc | 2221 | lncrna | 1449 |
| KCCAT131.2 | kirc | 3651 | lncrna | 1450 |
| KCCAT131.2 | kirc | 3651 | lncrna | 1451 |
| CAT1113.1 | colorectal | 1852 | lncrna | 1452 |
| FAM83H-AS1.5 | prostate | 10522 | tucp | 1453 |
| FAM83H-AS1.5 | breast | 10522 | tucp | 1454 |
| FAM83H-AS1.5 | luad | 10522 | tucp | 1455 |
| FAM83H-AS1.5 | lusc | 10522 | tucp | 1456 |
| FAM83H-AS1.5 | heart | 10522 | tucp | 1457 |
| FAM83H-AS1.5 | gbm | 10522 | tucp | 1458 |
| FAM83H-AS1.5 | melanoma | 10522 | tucp | 1459 |
| LINC01003 | gbm | 3779 | lncrna | 1460 |
| CAT1023.2 | breast | 13105 | lncrna | 1461 |
| CAT1456 | colorectal | 1916 | lncrna | 1462 |
| CAT1456 | uterine | 1916 | lncrna | 1463 |
| CAT1456 | breast | 1916 | lncrna | 1464 |
| CAT1456 | lusc | 1916 | lncrna | 1465 |
| THCAT36.9 | thyroid | 1259 | lncrna | 1466 |
| CAT1576 | kirc | 1579 | lncrna | 1467 |
| CAT1576 | medulloblastoma | 1579 | lncrna | 1468 |
| MIR7-3HG.14 | pancreatic | 3421 | lncrna | 1469 |
| MIR7-3HG.11 | pancreatic | 3252 | lncrna | 1470 |
| MIR7-3HG.15 | pancreatic | 3304 | lncrna | 1471 |
| MIR7-3HG.17 | pancreatic | 3560 | lncrna | 1472 |
| MIR7-3HG.9 | pancreatic | 3491 | lncrna | 1473 |
| ESAT39.1 | embryonic_stem_cells | 3310 | lncrna | 1474 |
| ESAT39.2 | embryonic_stem_cells | 12934 | tucp | 1475 |
| MIR4435-1HG.3 | breast | 903 | lncrna | 1476 |
| MIR4435-1HG.3 | luad | 903 | lncrna | 1477 |
| MIR4435-1HG.3 | liver | 903 | lncrna | 1478 |
| MIR4435-1HG.3 | lgg | 903 | lncrna | 1479 |
| CAT271 | luad | 1212 | lncrna | 1480 |
| CAT271 | lusc | 1212 | lncrna | 1481 |
| MEAT51.2 | melanoma | 2746 | lncrna | 1482 |
| MEAT51.1 | melanoma | 2650 | lncrna | 1483 |
| CAT249.2 | embryonic_stem_cells | 11296 | tucp | 1484 |
| CAT249.2 | kich | 11296 | tucp | 1485 |
| BRCAT24.2 | breast | 1938 | lncrna | 1486 |
| CAT2164.1 | prostate | 5670 | lncrna | 1487 |
| CAT2164.1 | breast | 5670 | lncrna | 1488 |
| CAT2164.1 | luad | 5670 | lncrna | 1489 |
| CAT2164.2 | heart | 3981 | lncrna | 1490 |
| CAT2164.2 | cml | 3981 | lncrna | 1491 |
| CAT2164.2 | aml | 3981 | lncrna | 1492 |
| CAT2164.2 | lgg | 3981 | lncrna | 1493 |
| CAT2164.2 | lusc | 3981 | lncrna | 1494 |
| CAT2164.2 | prostate | 3981 | lncrna | 1495 |
| CAT2164.2 | kich | 3981 | lncrna | 1496 |

TABLE 2-continued

| func_name_final | tissue | transcript_length | tcat | SEQ ID NO |
|---|---|---|---|---|
| CAT2164.2 | luad | 3981 | lncrna | 1497 |
| CAT2164.2 | breast | 3981 | lncrna | 1498 |
| KPCAT19 | kirp | 632 | lncrna | 1499 |
| MEAT38 | melanoma | 568 | lncrna | 1500 |
| MIR31HG.1 | thyroid | 2183 | lncrna | 1501 |
| MIR31HG.1 | prostate | 2183 | lncrna | 1502 |
| MIR31HG.2 | thyroid | 2442 | lncrna | 1503 |
| MIR31HG.2 | prostate | 2442 | lncrna | 1504 |
| THCAT22.2 | thyroid | 7479 | lncrna | 1505 |
| THCAT22.2 | thyroid | 7479 | lncrna | 1506 |
| THCAT22.5 | thyroid | 3138 | lncrna | 1507 |
| THCAT22.5 | thyroid | 3138 | lncrna | 1508 |
| CAT226.7 | melanoma | 1278 | lncrna | 1509 |
| CAT226.8 | melanoma | 599 | lncrna | 1510 |
| LINC00665.6 | ovarian | 5220 | lncrna | 1511 |
| LINC00665.6 | prostate | 5220 | lncrna | 1512 |
| LINC00665.6 | breast | 5220 | lncrna | 1513 |
| LINC00665.6 | luad | 5220 | lncrna | 1514 |
| LINC00665.6 | lusc | 5220 | lncrna | 1515 |
| LINC00665.6 | colorectal | 5220 | lncrna | 1516 |
| LINC00665.7 | breast | 5165 | lncrna | 1517 |
| CAT944 | ovarian | 553 | lncrna | 1518 |
| CAT944 | colorectal | 553 | lncrna | 1519 |
| CAT944 | uterine | 553 | lncrna | 1520 |
| CAT944 | breast | 553 | lncrna | 1521 |
| CAT944 | melanoma | 553 | lncrna | 1522 |
| LINC00665.8 | ovarian | 3759 | lncrna | 1523 |
| LINC00665.8 | prostate | 3759 | lncrna | 1524 |
| LINC00665.8 | breast | 3759 | lncrna | 1525 |
| LINC00665.8 | luad | 3759 | lncrna | 1526 |
| LINC00665.8 | lusc | 3759 | lncrna | 1527 |
| LINC00665.8 | colorectal | 3759 | lncrna | 1528 |
| DDX11-AS1.2 | lusc | 3230 | lncrna | 1529 |
| KCCAT162 | kirc | 16275 | lncrna | 1530 |
| CAT2251.2 | mpn | 2297 | lncrna | 1531 |
| CAT2251.2 | aml | 2297 | lncrna | 1532 |
| LINC00265.3 | kich | 4722 | tucp | 1533 |
| LINC00265.2 | kich | 4851 | tucp | 1534 |
| CAT1326 | aml | 1076 | lncrna | 1535 |
| CAT1326 | kirc | 1076 | lncrna | 1536 |
| CAT1326 | lusc | 1076 | lncrna | 1537 |
| CAT529 | thyroid | 1995 | lncrna | 1538 |
| CAT529 | lusc | 1995 | lncrna | 1539 |
| THCAT57 | thyroid | 938 | lncrna | 1540 |
| CAT1683.2 | thyroid | 5074 | lncrna | 1541 |
| CAT1683.2 | lusc | 5074 | lncrna | 1542 |
| CAT1683.2 | kirp | 5074 | lncrna | 1543 |
| CAT1683.2 | bladder | 5074 | lncrna | 1544 |
| CAT1683.2 | luad | 5074 | lncrna | 1545 |
| CAT1683.2 | kirc | 5074 | lncrna | 1546 |
| CAT1345.2 | luad | 822 | lncrna | 1547 |
| CAT1345.2 | lusc | 822 | lncrna | 1548 |
| KCCAT279.2 | kirc | 2100 | lncrna | 1549 |
| KCCAT279.1 | kirc | 2224 | lncrna | 1550 |
| KCCAT279.1 | kirc | 2224 | lncrna | 1551 |
| BRCAT24.1 | breast | 1593 | lncrna | 1552 |
| BRCAT24.1 | breast | 1593 | lncrna | 1553 |
| BRCAT24.3 | breast | 2882 | lncrna | 1554 |
| MPAT2 | mpn | 6029 | lncrna | 1555 |
| CAT1435 | liver | 404 | lncrna | 1556 |
| CAT1435 | mpn | 404 | lncrna | 1557 |
| CAT1435 | cml | 404 | lncrna | 1558 |
| CAT1435 | aml | 404 | lncrna | 1559 |
| CAT1435 | kirp | 404 | lncrna | 1560 |
| CAT1435 | kich | 404 | lncrna | 1561 |
| CAT226.9 | kirc | 1604 | lncrna | 1562 |
| CAT99.3 | colorectal | 4273 | lncrna | 1563 |
| CAT99.3 | uterine | 4273 | lncrna | 1564 |
| CAT99.3 | kich | 4273 | lncrna | 1565 |
| CAT99.3 | luad | 4273 | lncrna | 1566 |
| CAT99.3 | lusc | 4273 | lncrna | 1567 |
| ESAT33.3 | embryonic_stem_cells | 78505 | lncrna | 1568 |
| MIR31HG.3 | thyroid | 4972 | lncrna | 1569 |
| CAT1807 | kich | 1795 | lncrna | 1570 |
| CAT1807 | breast | 1795 | lncrna | 1571 |
| HOXA11-AS.1 | head_neck | 9419 | lncrna | 1572 |
| HOXA11-AS.1 | lusc | 9419 | lncrna | 1573 |
| HOXA11-AS.2 | kirc | 7671 | lncrna | 1574 |

TABLE 2-continued

| func_name_final | tissue | transcript_length | tcat | SEQ ID NO |
|---|---|---|---|---|
| HOXA11-AS.3 | lusc | 7195 | tucp | 1575 |
| CAT1768.3 | prostate | 5769 | lncrna | 1576 |
| CAT1768.3 | luad | 5769 | lncrna | 1577 |
| CAT1768.4 | prostate | 4744 | lncrna | 1578 |
| PRCAT121.2 | prostate | 2141 | lncrna | 1579 |
| PRCAT121.1 | prostate | 6441 | lncrna | 1580 |
| CAT359.2 | kich | 1706 | lncrna | 1581 |
| CAT359.2 | kich | 1706 | lncrna | 1582 |
| CAT359.3 | kich | 3119 | lncrna | 1583 |
| CAT359.3 | kich | 3119 | lncrna | 1584 |
| CAT359.3 | kirp | 3119 | lncrna | 1585 |
| LIMD1-AS1.1 | kich | 1252 | lncrna | 1586 |
| LIMD1-AS1.1 | luad | 1252 | lncrna | 1587 |
| LIMD1-AS1.1 | lusc | 1252 | lncrna | 1588 |
| CAT226.10 | kich | 12650 | lncrna | 1589 |
| CAT227.4 | kirc | 11959 | lncrna | 1590 |
| CAT227.4 | kirc | 11959 | lncrna | 1591 |
| CAT227.5 | kirc | 2100 | lncrna | 1592 |
| CAT227.5 | kirc | 2100 | lncrna | 1593 |
| CAT226.11 | kich | 28708 | lncrna | 1594 |
| CAT227.6 | kirc | 14049 | lncrna | 1595 |
| CAT474.2 | embryonic_stem_cells | 18915 | tucp | 1596 |
| CAT474.3 | ovarian | 11888 | lncrna | 1597 |
| ESAT9 | embryonic_stem_cells | 1048 | lncrna | 1598 |
| CMAT7 | cml | 724 | lncrna | 1599 |
| CAT1532 | gbm | 3711 | lncrna | 1600 |
| CAT1532 | lgg | 3711 | lncrna | 1601 |
| CAT1532 | kirp | 3711 | lncrna | 1602 |
| CAT1532 | liver | 3711 | lncrna | 1603 |
| CAT1532 | colorectal | 3711 | lncrna | 1604 |
| CAT1532 | thyroid | 3711 | lncrna | 1605 |
| AMAT47 | aml | 1525 | tucp | 1606 |
| CAT1439 | medulloblastoma | 770 | lncrna | 1607 |
| CAT1439 | kirc | 770 | lncrna | 1608 |
| CAT1439 | mpn | 770 | lncrna | 1609 |
| CAT1439 | cml | 770 | lncrna | 1610 |
| CAT1439 | thyroid | 770 | lncrna | 1611 |
| CAT1439 | head_neck | 770 | lncrna | 1612 |
| ESRG.6 | ovarian | 10002 | lncrna | 1613 |
| GBAT14 | gbm | 1042 | lncrna | 1614 |
| KHCAT3.2 | kich | 1083 | lncrna | 1615 |
| GBAT5 | gbm | 459 | lncrna | 1616 |
| CAT1736.2 | luad | 2444 | lncrna | 1617 |
| TINCR.1 | thyroid | 4657 | tucp | 1618 |
| TINCR.1 | breast | 4657 | tucp | 1619 |
| TINCR.1 | kirc | 4657 | tucp | 1620 |
| TINCR.1 | luad | 4657 | tucp | 1621 |
| THCAT63 | thyroid | 2818 | tucp | 1622 |
| KHCAT1 | kich | 609 | lncrna | 1623 |
| AFAP1-AS1 | luad | 6729 | lncrna | 1624 |
| PRCAT47.3 | prostate | 2543 | lncrna | 1625 |
| PRCAT47.3 | prostate | 2543 | lncrna | 1626 |
| PRCAT47.2 | prostate | 2261 | lncrna | 1627 |
| PRCAT47.2 | prostate | 2261 | lncrna | 1628 |
| PRCAT47.4 | prostate | 2375 | lncrna | 1629 |
| PRCAT47.4 | prostate | 2375 | lncrna | 1630 |
| WT1-AS.7 | ovarian | 2477 | lncrna | 1631 |
| THCAT4.2 | thyroid | 1860 | lncrna | 1632 |
| CAT252.2 | breast | 11636 | lncrna | 1633 |
| CAT252.2 | luad | 11636 | lncrna | 1634 |
| CAT742.6 | kich | 4836 | lncrna | 1635 |
| CAT742.6 | kich | 4836 | lncrna | 1636 |
| CAT788 | aml | 837 | lncrna | 1637 |
| CAT788 | kirc | 837 | lncrna | 1638 |
| LSCAT5 | lusc | 1505 | lncrna | 1639 |
| IDI2-AS1 | melanoma | 615 | lncrna | 1640 |
| IDI2-AS1 | head_neck | 615 | lncrna | 1641 |
| KCCAT6 | kirc | 2565 | lncrna | 1642 |
| KCCAT6 | kirc | 2565 | lncrna | 1643 |
| GBAT25.2 | gbm | 6794 | lncrna | 1644 |
| CAT2062 | thyroid | 1317 | lncrna | 1645 |
| CAT2062 | kirc | 1317 | lncrna | 1646 |
| CAT2062 | lusc | 1317 | lncrna | 1647 |
| ESAT82.2 | embryonic_stem_cells | 3839 | lncrna | 1648 |
| PNAT1.1 | pancreatic | 863 | lncrna | 1649 |
| ESAT1.2 | embryonic_stem_cells | 1686 | lncrna | 1650 |
| ESAT1.1 | embryonic_stem_cells | 1196 | lncrna | 1651 |
| TUG1.4 | head_neck | 5572 | lncrna | 1652 |

TABLE 2-continued

| func_name_final | tissue | transcript_length | tcat | SEQ ID NO |
|---|---|---|---|---|
| PNAT13.1 | pancreatic | 1846 | lncrna | 1653 |
| LINC00152.4 | kirc | 2305 | lncrna | 1654 |
| LINC00152.4 | stomach | 2305 | lncrna | 1655 |
| LINC00958.6 | lusc | 38472 | lncrna | 1656 |
| LINC00958.6 | pancreatic | 38472 | lncrna | 1657 |
| LINC00958.7 | lusc | 22404 | lncrna | 1658 |
| LINC00958.7 | pancreatic | 22404 | lncrna | 1659 |
| LINC00958.7 | prostate | 22404 | lncrna | 1660 |
| LINC00958.8 | lusc | 38382 | lncrna | 1661 |
| LINC00958.8 | pancreatic | 38382 | lncrna | 1662 |
| LINC00958.9 | thyroid | 16426 | lncrna | 1663 |
| LINC00958.9 | head_neck | 16426 | lncrna | 1664 |
| LINC00958.9 | lusc | 16426 | lncrna | 1665 |
| LINC00958.9 | pancreatic | 16426 | lncrna | 1666 |
| LINC00958.9 | prostate | 16426 | lncrna | 1667 |
| CAT1012.2 | thyroid | 2674 | lncrna | 1668 |
| CAT1012.2 | thyroid | 2674 | lncrna | 1669 |
| CAT1846 | colorectal | 1948 | lncrna | 1670 |
| CAT1846 | uterine | 1948 | lncrna | 1671 |
| CAT1381 | head_neck | 6977 | lncrna | 1672 |
| CAT1381 | stomach | 6977 | lncrna | 1673 |
| CAT1381 | lusc | 6977 | lncrna | 1674 |
| CAT1768.5 | prostate | 2715 | lncrna | 1675 |
| CAT1768.5 | luad | 2715 | lncrna | 1676 |
| CAT1768.5 | cervical | 2715 | lncrna | 1677 |
| CAT1768.5 | melanoma | 2715 | lncrna | 1678 |
| CAT1768.5 | kirp | 2715 | lncrna | 1679 |
| CAT1768.6 | prostate | 16798 | lncrna | 1680 |
| CAT1575.1 | colorectal | 1254 | lncrna | 1681 |
| CAT1575.1 | cervical | 1254 | lncrna | 1682 |
| CAT1575.2 | kich | 2362 | lncrna | 1683 |
| CAT1575.2 | thyroid | 2362 | lncrna | 1684 |
| CAT591 | gbm | 4547 | lncrna | 1685 |
| CAT591 | lgg | 4547 | lncrna | 1686 |
| CAT591 | kirc | 4547 | lncrna | 1687 |
| CAT591 | kich | 4547 | lncrna | 1688 |
| CAT2082.3 | thyroid | 11813 | tucp | 1689 |
| OVAT92 | ovarian | 2661 | lncrna | 1690 |
| OVAT131 | ovarian | 2875 | lncrna | 1691 |
| CAT2052 | breast | 891 | lncrna | 1692 |
| CAT2052 | heart | 891 | lncrna | 1693 |
| CAT2052 | melanoma | 891 | lncrna | 1694 |
| CAT2052 | aml | 891 | lncrna | 1695 |
| CAT2052 | skeletal_muscle | 891 | lncrna | 1696 |
| CAT2052 | gbm | 891 | lncrna | 1697 |
| CAT2052 | lgg | 891 | lncrna | 1698 |
| CAT2052 | medulloblastoma | 891 | lncrna | 1699 |
| CAT2052 | head_neck | 891 | lncrna | 1700 |
| LACAT23 | luad | 2080 | lncrna | 1701 |
| CAT1363.3 | uterine | 5104 | lncrna | 1702 |
| CAT2168.1 | breast | 4445 | lncrna | 1703 |
| CAT227.7 | kirc | 2301 | lncrna | 1704 |
| CAT227.7 | kirc | 2301 | lncrna | 1705 |
| ESAT32.1 | embryonic_stem_cells | 3723 | lncrna | 1706 |
| CAT969.3 | thyroid | 871 | lncrna | 1707 |
| CAT458 | aml | 13405 | lncrna | 1708 |
| CAT458 | breast | 13405 | lncrna | 1709 |
| PRCAT47.1 | prostate | 11599 | lncrna | 1710 |
| PRCAT47.1 | prostate | 11599 | lncrna | 1711 |
| CAT260.1 | kirc | 7684 | lncrna | 1712 |
| LINC00938 | medulloblastoma | 2932 | lncrna | 1713 |
| LINC00938 | head_neck | 2932 | lncrna | 1714 |
| HNCAT39.2 | head_neck | 792 | lncrna | 1715 |
| HNCAT39.1 | head_neck | 489 | lncrna | 1716 |
| CAT1137 | aml | 734 | lncrna | 1717 |
| CAT1137 | kirc | 734 | lncrna | 1718 |
| CAT1137 | gbm | 734 | lncrna | 1719 |
| CAT1137 | ovarian | 734 | lncrna | 1720 |
| EPB41L4A-AS1.2 | lgg | 1557 | lncrna | 1721 |
| EPB41L4A-AS1.2 | head_neck | 1557 | lncrna | 1722 |
| EPB41L4A-AS1.2 | breast | 1557 | lncrna | 1723 |
| EPB41L4A-AS1.3 | kirc | 856 | lncrna | 1724 |
| EPB41L4A-AS1.3 | head_neck | 856 | lncrna | 1725 |
| CAT715 | lgg | 1872 | lncrna | 1726 |
| CAT715 | uterine | 1872 | lncrna | 1727 |
| GBAT25.3 | gbm | 5608 | lncrna | 1728 |
| CAT1237.1 | liver | 23796 | lncrna | 1729 |
| CAT1237.1 | pancreatic | 23796 | lncrna | 1730 |

TABLE 2-continued

| func_name_final | tissue | transcript_length | tcat | SEQ ID NO |
|---|---|---|---|---|
| CAT1237.2 | prostate | 1508 | lncrna | 1731 |
| ST8SIA6-AS1.3 | prostate | 10062 | lncrna | 1732 |
| ST8SIA6-AS1.3 | liver | 10062 | lncrna | 1733 |
| ST8SIA6-AS1.4 | liver | 7702 | lncrna | 1734 |
| ST8SIA6-AS1.5 | prostate | 6276 | lncrna | 1735 |
| ST8SIA6-AS1.5 | liver | 6276 | lncrna | 1736 |
| LINC00678.3 | embryonic_stem_cells | 5513 | lncrna | 1737 |
| LINC00678.2 | embryonic_stem_cells | 5593 | lncrna | 1738 |
| LINC00678.5 | embryonic_stem_cells | 5362 | lncrna | 1739 |
| LINC00678.4 | embryonic_stem_cells | 5517 | lncrna | 1740 |
| SNHG12.5 | kirc | 1470 | lncrna | 1741 |
| CAT2039.3 | prostate | 1813 | lncrna | 1742 |
| CAT2039.3 | breast | 1813 | lncrna | 1743 |
| CAT2039.3 | luad | 1813 | lncrna | 1744 |
| CAT2180.3 | kirc | 2859 | lncrna | 1745 |
| CAT2180.3 | kirp | 2859 | lncrna | 1746 |
| CAT2180.3 | stomach | 2859 | lncrna | 1747 |
| CAT2180.3 | medulloblastoma | 2859 | lncrna | 1748 |
| CAT2180.3 | luad | 2859 | lncrna | 1749 |
| CAT2180.3 | lusc | 2859 | lncrna | 1750 |
| CAT2180.4 | cml | 3044 | lncrna | 1751 |
| CAT2180.4 | liver | 3044 | lncrna | 1752 |
| CAT2180.4 | luad | 3044 | lncrna | 1753 |
| CAT2180.4 | lusc | 3044 | lncrna | 1754 |
| ESAT75 | embryonic_stem_cells | 4294 | lncrna | 1755 |
| CAT184 | head_neck | 1098 | lncrna | 1756 |
| CAT184 | luad | 1098 | lncrna | 1757 |
| CAT821.1 | ovarian | 9000 | lncrna | 1758 |
| CAT821.1 | colorectal | 9000 | lncrna | 1759 |
| CAT821.1 | uterine | 9000 | lncrna | 1760 |
| CAT821.1 | head_neck | 9000 | lncrna | 1761 |
| CAT821.1 | breast | 9000 | lncrna | 1762 |
| CAT821.2 | cml | 5562 | lncrna | 1763 |
| CAT821.2 | lgg | 5562 | lncrna | 1764 |
| CAT821.2 | ovarian | 5562 | lncrna | 1765 |
| CAT821.2 | head_neck | 5562 | lncrna | 1766 |
| CAT821.2 | prostate | 5562 | lncrna | 1767 |
| CAT821.2 | breast | 5562 | lncrna | 1768 |
| CAT821.2 | luad | 5562 | lncrna | 1769 |
| BRCAT1.6 | breast | 27927 | lncrna | 1770 |
| BRCAT1.6 | breast | 27927 | lncrna | 1771 |
| CAT148 | heart | 2920 | lncrna | 1772 |
| CAT148 | kich | 2920 | lncrna | 1773 |
| MIR4435-1HG.4 | kirc | 2901 | lncrna | 1774 |
| MIR4435-1HG.4 | kirp | 2901 | lncrna | 1775 |
| MIR4435-1HG.4 | liver | 2901 | lncrna | 1776 |
| MIR4435-1HG.5 | kirc | 11167 | lncrna | 1777 |
| MIR4435-1HG.5 | stomach | 11167 | lncrna | 1778 |
| CAT294 | thyroid | 3095 | lncrna | 1779 |
| CAT294 | kirc | 3095 | lncrna | 1780 |
| CAT294 | liver | 3095 | lncrna | 1781 |
| MIR4435-1HG.6 | head_neck | 4054 | lncrna | 1782 |
| MIR4435-1HG.6 | stomach | 4054 | lncrna | 1783 |
| MIR4435-1HG.6 | kirc | 4054 | lncrna | 1784 |
| MIR4435-1HG.7 | kirc | 3676 | lncrna | 1785 |
| MIR4435-1HG.8 | kirc | 4586 | lncrna | 1786 |
| OVAT65.3 | ovarian | 1423 | lncrna | 1787 |
| CAT969.4 | thyroid | 984 | lncrna | 1788 |
| IL10RB-AS1.1 | kirc | 2299 | lncrna | 1789 |
| PRCAT119 | prostate | 10026 | lncrna | 1790 |
| PRCAT119 | prostate | 10026 | lncrna | 1791 |
| CAT972.2 | kirc | 1161 | lncrna | 1792 |
| CAT972.2 | kirp | 1161 | lncrna | 1793 |
| CAT972.2 | kirc | 1161 | lncrna | 1794 |
| CAT972.2 | kich | 1161 | lncrna | 1795 |
| CAT972.3 | kirc | 1282 | lncrna | 1796 |
| AMAT24 | aml | 2993 | lncrna | 1797 |
| KHCAT3.1 | kich | 975 | lncrna | 1798 |
| ESAT76.2 | embryonic_stem_cells | 12107 | lncrna | 1799 |
| ESAT76.1 | embryonic_stem_cells | 12103 | lncrna | 1800 |
| CAT1354 | cml | 649 | lncrna | 1801 |
| CAT1354 | kirc | 649 | lncrna | 1802 |
| CAT252.3 | medulloblastoma | 11801 | lncrna | 1803 |
| CAT1966.1 | cml | 5697 | lncrna | 1804 |
| CAT1966.1 | kirc | 5697 | lncrna | 1805 |
| SMAT14 | skeletal_muscle | 456 | lncrna | 1806 |
| LSCAT1.1 | lusc | 1196 | lncrna | 1807 |
| CAT1501.3 | kirc | 656 | lncrna | 1808 |

TABLE 2-continued

| func_name_final | tissue | transcript_length | tcat | SEQ ID NO |
|---|---|---|---|---|
| CAT1501.3 | kirp | 656 | lncrna | 1809 |
| CAT1501.3 | kich | 656 | lncrna | 1810 |
| CAT1501.3 | pancreatic | 656 | lncrna | 1811 |
| CAT1501.4 | kich | 513 | lncrna | 1812 |
| CAT1501.4 | medulloblastoma | 513 | lncrna | 1813 |
| CAT1501.5 | medulloblastoma | 2898 | lncrna | 1814 |
| CAT119 | colorectal | 1750 | lncrna | 1815 |
| CAT119 | uterine | 1750 | lncrna | 1816 |
| LVCAT6 | liver | 4958 | lncrna | 1817 |
| CRAT4 | colorectal | 809 | lncrna | 1818 |
| MEAT29.2 | melanoma | 3541 | lncrna | 1819 |
| MEAT29.1 | melanoma | 739 | lncrna | 1820 |
| LINC00948.2 | pancreatic | 1327 | lncrna | 1821 |
| LINC00948.2 | kirp | 1327 | lncrna | 1822 |
| CAT1410 | pancreatic | 626 | lncrna | 1823 |
| CAT1410 | colorectal | 626 | lncrna | 1824 |
| PRCAT42.3 | prostate | 2607 | lncrna | 1825 |
| PRCAT42.1 | prostate | 4241 | lncrna | 1826 |
| OVAT148 | ovarian | 612 | lncrna | 1827 |
| CAT1345.3 | head_neck | 885 | lncrna | 1828 |
| CAT1345.3 | luad | 885 | lncrna | 1829 |
| CAT1345.3 | lusc | 885 | lncrna | 1830 |
| CAT1345.4 | luad | 525 | lncrna | 1831 |
| CAT1345.4 | lusc | 525 | lncrna | 1832 |
| CAT1345.5 | head_neck | 2239 | lncrna | 1833 |
| CAT1345.5 | luad | 2239 | lncrna | 1834 |
| CAT1345.5 | lusc | 2239 | lncrna | 1835 |
| CAT2040 | uterine | 1952 | lncrna | 1836 |
| CAT2040 | kich | 1952 | lncrna | 1837 |
| CAT2040 | liver | 1952 | lncrna | 1838 |
| CAT1914 | gbm | 1746 | lncrna | 1839 |
| CAT1914 | lgg | 1746 | lncrna | 1840 |
| CAT1914 | mpn | 1746 | lncrna | 1841 |
| CAT1914 | aml | 1746 | lncrna | 1842 |
| CAT1914 | colorectal | 1746 | lncrna | 1843 |
| CAT1914 | luad | 1746 | lncrna | 1844 |
| CD27-AS1.1 | kirp | 1880 | lncrna | 1845 |
| CD27-AS1.1 | prostate | 1880 | lncrna | 1846 |
| CAT1687 | thyroid | 1043 | lncrna | 1847 |
| CAT1687 | head_neck | 1043 | lncrna | 1848 |
| CAT1687 | breast | 1043 | lncrna | 1849 |
| CAT1687 | luad | 1043 | lncrna | 1850 |
| CAT1079.3 | gbm | 583 | lncrna | 1851 |
| CAT1079.3 | lgg | 583 | lncrna | 1852 |
| CAT1079.3 | kich | 583 | lncrna | 1853 |
| CAT1011 | aml | 5218 | tucp | 1854 |
| CAT1011 | thyroid | 5218 | tucp | 1855 |
| CAT1011 | breast | 5218 | tucp | 1856 |
| H1FX-AS1.2 | colorectal | 6093 | lncrna | 1857 |
| CAT366.4 | thyroid | 1568 | lncrna | 1858 |
| CAT366.4 | thyroid | 1568 | lncrna | 1859 |
| CAT505.1 | prostate | 4300 | tucp | 1860 |
| CAT505.1 | breast | 4300 | tucp | 1861 |
| CAT793.3 | head_neck | 10130 | tucp | 1862 |
| DGCR10.3 | kirc | 21073 | tucp | 1863 |
| CAT1855.1 | breast | 2092 | lncrna | 1864 |
| CAT1855.2 | breast | 1987 | lncrna | 1865 |
| CAT1855.2 | breast | 1987 | lncrna | 1866 |
| PRC1-AS1 | colorectal | 333 | lncrna | 1867 |
| PRC1-AS1 | uterine | 333 | lncrna | 1868 |
| PRC1-AS1 | lusc | 333 | lncrna | 1869 |
| PRC1-AS1 | breast | 333 | lncrna | 1870 |
| PRC1-AS1 | luad | 333 | lncrna | 1871 |
| PRC1-AS1 | liver | 333 | lncrna | 1872 |
| LACAT16.1 | luad | 4814 | tucp | 1873 |
| CAT2010 | melanoma | 4289 | lncrna | 1874 |
| CAT2010 | thyroid | 4289 | lncrna | 1875 |
| CAT2010 | lusc | 4289 | lncrna | 1876 |
| CAT773.3 | embryonic_stem_cells | 527 | lncrna | 1877 |
| ESAT42.3 | embryonic_stem_cells | 2715 | lncrna | 1878 |
| ESAT42.2 | embryonic_stem_cells | 2712 | lncrna | 1879 |
| CAT1892.2 | bladder | 5614 | lncrna | 1880 |
| CAT221 | ovarian | 949 | lncrna | 1881 |
| CAT221 | lusc | 949 | lncrna | 1882 |
| CAT2275.3 | colorectal | 1176 | lncrna | 1883 |
| HRAT4 | heart | 3659 | lncrna | 1884 |
| KCCAT41 | kirc | 616 | lncrna | 1885 |
| CAT2082.4 | head_neck | 2265 | lncrna | 1886 |

TABLE 2-continued

| func_name_final | tissue | transcript_length | tcat | SEQ ID NO |
|---|---|---|---|---|
| OVAT114.2 | ovarian | 5819 | lncrna | 1887 |
| OVAT114.4 | ovarian | 3619 | lncrna | 1888 |
| OVAT114.3 | ovarian | 8783 | lncrna | 1889 |
| CAT260.2 | cml | 22722 | lncrna | 1890 |
| CAT260.2 | aml | 22722 | lncrna | 1891 |
| CAT260.2 | kirc | 22722 | lncrna | 1892 |
| CAT1595 | aml | 8430 | lncrna | 1893 |
| CAT1595 | kirc | 8430 | lncrna | 1894 |
| MEAT62.1 | melanoma | 3376 | lncrna | 1895 |
| MEAT62.3 | melanoma | 3304 | lncrna | 1896 |
| ESAT25 | embryonic_stem_cells | 842 | lncrna | 1897 |
| CAT1841.2 | kirc | 3261 | lncrna | 1898 |
| CAT1841.3 | colorectal | 2718 | lncrna | 1899 |
| CAT1841.3 | breast | 2718 | lncrna | 1900 |
| CAT1841.3 | pancreatic | 2718 | lncrna | 1901 |
| CAT1841.3 | medulloblastoma | 2718 | lncrna | 1902 |
| CAT1841.4 | lusc | 2433 | lncrna | 1903 |
| CAT1841.4 | head_neck | 2433 | lncrna | 1904 |
| CAT1841.4 | kirp | 2433 | lncrna | 1905 |
| CAT1841.4 | breast | 2433 | lncrna | 1906 |
| CAT1841.4 | luad | 2433 | lncrna | 1907 |
| CAT1841.4 | kirc | 2433 | lncrna | 1908 |
| CAT1841.4 | liver | 2433 | lncrna | 1909 |
| CAT1117 | thyroid | 1230 | lncrna | 1910 |
| CAT1806 | kich | 1496 | lncrna | 1911 |
| CAT1806 | thyroid | 1496 | lncrna | 1912 |
| CAT1806 | kirc | 1496 | lncrna | 1913 |
| CAT1806 | kirp | 1496 | lncrna | 1914 |
| CAT1710.1 | uterine | 1902 | tucp | 1915 |
| CAT1195.4 | kich | 8189 | lncrna | 1916 |
| CAT1195.4 | kich | 8189 | lncrna | 1917 |
| CAT1195.4 | kirp | 8189 | lncrna | 1918 |
| CAT1300 | mpn | 3661 | lncrna | 1919 |
| CAT1300 | liver | 3661 | lncrna | 1920 |
| CAT1300 | luad | 3661 | lncrna | 1921 |
| CD27-AS1.2 | kirp | 1758 | lncrna | 1922 |
| CD27-AS1.2 | embryonic_stem_cells | 1758 | lncrna | 1923 |
| CAT2023 | kich | 821 | lncrna | 1924 |
| CAT2023 | cervical | 821 | lncrna | 1925 |
| CAT2023 | kirc | 821 | lncrna | 1926 |
| CAT2023 | kirp | 821 | lncrna | 1927 |
| CAT2023 | luad | 821 | lncrna | 1928 |
| CAT2023 | lusc | 821 | lncrna | 1929 |
| PNAT23.2 | pancreatic | 7024 | lncrna | 1930 |
| PNAT23.5 | pancreatic | 1409 | lncrna | 1931 |
| PNAT23.4 | pancreatic | 13418 | tucp | 1932 |
| PNAT23.3 | pancreatic | 13621 | tucp | 1933 |
| PNAT23.1 | pancreatic | 1282 | lncrna | 1934 |
| CAT1701 | kich | 1055 | lncrna | 1935 |
| CAT1701 | mpn | 1055 | lncrna | 1936 |
| CAT1701 | cml | 1055 | lncrna | 1937 |
| CAT1701 | aml | 1055 | lncrna | 1938 |
| DGCR5.7 | kirc | 4192 | tucp | 1939 |
| DGCR5.7 | kirp | 4192 | tucp | 1940 |
| DGCR5.7 | luad | 4192 | tucp | 1941 |
| DGCR5.8 | kirc | 12465 | tucp | 1942 |
| CAT2051 | uterine | 1174 | lncrna | 1943 |
| CAT2051 | pancreatic | 1174 | lncrna | 1944 |
| DGCR5.9 | kirc | 4293 | tucp | 1945 |
| DGCR5.9 | luad | 4293 | tucp | 1946 |
| DGCR5.9 | kirc | 4293 | tucp | 1947 |
| CAT742.7 | kich | 6946 | lncrna | 1948 |
| CAT742.7 | kich | 6946 | lncrna | 1949 |
| CAT1069 | ovarian | 1412 | lncrna | 1950 |
| CAT1069 | colorectal | 1412 | lncrna | 1951 |
| CAT1069 | uterine | 1412 | lncrna | 1952 |
| CAT1069 | kirc | 1412 | lncrna | 1953 |
| CAT2068 | ovarian | 713 | lncrna | 1954 |
| CAT2068 | uterine | 713 | lncrna | 1955 |
| CAT2068 | thyroid | 713 | lncrna | 1956 |
| CAT2068 | kich | 713 | lncrna | 1957 |
| CAT2068 | luad | 713 | lncrna | 1958 |
| CAT2068 | breast | 713 | lncrna | 1959 |
| CAT2068 | pancreatic | 713 | lncrna | 1960 |
| CAT2012 | embryonic_stem_cells | 2410 | lncrna | 1961 |
| CAT2012 | head_neck | 2410 | lncrna | 1962 |
| CAT2012 | liver | 2410 | lncrna | 1963 |
| CAT2012 | luad | 2410 | lncrna | 1964 |

TABLE 2-continued

| func_name_final | tissue | transcript_length | tcat | SEQ ID NO |
|---|---|---|---|---|
| MPAT11 | mpn | 17500 | lncrna | 1965 |
| CAT1966.2 | mpn | 5823 | lncrna | 1966 |
| CAT1966.2 | cml | 5823 | lncrna | 1967 |
| CAT1966.2 | aml | 5823 | lncrna | 1968 |
| CAT1966.2 | kirc | 5823 | lncrna | 1969 |
| CAT1966.2 | embryonic_stem_cells | 5823 | lncrna | 1970 |
| ESAT8.1 | embryonic_stem_cells | 4074 | lncrna | 1971 |
| THCAT50.1 | thyroid | 1675 | lncrna | 1972 |
| THCAT50.1 | thyroid | 1675 | lncrna | 1973 |
| THCAT50.2 | thyroid | 1639 | lncrna | 1974 |
| CAT1224.2 | prostate | 15239 | lncrna | 1975 |
| CAT1224.2 | breast | 15239 | lncrna | 1976 |
| CAT1224.3 | breast | 22412 | lncrna | 1977 |
| CAT120 | thyroid | 4940 | lncrna | 1978 |
| CAT120 | prostate | 4940 | lncrna | 1979 |
| CAT120 | breast | 4940 | lncrna | 1980 |
| CAT120 | luad | 4940 | lncrna | 1981 |
| CAT120 | lusc | 4940 | lncrna | 1982 |
| CAT120 | pancreatic | 4940 | lncrna | 1983 |
| CAT270 | heart | 423 | lncrna | 1984 |
| CAT270 | embryonic_stem_cells | 423 | lncrna | 1985 |
| CAT270 | head_neck | 423 | lncrna | 1986 |
| CAT655.3 | head_neck | 895 | lncrna | 1987 |
| LACAT3 | luad | 814 | lncrna | 1988 |
| ESAT32.2 | embryonic_stem_cells | 2299 | lncrna | 1989 |
| CAT405.1 | heart | 842 | lncrna | 1990 |
| CAT405.1 | uterine | 842 | lncrna | 1991 |
| CAT405.1 | lusc | 842 | lncrna | 1992 |
| HCP5.1 | head_neck | 16291 | lncrna | 1993 |
| HCP5.1 | kich | 16291 | lncrna | 1994 |
| HCP5.1 | kirc | 16291 | lncrna | 1995 |
| HCP5.1 | skeletal_muscle | 16291 | lncrna | 1996 |
| HCP5.2 | kirc | 13672 | lncrna | 1997 |
| HCP5.2 | skeletal_muscle | 13672 | lncrna | 1998 |
| CAT1202.1 | ovarian | 2314 | tucp | 1999 |
| CAT1202.2 | embryonic_stem_cells | 2066 | tucp | 2000 |
| CAT1202.3 | ovarian | 1079 | tucp | 2001 |
| CAT1202.3 | thyroid | 1079 | tucp | 2002 |
| CAT1202.3 | stomach | 1079 | tucp | 2003 |
| CAT1202.3 | breast | 1079 | tucp | 2004 |
| ESAT53 | embryonic_stem_cells | 3328 | lncrna | 2005 |
| MIR31HG.4 | thyroid | 4713 | lncrna | 2006 |
| CASC9.4 | head_neck | 10480 | lncrna | 2007 |
| CASC9.4 | lusc | 10480 | lncrna | 2008 |
| HRAT17.2 | heart | 818 | lncrna | 2009 |
| HRAT17.1 | heart | 867 | lncrna | 2010 |
| CASC9.5 | head_neck | 1316 | lncrna | 2011 |
| CASC9.5 | luad | 1316 | lncrna | 2012 |
| CASC9.5 | lusc | 1316 | lncrna | 2013 |
| HRAT17.5 | heart | 1579 | lncrna | 2014 |
| CAT2024 | kirc | 8337 | lncrna | 2015 |
| CAT2024 | kirc | 8337 | lncrna | 2016 |
| CAT2024 | kich | 8337 | lncrna | 2017 |
| UGDH-AS1.4 | cervical | 8132 | tucp | 2018 |
| UGDH-AS1.4 | thyroid | 8132 | tucp | 2019 |
| CAT505.2 | prostate | 4033 | tucp | 2020 |
| CAT505.2 | breast | 4033 | tucp | 2021 |
| KDM4A-AS1.2 | lusc | 5308 | lncrna | 2022 |
| KDM4A-AS1.3 | uterine | 3382 | lncrna | 2023 |
| OVAT150 | ovarian | 271 | lncrna | 2024 |
| CAT2168.2 | prostate | 3715 | lncrna | 2025 |
| CAT2168.2 | breast | 3715 | lncrna | 2026 |
| CAT2168.3 | breast | 831 | lncrna | 2027 |
| CAT2168.4 | breast | 1058 | lncrna | 2028 |
| CAT2168.5 | breast | 1098 | lncrna | 2029 |
| CAT2168.6 | breast | 976 | lncrna | 2030 |
| CAT505.3 | breast | 4286 | tucp | 2031 |
| CAT784.1 | kich | 1094 | lncrna | 2032 |
| CAT1141.3 | thyroid | 4764 | tucp | 2033 |
| CAT1141.4 | medulloblastoma | 4002 | tucp | 2034 |
| PRCAT55 | prostate | 1063 | lncrna | 2035 |
| PRCAT55 | prostate | 1063 | lncrna | 2036 |
| KCCAT10 | kirc | 825 | lncrna | 2037 |
| KCCAT10 | kirc | 825 | lncrna | 2038 |
| CAT1636.2 | kirc | 484 | lncrna | 2039 |
| CAT1636.2 | liver | 484 | lncrna | 2040 |
| CAT2069.2 | thyroid | 1070 | tucp | 2041 |
| CAT2069.2 | head_neck | 1070 | tucp | 2042 |

TABLE 2-continued

| func_name_final | tissue | transcript_length | tcat | SEQ ID NO |
|---|---|---|---|---|
| CAT2069.2 | kirp | 1070 | tucp | 2043 |
| CAT2069.2 | luad | 1070 | tucp | 2044 |
| MIAT.2 | embryonic_stem_cells | 4074 | lncrna | 2045 |
| MIAT.2 | head_neck | 4074 | lncrna | 2046 |
| MIAT.2 | breast | 4074 | lncrna | 2047 |
| MIAT.2 | kirc | 4074 | lncrna | 2048 |
| THCAT36.6 | thyroid | 1180 | lncrna | 2049 |
| THCAT36.6 | thyroid | 1180 | lncrna | 2050 |
| PRCAT102.1 | prostate | 3656 | lncrna | 2051 |
| THCAT36.7 | thyroid | 1170 | lncrna | 2052 |
| THCAT36.7 | thyroid | 1170 | lncrna | 2053 |
| CAT2176.5 | head_neck | 12721 | lncrna | 2054 |
| LINC00511.5 | luad | 13108 | lncrna | 2055 |
| LINC00511.5 | lusc | 13108 | lncrna | 2056 |
| LINC00673 | luad | 7751 | lncrna | 2057 |
| LINC00673 | lusc | 7751 | lncrna | 2058 |
| CALML3-AS1.3 | lusc | 13476 | tucp | 2059 |
| CALML3-AS1.4 | lusc | 9287 | tucp | 2060 |
| CALML3-AS1.5 | lusc | 7874 | tucp | 2061 |
| CALML3-AS1.5 | pancreatic | 7874 | tucp | 2062 |
| CALML3-AS1.5 | prostate | 7874 | tucp | 2063 |
| CALML3-AS1.6 | lusc | 9117 | tucp | 2064 |
| CALML3-AS1.7 | lusc | 11578 | tucp | 2065 |
| ESAT73.2 | embryonic_stem_cells | 11801 | lncrna | 2066 |
| ESAT73.3 | embryonic_stem_cells | 19092 | lncrna | 2067 |
| ESAT73.1 | embryonic_stem_cells | 11767 | lncrna | 2068 |
| CAT678 | uterine | 392 | lncrna | 2069 |
| CAT678 | lusc | 392 | lncrna | 2070 |
| LSCAT8 | lusc | 894 | lncrna | 2071 |
| ESAT16.1 | embryonic_stem_cells | 3069 | lncrna | 2072 |
| ESAT16.2 | embryonic_stem_cells | 5948 | lncrna | 2073 |
| ESAT16.3 | embryonic_stem_cells | 3319 | lncrna | 2074 |
| CAT808 | skeletal_muscle | 3066 | lncrna | 2075 |
| CAT808 | medulloblastoma | 3066 | lncrna | 2076 |
| CAT808 | lusc | 3066 | lncrna | 2077 |
| CAT808 | kirp | 3066 | lncrna | 2078 |
| CAT808 | breast | 3066 | lncrna | 2079 |
| CAT808 | luad | 3066 | lncrna | 2080 |
| CAT808 | kirc | 3066 | lncrna | 2081 |
| CAT808 | kich | 3066 | lncrna | 2082 |
| CAT2045.3 | kirc | 3770 | lncrna | 2083 |
| CAT2045.4 | mpn | 6943 | tucp | 2084 |
| CAT2045.4 | kirc | 6943 | tucp | 2085 |
| CAT1204.5 | lusc | 1366 | lncrna | 2086 |
| CAT1204.5 | prostate | 1366 | lncrna | 2087 |
| CAT1204.6 | thyroid | 1329 | lncrna | 2088 |
| CAT1204.6 | prostate | 1329 | lncrna | 2089 |
| ESAT94.2 | embryonic_stem_cells | 8025 | lncrna | 2090 |
| PRCAT89 | prostate | 2337 | lncrna | 2091 |
| CAT201.3 | kich | 1789 | lncrna | 2092 |
| AMAT7 | aml | 411 | lncrna | 2093 |
| CAT1452.2 | kich | 1906 | tucp | 2094 |
| OVAT20.2 | ovarian | 8749 | tucp | 2095 |
| KCCAT63 | kirc | 1938 | tucp | 2096 |
| KCCAT63 | kirc | 1938 | tucp | 2097 |
| CAT955 | head_neck | 4596 | lncrna | 2098 |
| CAT955 | lusc | 4596 | lncrna | 2099 |
| CAT955 | luad | 4596 | lncrna | 2100 |
| CAT955 | kirc | 4596 | lncrna | 2101 |
| CAT369 | luad | 2102 | lncrna | 2102 |
| CAT369 | melanoma | 2102 | lncrna | 2103 |
| CAT369 | skeletal_muscle | 2102 | lncrna | 2104 |
| CAT369 | medulloblastoma | 2102 | lncrna | 2105 |
| ESAT89 | embryonic_stem_cells | 10862 | lncrna | 2106 |
| LINC00957 | kich | 3721 | tucp | 2107 |
| LINC00957 | embryonic_stem_cells | 3721 | tucp | 2108 |
| HNCAT99 | head_neck | 2534 | lncrna | 2109 |
| HNCAT3.2 | head_neck | 6556 | lncrna | 2110 |
| OVAT19 | ovarian | 341 | lncrna | 2111 |
| CAT1916 | kirc | 971 | lncrna | 2112 |
| CAT1916 | head_neck | 971 | lncrna | 2113 |
| CAT1916 | prostate | 971 | lncrna | 2114 |
| CAT877 | mpn | 1598 | lncrna | 2115 |
| CAT877 | kirc | 1598 | lncrna | 2116 |
| CAT877 | medulloblastoma | 1598 | lncrna | 2117 |
| CAT877 | thyroid | 1598 | lncrna | 2118 |
| CAT877 | breast | 1598 | lncrna | 2119 |
| CAT877 | luad | 1598 | lncrna | 2120 |

TABLE 2-continued

| func_name_final | tissue | transcript_length | tcat | SEQ ID NO |
|---|---|---|---|---|
| CAT877 | lusc | 1598 | lncrna | 2121 |
| CAT1429 | kich | 932 | lncrna | 2122 |
| CAT1429 | thyroid | 932 | lncrna | 2123 |
| CAT1429 | kirc | 932 | lncrna | 2124 |
| CAT1429 | kirp | 932 | lncrna | 2125 |
| CAT57.3 | thyroid | 3492 | tucp | 2126 |
| CAT57.3 | kich | 3492 | tucp | 2127 |
| CAT57.4 | thyroid | 3093 | tucp | 2128 |
| TRAF3IP2-AS1.1 | gbm | 2387 | lncrna | 2129 |
| TRAF3IP2-AS1.1 | lgg | 2387 | lncrna | 2130 |
| TRAF3IP2-AS1.1 | prostate | 2387 | lncrna | 2131 |
| TRAF3IP2-AS1.1 | breast | 2387 | lncrna | 2132 |
| TRAF3IP2-AS1.2 | lgg | 5721 | lncrna | 2133 |
| TRAF3IP2-AS1.2 | breast | 5721 | lncrna | 2134 |
| TRAF3IP2-AS1.3 | gbm | 5841 | lncrna | 2135 |
| TRAF3IP2-AS1.3 | lgg | 5841 | lncrna | 2136 |
| TRAF3IP2-AS1.3 | kich | 5841 | lncrna | 2137 |
| CAT781 | head_neck | 8619 | lncrna | 2138 |
| CAT781 | breast | 8619 | lncrna | 2139 |
| CAT781 | luad | 8619 | lncrna | 2140 |
| MIR205HG.8 | lusc | 3923 | lncrna | 2141 |
| MIR205HG.9 | lusc | 4139 | lncrna | 2142 |
| CAT2044 | colorectal | 356 | lncrna | 2143 |
| CAT2044 | uterine | 356 | lncrna | 2144 |
| AMAT31 | aml | 1230 | lncrna | 2145 |
| KPCAT2.2 | kirp | 1958 | lncrna | 2146 |
| LINC00511.6 | luad | 11120 | lncrna | 2147 |
| SMAT5 | skeletal_muscle | 3550 | lncrna | 2148 |
| CAT1918 | colorectal | 808 | lncrna | 2149 |
| CAT1918 | uterine | 808 | lncrna | 2150 |
| CAT1918 | kirc | 808 | lncrna | 2151 |
| CAT1918 | pancreatic | 808 | lncrna | 2152 |
| ESAT54.2 | embryonic_stem_cells | 2476 | lncrna | 2153 |
| ESAT54.3 | embryonic_stem_cells | 6385 | lncrna | 2154 |
| ESAT54.4 | embryonic_stem_cells | 5819 | lncrna | 2155 |
| ESAT54.6 | embryonic_stem_cells | 7677 | lncrna | 2156 |
| ESAT54.1 | embryonic_stem_cells | 10005 | lncrna | 2157 |
| CAT275 | ovarian | 644 | lncrna | 2158 |
| CAT275 | breast | 644 | lncrna | 2159 |
| CAT275 | cml | 644 | lncrna | 2160 |
| CAT1113.2 | lusc | 9018 | lncrna | 2161 |
| CAT1113.3 | cervical | 6154 | lncrna | 2162 |
| CAT1113.3 | head_neck | 6154 | lncrna | 2163 |
| CAT1113.3 | luad | 6154 | lncrna | 2164 |
| CAT1113.3 | lusc | 6154 | lncrna | 2165 |
| CAT118.2 | gbm | 1883 | tucp | 2166 |
| CAT2038 | uterine | 2445 | tucp | 2167 |
| CAT2038 | thyroid | 2445 | tucp | 2168 |
| DDX11-AS1.3 | lusc | 920 | lncrna | 2169 |
| CAT1822 | aml | 2450 | lncrna | 2170 |
| CAT1822 | kirc | 2450 | lncrna | 2171 |
| CAT708 | embryonic_stem_cells | 8558 | lncrna | 2172 |
| CAT708 | stomach | 8558 | lncrna | 2173 |
| ESAT43 | embryonic_stem_cells | 764 | lncrna | 2174 |
| KCCAT101 | kirc | 3308 | lncrna | 2175 |
| KCCAT101 | kirc | 3308 | lncrna | 2176 |
| SMAT17 | skeletal_muscle | 915 | lncrna | 2177 |
| LIMD1-AS1.2 | thyroid | 1896 | lncrna | 2178 |
| LIMD1-AS1.2 | lusc | 1896 | lncrna | 2179 |
| CAT784.2 | embryonic_stem_cells | 3134 | lncrna | 2180 |
| OVAT21 | ovarian | 1169 | tucp | 2181 |
| CAT1632 | head_neck | 5529 | lncrna | 2182 |
| HRAT17.3 | heart | 531 | lncrna | 2183 |
| CAT512 | lgg | 12274 | tucp | 2184 |
| CAT512 | kich | 12274 | tucp | 2185 |
| CAT512 | kich | 12274 | tucp | 2186 |
| CAT512 | kirc | 12274 | tucp | 2187 |
| HRAT17.6 | heart | 1647 | lncrna | 2188 |
| KCCAT148.2 | kirc | 7257 | lncrna | 2189 |
| KCCAT148.2 | kirc | 7257 | lncrna | 2190 |
| KCCAT148.3 | kirc | 6805 | lncrna | 2191 |
| PRCAT106 | prostate | 2039 | lncrna | 2192 |
| CAT405.2 | melanoma | 3058 | lncrna | 2193 |
| CAT62.2 | embryonic_stem_cells | 1319 | lncrna | 2194 |
| CAT62.3 | breast | 750 | lncrna | 2195 |
| CAT62.3 | luad | 750 | lncrna | 2196 |
| CAT62.3 | lusc | 750 | lncrna | 2197 |
| CAT62.4 | breast | 1508 | lncrna | 2198 |

TABLE 2-continued

| func_name_final | tissue | transcript_length | tcat | SEQ ID NO |
|---|---|---|---|---|
| CAT62.4 | luad | 1508 | lncrna | 2199 |
| CAT62.4 | lusc | 1508 | lncrna | 2200 |
| CAT62.5 | embryonic_stem_cells | 1024 | lncrna | 2201 |
| CAT749.2 | kirc | 2368 | lncrna | 2202 |
| CAT749.2 | medulloblastoma | 2368 | lncrna | 2203 |
| CAT749.2 | stomach | 2368 | lncrna | 2204 |
| CAT749.2 | prostate | 2368 | lncrna | 2205 |
| UTAT7 | uterine | 465 | lncrna | 2206 |
| MIR205HG.10 | lusc | 2112 | lncrna | 2207 |
| MIR205HG.10 | breast | 2112 | lncrna | 2208 |
| MIR205HG.11 | lusc | 1994 | lncrna | 2209 |
| MIR205HG.11 | prostate | 1994 | lncrna | 2210 |
| GATA3-AS1.6 | breast | 2672 | lncrna | 2211 |
| GATA3-AS1.6 | breast | 2672 | lncrna | 2212 |
| GATA3-AS1.6 | kirc | 2672 | lncrna | 2213 |
| ESAT42.4 | embryonic_stem_cells | 960 | lncrna | 2214 |
| TINCR.2 | lusc | 5928 | tucp | 2215 |
| ESAT42.1 | embryonic_stem_cells | 957 | lncrna | 2216 |
| CAT1710.2 | heart | 1269 | tucp | 2217 |
| CAT1710.2 | uterine | 1269 | tucp | 2218 |
| PXN-AS1 | embryonic_stem_cells | 707 | lncrna | 2219 |
| OVAT175 | ovarian | 993 | lncrna | 2220 |
| CAT1115.3 | lusc | 3501 | lncrna | 2221 |
| CAT1115.4 | colorectal | 2839 | lncrna | 2222 |
| CAT1115.4 | uterine | 2839 | lncrna | 2223 |
| ESAT54.5 | embryonic_stem_cells | 6980 | lncrna | 2224 |
| ESAT8.2 | embryonic_stem_cells | 3913 | lncrna | 2225 |
| KCCAT192 | kirc | 15256 | lncrna | 2226 |
| LVCAT7 | liver | 1843 | lncrna | 2227 |
| CAT82 | cervical | 912 | lncrna | 2228 |
| CAT82 | lgg | 912 | lncrna | 2229 |
| CAT82 | medulloblastoma | 912 | lncrna | 2230 |
| PRCAT71 | prostate | 1039 | lncrna | 2231 |
| PRCAT71 | prostate | 1039 | lncrna | 2232 |
| THCAT39.10 | thyroid | 1098 | lncrna | 2233 |
| THCAT39.10 | thyroid | 1098 | lncrna | 2234 |
| THCAT36.5 | thyroid | 1421 | lncrna | 2235 |
| CAT62.6 | melanoma | 693 | lncrna | 2236 |
| LINC00511.7 | thyroid | 3816 | lncrna | 2237 |
| LINC00511.7 | luad | 3816 | lncrna | 2238 |
| LINC00511.8 | luad | 4626 | lncrna | 2239 |
| LINC00511.8 | lusc | 4626 | lncrna | 2240 |
| CAT1193 | kirc | 3537 | lncrna | 2241 |
| CAT1193 | heart | 3537 | lncrna | 2242 |
| LINC00035 | thyroid | 745 | tucp | 2243 |
| LINC00035 | kirp | 745 | tucp | 2244 |
| LINC00035 | head_neck | 745 | tucp | 2245 |
| LACAT16.2 | luad | 10365 | lncrna | 2246 |
| LACAT16.3 | luad | 6960 | lncrna | 2247 |
| CAT1508 | colorectal | 1081 | lncrna | 2248 |
| CAT1508 | uterine | 1081 | lncrna | 2249 |
| CAT1508 | breast | 1081 | lncrna | 2250 |
| CAT1508 | luad | 1081 | lncrna | 2251 |
| CAT1508 | lusc | 1081 | lncrna | 2252 |
| CAT1508 | lgg | 1081 | lncrna | 2253 |
| CAT76.2 | thyroid | 2232 | lncrna | 2254 |
| CAT1383.2 | kirc | 1109 | lncrna | 2255 |
| CAT1383.2 | breast | 1109 | lncrna | 2256 |
| CAT1383.3 | kirc | 3577 | lncrna | 2257 |
| CAT1383.3 | breast | 3577 | lncrna | 2258 |
| CAT1383.3 | breast | 3577 | lncrna | 2259 |
| CAT147.2 | head_neck | 1660 | lncrna | 2260 |
| CAT147.2 | prostate | 1660 | lncrna | 2261 |
| CAT147.2 | breast | 1660 | lncrna | 2262 |
| CAT147.2 | luad | 1660 | lncrna | 2263 |
| CAT147.2 | medulloblastoma | 1660 | lncrna | 2264 |
| ESAT24.2 | embryonic_stem_cells | 2847 | lncrna | 2265 |
| ESAT24.1 | embryonic_stem_cells | 373 | lncrna | 2266 |
| OVAT114.5 | ovarian | 6360 | lncrna | 2267 |
| OVAT114.1 | ovarian | 4598 | lncrna | 2268 |
| WT1-AS.8 | ovarian | 10131 | lncrna | 2269 |
| WT1-AS.9 | ovarian | 9999 | lncrna | 2270 |
| WT1-AS.10 | ovarian | 10357 | lncrna | 2271 |
| WT1-AS.11 | ovarian | 7286 | lncrna | 2272 |
| WT1-AS.11 | kich | 7286 | lncrna | 2273 |
| CAT669 | luad | 678 | lncrna | 2274 |
| CAT669 | lusc | 678 | lncrna | 2275 |
| ESAT15.1 | embryonic_stem_cells | 368 | lncrna | 2276 |

TABLE 2-continued

| func_name_final | tissue | transcript_length | tcat | SEQ ID NO |
|---|---|---|---|---|
| LBX2-AS1.3 | thyroid | 2478 | tucp | 2277 |
| LBX2-AS1.3 | head_neck | 2478 | tucp | 2278 |
| THCAT36.3 | thyroid | 3966 | lncrna | 2279 |
| THCAT36.3 | thyroid | 3966 | lncrna | 2280 |
| THCAT36.2 | thyroid | 1552 | lncrna | 2281 |
| THCAT36.2 | thyroid | 1552 | lncrna | 2282 |
| THCAT36.8 | thyroid | 1668 | lncrna | 2283 |
| THCAT36.8 | thyroid | 1668 | lncrna | 2284 |
| LINC00511.9 | luad | 3918 | lncrna | 2285 |
| LINC00511.9 | lusc | 3918 | lncrna | 2286 |
| LINC00511.10 | thyroid | 3907 | lncrna | 2287 |
| LINC00511.10 | breast | 3907 | lncrna | 2288 |
| LINC00511.10 | luad | 3907 | lncrna | 2289 |
| LINC00511.10 | lusc | 3907 | lncrna | 2290 |
| LINC00511.11 | lusc | 7803 | lncrna | 2291 |
| CAT249.3 | embryonic_stem_cells | 1097 | lncrna | 2292 |
| BRCAT431.1 | breast | 1250 | lncrna | 2293 |
| BRCAT431.1 | breast | 1250 | lncrna | 2294 |
| BRCAT431.2 | breast | 1804 | lncrna | 2295 |
| BRCAT431.2 | breast | 1804 | lncrna | 2296 |
| BRCAT431.3 | breast | 1333 | lncrna | 2297 |
| BRCAT431.3 | breast | 1333 | lncrna | 2298 |
| BRCAT431.4 | breast | 2359 | lncrna | 2299 |
| BRCAT431.4 | breast | 2359 | lncrna | 2300 |
| HICLINC62.1 | NA | 970 | lncrna | 2301 |
| HICLINC62.2 | NA | 680 | Lncrna | 2302 |
| HICLINC62.3 | NA | 796 | lncrna | 2303 |
| HICLINC62.4 | NA | 1273 | lncrna | 2304 |
| HICLINC62.5 | NA | 1220 | lncrna | 2305 |
| HICLINC62.6 | NA | 1941 | lncrna | 2306 |
| HICLINC62.7 | NA | 2041 | lncrna | 2307 |
| HICLINC62.8 | NA | 2043 | lncrna | 2308 |
| HICLINC62.9 | NA | 2100 | lncrna | 2309 |

All publications, patents, patent applications and accession numbers mentioned in the above specification are herein incorporated by reference in their entirety. Although the disclosure has been described in connection with specific embodiments, it should be understood that the disclosure as claimed should not be unduly limited to such specific embodiments. Indeed, various modifications and variations of the described compositions and methods of the disclosure will be apparent to those of ordinary skill in the art and are intended to be within the scope of the following claims.

SEQUENCE LISTING (2309 sequences)

SEQ ID NO: 1 - DNA, 1425 bp, Homo sapiens
ggagacgcaccaggggcgcgtggccccgcagcacggccagtacctggggccaggcaggagaagggagcatggctctttggggtggctgcagcagcctggcccctccagcggctgcacgggaaagaaggaaagctccgtaaggctgaccgggaaagaagcgaggagctctgggggctgggtggaaagtcccgtactcatcagggccagggaggccacagaaactacctcacgccagcttcccaggggtacagcggctagaatggacctcgaggaggcccctcccaagactcccgtctcccgggttccaccgcagtgggggcagccacagctgcctctgcaatgcttgtaggacccacacacagtggggcacggaggggcagaggccgcagcccctttgccatgaatccaaagaacctggagtgattctgcagagacgttcgaaccagagcgactccatcttgaacaggggctgggtaaaatgaggccgagaccggctgggccgcattccctggaggtcaggcattcttagtcacaggatgagatcagcacaagatacagatcacaaagaccccgctgataaaacaggatgccgtgaagaagccggccccaaaccaccaaaaccaagacagccagtcctcactgctcattatgtgctgattataatacattagcatgagacacgcccaccagcaccaggaccatttacagttgccatggcaatgccgggaagttaccctagatggtctaaaagggggaagaaccctcacttccgggaattgcctgcccctttcccggaaaagtccggaataatccacaccatgtttagtacatatcaagaaacaacaataagtgttctcgtcggagtagcccaggccgctgctcagcctatggggcagcccttctcttattcctttactttcctattaaacttgctttcagtttactccgtggactcccccgaattcttccttgtgtggggtccaagaaccctctctcggggtctggatcgggacctccttttccgatgacagtccctgggacttagtagcagttcagcagtgtttgttgaatgaataagcgagagacctggttggggggcacttagaaagcagaggttttgcaactttttaaaactttttatttgtatttttgagacggagtctcactctgtcactcaggctggagtgcagtggtgtgatctcagctcacttggaaccaccatctgccagtttcaagtgattctcctgcctcagcctcccaagtagctgggattataggcacccaccgccatgaccggctaatttttgtatttttagtaaagacagggtttcaccatgttggccaggctggtctcctgacctcaagtgatccgccttccacaggttcccaaaatgctgggattacaggcgcccaccaccatgcctg

SEQ ID NO: 2 - DNA, 2622 bp, Homo sapiens
agcagcgtgtggcccagggcagcggcctcgtgcagcgcggtgcgccccgcccggtccaccgcgcccaccggggcccctcgctgcagcaggagacgcaccaggggcgcgtggccccgcagcacggccagaaggaaagctccgtaaggctgaccgggaaagaagcgaggagctctgggggctgggtggaaagtcccgtactcatcagggccagggaggccacagaaactacctcacgccagcttcccaggggtacagcggctagaatggacctcgaggaggcccctcccaagactcccgtctcccgggttccaccgcagtgggggcagccacagctgcctctgcaatgcttgtaggacccacacacagtggggcacggaggggcagaggccgcagcccctttgccatgaatccaaagaacctggagtgattctgcagagacgttcgaaccagagcgactccatcttgaacaggggctgggtaaaatgaggccgagaccggctgggccgcattccctggaggtcaggcattcttagtcacaggatgagatcagcacaagatacagatcacaaagaccccgctgataaaacaggatgccgtgaagaagccggccccaaaccaccaaaaccaagacagccagtcctcactgctcattatgtgctgattataatacattagcatgagacacgcccaccagcaccaggaccatttacagttgccatggcaatgccgggaagttaccctagatggtctaaaagggggaagaaccctcacttccgggaattgcctgcccctttcccggaaaagtccggaataatccacaccatgtttagtacatatcaagaaacaacaataagtgttctcgtcggagtagcccaggccgctgctcagcctatggggcagcccttctcttattcctttactttcctattaaacttgctttcagtttactccgtggactcccccgaattcttccttgtgtggggtccaagaaccctctctcggggtctggatcgggacctccttttccgatgacagtccctgggacttagtagcagttcagcagtgtttgttgaatgaataagcgagagacctggttggggggcacttagaaagcagaggttttgcaactttttaaaactttttatttgtatttttgagacggagtctcactctgtcactcaggctggagtgcagtggtgtgatctcagctcacttggaaccaccatctgccagtttcaagtgattctcctgcctcagcctcccaagtagctgggattataggcacccaccgccatgaccggctaatttttgtatttttagtaaagacagggtttcaccatgttggccaggctggtctcctgacctcaagtgatccgccttccacaggttcccaaaatgctgggattacaggcgcccaccaccatgcctggctaacttttttttttttttttttttttttgagatggattctcgctctgttgcccaggctggagtgcaatggtttgatctcggctcactgcaacctcctcctcccgggttcaaacaattctcctgtctcagcttcccgagtagcaggtactacaggcacgtgtcaacaggcccagctaagttttgtattttttttttttttaagacaggaggtttcaccatactggtcaggctggtctcgaactcctgacatcaggtgatacacccgcctcagcctcccaaagtgcgggattacaggcatgagacaccgtgcccggcctgatttttgtatttgtagcagagacggggtttcaccaaattggccaggctggtctcaagctcctgacctcaagtgatccacccgcctcagcctcccaaaatgctgggattacaggtgtgagccaccgtgcccagcgctgtagggacactgcagggaggcctctgctgccctgctagatgtcacacgccacatggtaccactctccttcttgttcacaagtctgaaggaagtaggtgagctggagaggcctggaaggtgttggaagggatggagcccactagaaggcctcacagggaacggctcagctcacagacacctactcctgtcaattaattatgaacacggagctggaggctgaagtgggaggactgatcgagtccaggaggtcaaggctgccgtagccgtgattgaaccactgtactgcggcctgcgtgacagagtgagaccctgtctcaaaaaaaagtcagagtcgggagtaacgttcagagaaaatgcttggggttttggatgggaaaagttttgcccctgactagaaatgatgggctgggcgccgtggctcacgcctgcaatcccagcactttgggaggccaaggtgggcggatcacaaggtcaagagatcgagaccatcctggctaacacagtgaaaccccgtctctacttaaaaaaaaatacaaaaatttgctggtcgcggtggtgagcgcctgtagtcctagctactagggaagttgaggcaggacaatcacttgaaccaggtatgcagaggttgcagtgagccgagatcgtgccactgcactccagccctggtgacagagtgagactgtctccaaaaaaaaaaaaaaaatgatggaacacaggttcttgtcctggaaaatctg

SEQ ID NO: 3 - DNA, 2156 bp, Homo sapiens
cacgccctcccatctctccctccttcctgccgtcccccgcctgagggaggggagcggtgcagcagacatccgagggcagctgggaccccctgactcagccgacgggtgagtcaggctccctgcaggccacaccggacccccccagggcggggatttccccaagatgagaaatcagccaccggaagtcacgccggaccttggacgggcagacagaggctgggaggagttctgggtgcagagccccccaacctgtgctctcatctcttgctctggggtaagccagtggccatgctataaggacactcaagccaccctatgaagaagcccacatgaagaggaactgagatatctggccaacagccagccagtcactgagcctgccaaccacgctgtggcaggtacctccagccccagacacctgcagcctccactgaaagctcaatggcagcctcatgagaccctggaccggaaccacccaacgaagcggctcctgtattcctgattgacagaaactacgggatcataaatgcttgctgttcagtctgccaagtgttggcgtgatttgttaaacagcaaccagtaactaatacgccacccatggctgccgcgttcctgctgtggggccagcactattccatgcttagaggctccatcaatacctgtgatggactaaatggtcagtacaaacaacagctcctctgtaatggtatgaggcagacaggtttctaaaggcaatatgctaaggtgcaaactcaaccccaaaagaccacatagtgtatcatcccatttatatgaaatgtccagaacaggcaaatccatagagacagaaagcagattagtggttgccagaggctgagagatggaagaaaagtagagagtaactgctaatggtgtgaaatctctttttggagtgatgaaaatgttttaattttttttttttaatagagacagggtctcactatattgcccaggctggtcttgaacttctaggctcaagtgagttcagcctcagcctcccaaagtgcttggattacagacatgagccaccatgcacagcttaaaatttatgatgctgatggttgcataactgtgaatatactaaaaaccactgaggcggggtttggtgactgacacctgtaatcctagcactttgggaggccgaggtgggaggatcacttgacaccaagagtttgaaaccagcctaggcaacatagcaagactccatctctacaaaaaatttaaaaataaaaataaaaaccattaggccaggcatgatggctcatgcctgtaatcctagcactttgggatgccaatgcgggtggatcacctgaggttaagagttcgagaccaggctggccaacatggtgaaaccccatctctactaaaaatacataaagtagcccggtgtggtggtgggcgcctgtaatcccagctactcgggaggctgaaacagaaggatcacttgaacccgggaggcagaggttgcaatgagccgagatcacgccactgcacttcagcctgtgtgacaggagtgaaactccatctcaaaaataaaaacgaaaacaataacaacaacagcaacaaaaaaccattgcattgtgcacattaaatgaattgtatggtatgtgaattctagctcaataaagcttcttatgctaaaacatgacgaggaagaagaggaggaggagaagaggcaaagtcactggtgcccaaggaatggcaccaggagtggtctccaggaaggctggccacctgtagggctgggagagctctgtgatgctgacatcaggggccttcttcatgcctgagaaacaggacatgggctaagggcggctaaccaaggcctgggagaatattgagaggtaaacaggcgatgtgggtgtggggcgctcagcctacttggccaaagggtgagttcttgctaatttcacagggagagcctgactggtctcaagcacctgaggcccagcatgagaagtcaacatccctgacttctcatcctctatagaaatttcccccagaccaggcgcggtggctcacgcctgtaatcccagcactttggcaggccaaggtgggcggatcacctgaagtcaggagttcaagaccagcctggccaacaccgtgaaaccccgtctctactaaaaatacaaaaatta

SEQ ID NO: 4 - DNA, 2156 bp, Homo sapiens; identical to SEQ ID NO: 3

SEQ ID NO: 5 - DNA, 996 bp, Homo sapiens
cccacgccctcccatctctccctccttcctgccgtcccccgcctgagggaggggagcggtgcagcagacatccgagggcagctgggaccccctgactcagccgacgggtgagtcaggctccctgcaggccacaccggacccccccagggcggggatttccccaagatgagaaatcagccaccggaagtcacgccggaccttggacgggcagacagaggctgggaggagttctgggtgcagagccccccaacctgtgctctcatctcttgctctggggtaagccagtggccatgctataaggacactcaagccaccctatgaagaagcccacatgaagaggaactgagatatctggccaacagccagccagtcactgagcctgccaaccacgctgtggcaggtacctccagccccagacacctgcagcctccactgaaagctcaatggcagcctcatgagaccctggaccggaaccacccaacgaagcggctcctgtattcctgattgacagaaactacgggatcataaatgcttgctgttcagtctgccaagtgttggcgtgatttgttaaacagcaaccagtaactaatacgccacccatggctgccgcgttcctgctgtggggccagcactattccatgcttagaggctccatcaatacctgtgatggactaaatggcacggtggctcacacctataatctcaccactttgggaggccgaagtgggaagattgcttgagcccagaagttggagaccagcctgggcaacacagcaagacccctgtctctaccgaaaatgaaaaaaattagctgggcatggcagtgtgcacttgggagctactcaggaggctgaagcgggaggatcacttgagctcaggagttcaaggctgcattgagctatgatggcaccactgcagtccagcctaggagacagagctagaccctgtctctaaaaataaataaataaataatctcggcatttctcatcctaattg

SEQ ID NO: 6 - DNA, 996 bp, Homo sapiens; identical to SEQ ID NO: 5

SEQ ID NO: 7 - DNA, 372 bp, Homo sapiens
gcgcagaggaggccagggcctagggtgcagccagggcccaagatatatttttagttgaaatatggagccacagcaacactttgacttttcctcttcagaagatgagacaggccggggtcatcattgttacaaaagcaaggcctgtgatcgtgacaaggacaggctggggcagagaccacacactcaaccaggctgacctggagagagacccttccaaaggcagtggagtggagggcatgggcctccgatgagagaactccagagctggccgggacctactgtgctggcagcagacaggtggaccctcaggcccagagccggcagcagaggggggtgaatccatggcaacaggagtcacaggtgaaccaatgg

SEQ ID NO: 8 - DNA, 372 bp, Homo sapiens; identical to SEQ ID NO: 7

SEQ ID NO: 9 - DNA, 6340 bp, Homo sapiens
attggatcatgggaatagtttcctctatgctgttctcatgatagtgagggagctctcacgtgatctgatggttttataagtgttcggtagttccttctaagttcattctccttcctgctgccttgtgaagaaggtgccttgcttccccttctccttctgccatgatggtaagtttcctgaggcctcctcagccatgtgtaactgtgagtcaattaaacttctttcctttataaattactcagtctctaatatttctctatagcaatgtgagaaaggactaagacaaagggcatccatttctcttcagctaatgatgtaaaaaaaaagactgtattgacatggctgaactctcaggaccctcagttatttagggatggactagatggctggtatcatcgcttacaaaagtgtcttgtaacttgatgaagtttatgttgagaaataaaatatatatatttgtgtatatgtgtgtgtgtgtatgtgtgtgtgtgtgtatatatggagagagggagaaagacgcagtcttgctctgttgcccaggctgaagtgcagtggtgcgatctccactcactgcaaactccacctcccaggttcaagtgattctcctgcctcagtctcccgagtagctgggatcccaggcatgcaccaccatgccagataatttttgtatttttagtagagatggggtctcatcctgttggacaggctggtctcgaactcctgacgtcaagtgatctgcccgcctcggcctcccacagtgctgggaatacaggagtgagccactgtgcctggcctatattttttattttcatcctttaattccattttccaccacctttttgaagtccccttgtatattaccacagtcacgtatattaccaatcgtgtatggtaccacagacatgtagagtaccacggtcatgaatattactacgaacgcaaggaagccatcagcatccagttcagaagccacaggaatctaagcctgagtgaaggatgtgagtctgtgcccaccctgcaccctcttgcctcctccctgctccccagcaccctggaaagcctggacaaaggaatgacatcactgctggaggatcctgctgaagtcatgctgagaagggctgccttcttttaattttcaagtgttggttgatcgatgctggtgtcctcttttcctcctgccccctgcccctgcccctgcctgtgtcattgccctcactgacttcatgacaatgactcacagaatcaaagggtagaagggacctaggaggttgtccagaacctaacctcccccagtgcagaaatctcgacaccatgtttgcttaaagagcaacctgttccaaagggcaggaaggtgttcctcttgcagggcccaggtctgcattttcgagccctccccacgggcctagcatgggcctccagaaccatctagaacaggtcccatgcctctgtggtactggaatgcagctgataccctctcttgcctcttaagcagtcaactatactcccatggatttgccacccaacctaagtcatggcttctagcccttgtcacccagcctgctccctggataccttccagttggtcaagggccctgtcaaagtgctggcccacatggacacaataccccagaagtcgtttgacaaagtaggactgaaaagcatctccttcattctaagcaccagcacaattatctgattttattcagaggggttaagcactactgccattagaagcctgcttgttggtgccaactcatccttccacagtgttaggagatttttcagtctggggatggtggtcactccaagaacactaagtgtcacaaggagagaaccttgtttatgaggttccctgccgcatctccaaggcctagtttgctgaatcaatgaacagagccaacatagtcacgattcctcagagccgtgtcaccctgaagctggttgtcacttcctcacctaagttaccagcaagaaagatcaggatctggctgggagcagggctgcccagcagagccctgagggctgggtgccagctgcctcccaccccctccaacagtggcaccccggactgcctagattctccattaccctcagcccagacacttccatcttgacagtaaaagatatcagaggaggccctcagcatcctccaaaactctagtgcaatgctgacagcattccctgagctctgggaagctctcaaagaaggtggcgaagcaagtctgggtgatatttttggaggaggcatggaaacctggcggcctcctagcaggtcccccacccctggcctgacacctccaccacctgcctgtcacagcagccaggggatcctgctaaggcttgggtgagggcatgatgcttgagtcgtggggccagctaggtctacctgtcctacatgggaacctgtctccctcagttcttcctccccactcactcactgcttcagccacactggccacctcttggtcctcagacactccactctctcctcagagcccttgccctgtcctcttcctggaatgctactgctcccttcccaccatgccctcgcctccttcaggtctttcctcgtgtctccttctcagtgtggccttccttataccctacctagaatctcaggccctcgcattcccatccttcttgcctcattggttttctcctcattgcttataatgacaattcaatgttctgttttatttatttatttattttttgagacagagtctcccactgttgctcaggctggagtgcagtggcatgatctctgctcactgcaacctccgcctcccaggttcaagcaattctcgtgcctcagactcccaagtagctgggattataagtgcgctctaccatgcccagcaattttttttttttttttgtattattagtagagaaggagggtttcaccatgttgggtcaagctggtcttgaactcctgacctcaagtgttccgcctgccttagcctcctaaagtgctgggattacaggcatgagaatgtactgttctactgatcttgctttttatctgtctctcttactaaaatgccagctctcactacatgggtggggattttcatctgctttgctccctgcatgccttcagtgcccagaacagtgcctggcatatagtaggtgctcagtaaatgtgctgaatgtatgaataagtgaataaatgaatgagttcccaccaaccattcattcatttgctaacccggcactttcttgttgagaatctaggcatgtgctcattttcagattctaagatctcactcatttcaggggtgccacagcaatgagcacacatttgggcatgctagtgtctaaatagactcacttttctcatttccaatgggcttcaatggtttcgtaatcctcgtggttcatctgaataatatgtttgaaatgtttcaagtatcttatggacttatatttttggattgtgtctcctgaagacaacggtgagcacagccttataaaattctgggtgtgttcatgcttttgtccaaggataagggagaacgtgtagggtgtgggacccatcccgcactgatgctcaaaactgtggtaggatatcgctggtagtggcaggttaagacaagggcttttgttacagcgattgtgacaaccagatacacttcctggttagaaaggacacctcataaatacagccgagatcactttctcaaggcagacggcctcggcaaataccaagatggaaatgaaccagagaaagtaactgcaaagatacagagatcagaagggcttggaagggatctgtgcagccataaacaagtgcgcttcatctgaaaagatggaagctcagaagagcttgaagtcgaaatgagaattagcagaagggctgggtgcactgaaaatgaacttgactcagagtcagtattgctagatggaggaggcattcctgaaagcccaaatagaaaagttggtgaatttagaagaaaaaaaccaggaaattttgtttgacatgctagtcagggaatttgggtcccttattcctttagaagcgacagtttggaaatactaacgtcttctgcaagagctgaaataaatccatggcagacagctacctgttgagggagttttgaatgggtgtggggctctgcggagctggggcacagcacatcttccaactctgagttgcttctttttcatttggtggcatctgatgactagcaaaggctgagatcagtgatggggacaaatgctttcttcacctggaagtctcctgcttgcaattcagggaagcctggcaatccgttgctttcttgggttgactgatgtgtaagacgagaatttttgagcgtgccgggatcttagggatcattgtaacccctctcattttataggtgtgcttctcagctgcaacctggagaaggtagtaacttttccagggtcaagaacccagtcttggctgggtgtggaagctcatacctgtaatcccagcactttggaaggtcaagaaggaaggattgcttgagcccaagagttcgagactaacctaagcaacatagggagactcccgtctctatttttaaaataaataaataaataaataaataaaagctcagtctctggcctcctgcacaagtgagcaagactgcaggggggcgtggtcccagaggtagacacctttgttcccccaagggaagggcctgggggagtaagaaggagatgtttgtttattcatgagacaggctcatttgtaaggtcagttgtgaccgatgctctaagcagaaacacttccagatgtcacaggtaggacaggtagcctacctgcctgctttcaggctgcacagagtgaggatgggagagatgggccactgctctctccctgtaaattggttagtgcagctgttttggcctgatgactctagggacccacagatgacctgtctggacccttctcttctctttctctttttttctattctcaccagtactgacctgactcagagtctgaggtgtaaactccctgcttacctccctatcccacaatacaatgttttcttgcttccctttcctcttccctcccgcaattccagccaggtagagcttttgatcaggtggtttcttgtacctagatttcccttgtcacaccccttctggttgaaacacttgaccttcttcaaggctcagtcgaatgctccttccttcatgaaacctttcatgagcacctgctataaattaactgctcctctgtgcttccactgtgtagcatctcccaaacttcacgcccatccagaacttcagaatgtcacctcatttggaaagagagtttttggagctataactagttaaggatcttgagatgcaatcacattggatttagtgtgtgccctgaatccaataactagtgtccttataagaagatgatgggggtgggcacggtggctcacacctgtaatccgagcacttcgggaggctgaggcaggtggatcacctgaggttgggagttcgagaccagcctgaccaacatggagaaaccccatctctactaaaaatacaaaatgagttgggcatggtggcacgcacgcctgtaatcccagctactcggaaggctgagacaggagaatcgcttgaatctgggaggcggaggttgcagtgagccaagatcacgccattgcactccagcctgggcaataagagcaaaactctgtttcaaaaaaaaaaaaaggagatgacgggacgtagacacacacagcaaggaaggccatgggatgatgaaaggagagactggagccatgcttccataagccaaggagcatcaggagccaccaggagctggaagagatgacgaaggatcttcccgtagtcttttgagtggagaggaacccagaaccctgctgatgccttgatttcagacttctggcctccagaaccacaagagaatacattttgttgtagtaagccgtcaagtttgtcctaattggtcatggtaaccacaggaagcacatacagatggtgacttgtgccttcactgtaagcacctggccacactctaggtctttattcatctttgctacattttcttacaggcccagagctgtgccaaacaccgaacagataccccagggctggctggagacagcctggcctgcctccctctcctgatggctctggtcaccgcgtttcagggtgggggtgaatagccagtcagccagccaccgatcccaaaggagcggatcaactctgaacctgccaaaaaagacagtccggtgcccgggaaatttacaaggtgaaaccgactagctcagcactcgtgggtggcgcggagaagtggggtggccggcgactctcagctcccgggcgcgggatcccgcag

SEQ ID NO: 10 - DNA, 6340 bp, Homo sapiens; identical to SEQ ID NO: 9

SEQ ID NO: 11 - DNA, 369 bp, Homo sapiens
ggatggtcagggtgggcttcacggagaagctgaccttgcagcagatgcttgagggaggtgagcgagttggccatgtgagtgggtgtctgggtgaagagtgttgtaggcagtgaaacagccagtgcaaaggccctggggcaggagcatgccttgagtgttccagaacagcaagagggcctggaggggtagagcagagcaaccaggaggagaggcagtcagagaggagataggaggtggtagaaaaggcagtcagggagctgatgggaggcagtaggagaggcggtcagggaggtgatgggaggtgggaggagaggcagtcagggaggtgatgggaggtgggaagagaggcagtcagggaggtgatgggag

SEQ ID NO: 12 - DNA, 3914 bp, Homo sapiens
cgcgggtgagcatcctctgagagcttgggtcttgcgtatgtggaaggtcagagacccctctaccctagtttccacttcttggtgtcatgaagaccactggtcttcacgtccgctcccaccctacaggccgccagggagaccagtgccgcccaccatgcgatttcgacgcttgacccctggttacttccgggtgttacagatgcaggtagctggtgagctgaaggcagagccccggagtctgctggcaggagttgtggctacagtgctagctgtcctcggcctgggtggctcctgctatgccgtctggaagatggtgggacagcggcctggaagttagagttggaggcaagttctctttgtccagttcctttatttggggcagggcaccaagaagaggccctccgctccccaaacccagaggcaaaaggggttggcacgctccctcccagcctagtccttgcgtcactgtccatgggcaattcctctgccctgcatcttcaggccatgtcaggtagaggtatccatctcagggacctcagtggacacttccgtgggcactgccagccgcctggggggcacataggatcccatacccgctgccctctccgcctcttcctgactgtagggctcgacgctcagctgcttcagcctgggagaaagaaaaacaggagttgggagctgaccaggtgagagccctatctgctgagcacccatccatcaatcctctccttactccttcataccttttcttgtggtctttggatcggaagtgggtcttcaggttggtggaatcgatgaagtacctcctgtaggaatggaagtgagaaggagagtgaggaggtgatagtctcccaagtgcacctatctccctagccctagcttgtccctgacgccaggatccgggtctgagaaacgggaggcgggcggacccacgggtcccaagagagaagactctgcgctgcctggggcttcaacttcacatctcccggccggtaccgcggaccctcctccgccccaggccgggctcgtccgggactcacgcgcaggccagacagcggtgcagaccgccccctggcaggtcggggtcgaactcggcgtttgggtcgggctggggtcgtgcggatccctgaggccgcagctcgcggtgaatctcatccaagtccggccgccgccgcttcgccttcatctgccgggctagagagtgcgctcggtgcgcgcctgtccggcgggagcgacccatggccagaaacagcccggccggccaaggggccaggagcagggcagggagcacacgtgtgagcacttccgggccgatcagctacgtcaggccacgccggggggctaggcaggctcggccggaccgcctctgatgacgtcactctcggccagcggctcgagcgccgccaggcggccgtcgacgtcagtgaccgagctcaggacgggctcccagaagtgtgcccactgaagggcatggccccgcgggccctcgctggggaggcgcggggtggtgcgtgcgcctgggggtttcggggccgtcttgctgccctgctcttcctggcctggtccaaccagtatcagtgccaacctgtactcctgtcatcccttcctgtttcccagaccttggactccgcggtgggggtgggatgctttatctctggaaagcactgataaatgtctgtgtcatgaataaattagtaaatgactgagagtgaataagtttggaatcccagccccaccagggcttcccgagataatctccagtccctgaaaaagccctcacttctccgggctcccgttattcccttgagtctccatcctctctctgaccccaaccaaatccgtgaagggtgttcctccccagagagtgcagtcctcaggcatccagactccagagggatcagttcctctcacaagtactcatagaaggacctctccatctttgcctcctttctctaagccctgggctcccagaggtgggctggcagcaaaggcctaggtgttgcatgctcagagtggctagagggcctttccccattcacaggagcctggtgcctcccaggctggccagagccaactcagctggaaggggccagaggagcttagcaataattcaggggctccagctctttggagtctgttgccaggaaacaaggagacaggcacgtgtatccctggggagaggaatcagtttccagcccagacaaaggagtgaaatgtaagcccaaggtgcccactgggggcctgcggaccttcctgctccagttcattgaggctaagtagggacacagggtggagccctgctgaggacacaactagtatgactacagtcacaggggctccagtgtgggtcccagacctcaggattttgtgaatggaagaagattttcctggaggcatgctaagagatgaacaactcaagtactcctaggcccaggaagaaagcctctctagagacaaatgacttcattattcttggccaatatgggtcaagacaaggggctaaggtggcagaagcttgttccatcccccactccccgactcctttggatcaggttcacctcctgggcactgtgccagctggggaggctggtgcatctttaatgaagtcactggatccctcggacaggctcttggcctcaccaagttcctagagccagactcactggtatccactgagccaccaccttcctgtgcttgcgtgccaggccccttccccctgcagccatgaaccaggccttctggaaaacctacaagtccaaagtgctacagaccctgagtggggaatctgaagaagacctggcagaggagagggagaacccagcattagtggggtctgagacagcagaaccgaccgaggagaccttcaatcccatgtcacagctggcccgccgggttcagggggtcggggtgaaaggctggctgacaatgtcatctctgtttaacaaagaagatgaagataagctgctgccatcagagccttgcgctgaccagttcccccggccccactaaactcctccgtcagcccagccgatgttcctccgcgggaccgcccggccgcttccctgaccgcggccctctcccgcagccctctggcggcgcgacccccctcgcaggcggcggcggcggcggaggcgcgcggcccgggcttctgggacgcgttcgccagcaggtggcagcagcagcaggccgcggcggcgtccatgctgcgcggcaccgagcccactccggagccggaccccgaacccgcggacgaggccgcggaggaggccgcagagcgccccgagtcgcaggaggccgagccggtggccggcttcaagtggggcttcctcactcacaaactggccgagatgagggtgaaggctgcgcccaagggtgactagcaggctggcagaaccccgcgcccgctgctcccacccctgataaaaaaccctggcccgacagcctgtgtgaccgcgtgcttttgtccagacatccagaaagactgcttttgcgggggtcgacctcgggcggggtccagctggaggggtcctcacctcatcaaacatacaaggcgaaaatgaccagagtcagcccgcatatcaggatgggttttttatttaaggtacaactttccaggaagttggagagctccagaggactgcgtccatcgccctctccagcctcatttaattcaacaaactgtgcctgtggccctactatgtgcgccgtccctgtactaggaaaaaggtcaaagattaactagagaacccagagtaccagcgggtcccacaaaaggtgacaaattgaggcccaaaaataggactgtacttgggagctcagagcaggtgaggctgactgggggcattcaggacggcttcctggaggagaatatacgttatctccgagaaggaagaagggggccgggcgcggtggct

SEQ ID NO: 13 - DNA, 1478 bp, Homo sapiens
ccggcagtagtacctactttttaaagtgtaagcaaggaaagttggcccgcacctgtagtcccatctacctgggaggctgaggtggaagaattgcttgagcccagttggtcgaggctgcaatgagccttgatcacgccactgcactccagcctgggcaacagaacaagaccctgtctcaaacaaaaaagtgtatgtaagaataaaaattaatagattaggcacaggatgggtgtttaattctcggcaatcaccactaagttttcatactgaggcttattcattccatgggcaaaacattgcgctatgtgtggtgcctggggtgggctccaaattccagtcctctcctcgcttgcgatagctgtgtgatccattcctaagtttccttatttgtccacagagcgtacacagggtttttatgaaaactagatcagataatcagacacagttaaaatagcacgcgctcagtaaaattacatattagtggaagagacaagccttgaataaatcgcctttcggggagtatgaccccctccccgaaacccactcaggcgctgctcgctcgcacgcccactgagctcggagcggagcccgagccctttcccagcacacagggttcatttccagactgaaagacatcccagagacaactccagaggccaaggcgggtcggcttcctgcgtgggcccagcgccgggcactgaaagcgccctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcagatgaagactcttaagatgacagaaggtgatttttctggtgatcgaggacttccggggtaatgacagtgatgaaatgcaggggacctggttgcccccaagtttcctggcagtgtgtgatactgaggagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtatatttgtgtttgtatttttttgtagagaccgaactggtctctt

SEQ ID NO: 14 - DNA, 1478 bp, Homo sapiens; identical to SEQ ID NO: 13

SEQ ID NO: 15 - DNA, 2738 bp, Homo sapiens
ttcgccgtgttagccaggatggtctcgatctcctgacctcgtgatccacccgccttggcctcccaaagtgctgggattacaggcgtgagtaaccgcacccggcagtagtacctactttttaaagtgtaagcaaggaaagttggcccgcacctgtagtcccatctacctgggaggctgaggtggaagaattgcttgagcccagttggtcgaggctgcaatgagccttgatcacgccactgcactccagcctgggcaacagaacaagaccctgtctcaaacaaaaaagtgtatgtaagaataaaaattaatagattaggcacaggatgggtgtttaattctcggcaatcaccactaagttttcatactgaggcttattcattccatgggcaaaacattgcgctatgtgtggtgcctggggtgggctccaaattccagtcctctcctcgcttgcgatagctgtgtgatccattcctaagtttccttatttgtccacagagcgtacacagggtttttatgaaaactagatcagataatcagacacagttaaaatagcacgcgctcagtaaaattacatattagtggaagagacaagccttgaataaatcgcctttcggggagtatgaccccctccccgaaacccactcaggcgctgctcgctcgcacgcccactgagctcggagcggagcccgagccctttcccagcacacagggttcatttccagactgaaagacatcccagagacaactccagaggccaaggcgggtcggcttcctgcgtgggcccagcgccgggcactgaaaggtgaaggcgcttcttccgctcggaggaaagcctctggcggttctcgcttcgcgggctcgggatggacacgcgcgtagggctggggaggtgacgcgcggacaacgccggggcgagcaaactacaactcccaggcagctgtgcgccacgcgggcggcctactgtcgggtgtggccgcgaggggcggcctatataagctcttgctcgcggcttcagcgccctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcaggtagtaatgatggacagatgaagactcttaagatgacagaaggtgatttttctggtgatcgaggacttccggggtaatgacagtgatgaaatgcaggggacctggtaggtttcttttggagactaactgggggctgcctggtgggacagaacagcatgtttccaagggctgtggctggtcatagccatgggatctccaactgcatgcaagagcaacctggaaagactttgacagcgcaggtcagtacaatacctgcaagctgccactcagctttcctataatgtttcaggaccagggctggaagccttccatgtgtcaacttcaatgtagatgggtttttttttttttttttttttgagacggagtcttgctctgtcacccaggctgctggagtgcagtggcatgatctcggctcatggcaacctctgcctcctgggttcaagcgactctcctacctcatcctcccgagtagctgggattacaggtgcccaccatcacacccagctaattttcttgtatttttagtagagatggttttcaccatgttggctagatgggtctcgaacttctgacctcgggtgatccgcccgactcggcctccccttccaaagtgctgggattacaggcatgagccaccgctcctggccagtttagttttcacgctaagctttttgttctgcaggttgcccccaagtttcctggcagtgtgtgatactgaggaggtgagcttgtttctggagctgtgctttaaggtaaagttgatcagcttaatcctcctgatccctttcccatcggatctgaacactggtcttggtggtcgtaaaaggaggaaaagtaatagtgaagctggcctaaatgttgtaatctggtatatggcatgtgggctagtttcagacaggtttcagagatggttggatctctgaaattgtaaaatgaagtataatcttaggctaagggaaggatgcgtgtgaagctctggaggttggtatagtaatagctgacctattactgcatttgggagggatctgtcatagcttccttgcctcttaattaagggtggtgtttttttcttttagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtatatttgtgtttgtatttttttgtagagaccgaactggtctctt

SEQ ID NO: 16 - DNA, 1508 bp, Homo sapiens
ccggcagtagtacctactttttaaagtgtaagcaaggaaagttggcccgcacctgtagtcccatctacctgggaggctgaggtggaagaattgcttgagcccagttggtcgaggctgcaatgagccttgatcacgccactgcactccagcctgggcaacagaacaagaccctgtctcaaacaaaaaagtgtatgtaagaataaaaattaatagattaggcacaggatgggtgtttaattctcggcaatcaccactaagttttcatactgaggcttattcattccatgggcaaaacattgcgctatgtgtggtgcctggggtgggctccaaattccagtcctctcctcgcttgcgatagctgtgtgatccattcctaagtttccttatttgtccacagagcgtacacagggtttttatgaaaactagatcagataatcagacacagttaaaatagcacgcgctcagtaaaattacatattagtggaagagacaagccttgaataaatcgcctttcggggagtatgaccccctccccgaaacccactcaggcgctgctcgctcgcacgcccactgagctcggagcggagcccgagccctttcccagcacacagggttcatttccagactgaaagacatcccagagacaactccagaggccaaggcgggtcggcttcctgcgtgggcccagcgccgggcactgaaagcgccctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcagatgaagactcttaagatgacagaaggtgatttttctggtgatcgaggacttccggggtaatgacagtgatgaaatgcaggggacctggttgcccccaagtttcctggcagtgtgtgatactgaggaggtgagcttgtttctggagctgtgctttaagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtatatttgtgtttgtatttttttgtagagaccgaactggtctctt

SEQ ID NO: 17 - DNA, 1508 bp, Homo sapiens; identical to SEQ ID NO: 16

SEQ ID NO: 18 - DNA, 2241 bp, Homo sapiens
ccagtccagcaggggccagggagaccatcttttgaaccttccccaaccaggggctggaccctgctgtgtctggaagcccttccttggggagcagcacagccagcaacagacttgagtgagtgacctccagacctggggaaaggagaggggagacaggaagagcccaaaggcctgcggggaagaactgtgttcagcttagctgcagcagatctggagcctacatcccaggaagggcttcttcacagtgagatggggcccatgagatgctgggaaaagtaagtaggaaggtggggctgtctcggaagatttgagctctgcgggatcaaggcttatctggctgaggctggggtatggattgtttgacctgaagactctacagactcaaagtctacctcattgtctcaggacatggagccccaaaaggccaagcgctttgctcaggagtgggcaaagcgcccactgccaacctcgctgctttcctgagccacgccgtggagggtgtccatgcacagaggccgagctcggccccccgtggctgtggcgaaacatccctccctcctctctgaggtgacatttacagtcaagtgtgtgtaggtcctgactctgtcctgctgcctgggtcaaatgtggctgtccctggagtttctcttcaggggtgcctaccttgagaggcagtgtggtgtggtggttaggggccaggtttctgaagccatgttgtgcttcacacaacgtgtgaacagagtgaagcccagttctgctgttgactgactgtgtgactttggacaagtcatttgccttcttcctccctcagattcttcttctatgagatggacagtctagtctaatagtaccattctcatagggtgatgagactacaagaattcatctaggtaaagcttttagaacaatggctggcatgcagttcatgatatccaagcgtgagctattactgtcattgtactcacatttgcctggctgggtgaggagttcccttctgagatgtgcctgcctctactgggtgactgtgtcaaccgtgcctggtctggtcaccaagtgagcagaggcagggtctggtatggggactaggcactcacctgggccccccaaagggcgcagcctggtgggcaggggctggaaggcaggcaggggcagcaggaccatccccatgtgctccacagaggccagcccgtggcgctgcctatcattgaggtatgagtagagcaggcggcagttctgggtgtcccgggccccatgtgggcacagtctgaccacgcagacgtcctgcggtggcaggaggagagcagctgtaagcgcagtcatcctctgctcctgccaacacccctgggctccctgaaacccctgagaaccccgtgagaaagtatgtctccatcttccagaggaggaaacagagggacctgtccagggtcacacagtgagtctgcagtcactctgggaactagacccagatatccaagccaggcctctgctctagaagtggagagggaggtgggagtaaggtactaggaaaagagggggtgcccaagagtgggcaggtaccttggccttggctgggcagatgctggccagaaggtcccagacaatgttggaggggatgcagcctgccgagcggatcacggtgggcagagcctaggggcaggaaggatggccagtcagctccccagcttcccacccactcagggtggacgcattcccagccacctggaaggctgcagcctgtggcaaatatgggcaggcagtgttccaggaccctcagtggctgcccagaaagctctaattgccccatggaggtctgcagcctgtactggctaatctacaacttctccaaagcccctccctccctcctctatcctctgctctcatccgacactttagctgatcattaagtcactcaacgatcactcctaaaaccctcctttgggcccttcttgctatgggtgacagggagtccttcaccctgtttgtctctgtaggaatgggaccaacatctcatttgcccccatgccctgcacagggccaggcacagaaaggggtgcccatgaattgttttagaatgcatgagtgaaagagagagagagagagaggctgcctgggctggtcagtgtgtaagggaatccctggcgaggagggcaggtgcacctggacaagccgacagctgtgtcccgagaccagctgggccctggcccggaaccgcttgatggagaacatgtccagaacaccttc

SEQ ID NO: 19 - DNA, 2241 bp, Homo sapiens; identical to SEQ ID NO: 18

SEQ ID NO: 20 - DNA, 496 bp, Homo sapiens
gacgtgtctgcctggggaaccaggagccctttggtattacttgcaggtagaagacttcactgaggttgagcaggatgcagatggcagctgtggtcaccatgaagtaggtgaagaccttcttctccgtgggccgggagatgtaacagtccacagtgtgggggcaaggctccacggagcaggccaccacgcggggcatgtcataatccttgtagaggcggtggaagatatagaggaagccagcatccacggcggccttgaagatgaggctcagcaagtacgtccaccacagtccgccccgcttcttgctcaggttgtcgtacagggacggggcattgggcccgtgtttcaggtggtgcttgcgctcgcgttcctcgcggtaggccacgtgcatgaccacgagcagtgaggggcacgtgaccaggatgagctgtagggcccagaggcgcacgtgggacacggggaagaactcgtcatagcagacgttggggcagccggg

SEQ ID NO: 21 - DNA, 496 bp, Homo sapiens; identical to SEQ ID NO: 20

SEQ ID NO: 22 - DNA, 496 bp, Homo sapiens; identical to SEQ ID NO: 20

SEQ ID NO: 23 - DNA, 2421 bp, Homo sapiens
gacgcggaagcgggcaaggggcggggccgtcccgggagaccgccccgggggcggggctgcctcgccccttcctgctccgctcctcgcgtcgcggccccgcccccgcggccgctgcgcgccggacggggcccaagcgggggtcggagcctcaaggctgcggcggcgacgagctccgagcgggacactgaacggcccgtatgcgcaagataagcacggactgaatcaggtacacgcacctgccggggacgcactgaccgaggtgcggacggcggtaccaggacaggtaaagccgcgaacactcggacctaagaacttgacaggtacaccctgcctgatgaagctacgtacggccaggtgcgcatcgagtgaatcagagacgaagtttcgccatgttgcccaggctgatctcaagctcttgggctcaagcaatccacctgccttggcctcccgaagtgctgggattacagggtgagaacctacttcttcataaagagaatttggagggagctttttgttctgcggggacaacatctggatttgaatacatccatgctcaaaaggagatttctcataatggacccaactgaaagcactcagagtacaaggaccggtgagctttcaaaaggagacacttcgggagactcgccaggggccctcgtatccccggcagcgcgagttttggaggtcagtggagggctctcgcatcatgcatgtaactttcatactcaaaaacttaccttcatcctgcatccctcacccccctgcagaaacttggggcttgaattcatttaaaaacatttgcggtttcagaagccttctttttattatgaagctgccaaggagatcttagaatgaaaggcatttttagagatgagaaagaaggaagccaggccaaggctgggccggctctcagccgtgggtctgtaaaggtgacacgtgggacatggccacctgcagaccctgcaggcggctgggcagaggcacccacagggacctgggtttgaatccctgctctgccagtcatttccacagcgatcttgggggaagttgtgtaacctctgggccctgcgacgccctttcctggagcctggagctggaacgaagccccttggagccctgacatcagaggtgacgttagtcttcgcaggcaatgactcggcggaatgtgatgccactccctaacccgtgtccggactggcagagtgtgtgccgcctcccaccaggtggtctggctgctttgatggatctcctaacttctctgcaccccagagccctcagtgctggccagaccttcactcactcctgggtgacaaccccgttctcagatagtgggtcccacaggctggcctgtggcgccccctgctggtgactgcagggagaaggatgccctaagccaaaggaagtccttcctggggtctaatctctaccttttgcatgatgaggcagctgaggtggctcgctttctcctccaccccagaaaataaagtcatatggagtccaagcagttatttttctctgctaggccagtccatcataagccccaaatggaggggcccctggaatgagccctatgcaggccttctatggacaagggcccttcagggagtagggctgtggatctgggaattctgccttggtggccgaagcagaagtcactgccctcctaatgccactcatcggaccacacaacactttcaccgccagtccttgtgtgatttgatctttgcaaatcagagatagtactgttaataatttccctgcaggaaagaggaagttaaggatatgaggaattgccgtcaggatcagaggtaaggcccggaatcccaacagactcccattcccagcaccttccgggcacccgccttcgaggcctttcccctccctgccgctttataatgctaattgagggaatgagtttccttggcctgagagtgggctagggctggggctgggacccagggcttaggcaatcccaagggtctggaaaggaaaacaggtcaggagtagaaccctttcccaacaccatgggccagctcccaggccccatcttgggcgtgggggatttggagtaggatgaccatataattagtcatccagattaggatacgtttgggaatgaaagggagtgtcattaaaagttaccctagggcggccgggcgcggaggctcacgcctgtaatcccagcactttgggaggctgaggcaggtggatccagaggtcagcagttcgagaccagcctggccaacatagtgaaaccccatctctactaaaaatacaaaaattaggctggtggctcacgcctgtaatccctgcactttgggaggccgaggcgggtggatcacctgaggtcaggagtttgagaccagcctggccaacatgatgaaaccccatctctaccaaaaaattagcctgatgtggtgg

SEQ ID NO: 24 - DNA, 2956 bp, Homo sapiens
tttcaaagaacatttaatcacagaaactttcaaaatattttgtacattgaatagatccgatcaccaagcagtgcatagagtaggatcctaactttgtaaaatatccatatgtcatatataaagaaagacaaatgtatatgtgccaagtaagaagactggaaggaattatgaacagtggttatctctgtgattgattatgggtgtttgtattctggtttttgttattttcaaaattttccccagcacacagataacattttcttacgtgagaaaaaattttttttaaaaagcagggggtggagagcggcaactgtttgctcaagacttttcagtaaggaaaggaacctggggtagaaagctcccccttcagctgcccatgagggcacaggtgggccccacactcactacggggccagggcagggccgcacacctgccacttcctcagcagagaccctagcgcgtgggtcactgctggcccagactccttccacgagcaggcgagtgtgcagggccacacctcatccaagagatgatcacgtttaggtttttgatgaaaagcatagctctcaggtaaatacagcagcacctctaagcatattctgggaggagtgggttttatgaggaaggcacacaaggaacgcccaaatttgcaagtccctttaaaatgagcctgctcagaattgctgtttattccacaggtctgcgcaggcatggcactaagtgtcccatggcacatttggccctcatggaggcctcaaaagggcaggaccagcaccctcttctacggaggaaggaacgggcacagcaggtacatgatgtggtcaaattaacaagaggcagaggccgggtaagtggctcacgcctgtaatcctagcactttgggaggctgaggcaggaggattgcttgagctcaggagttcaagactggcctgggcaaagtttaagaccggcctgggcaacatagtgagacctggtttctataaaaaatttaaaaattagctgggtatggtggcgtgtgcctgtcatcccagcaactcgggctgaagtgggaggattgcttgagcccagcaggttgaggctgcagtgagccatgacactgccactgcactccagcctgggcgacaaagcaagaccatgtatgtctttaaaaaaaaaaaaaaaaaggcagccaggacctgatgccaggtcgacttggctccaaaacctgccctctccttttcacagcctcctttcctgtgaaataatagggaatttctctaaagcgcatcgcccggtccctatgtaaagacaaagaaacaggactttgcacgctcacctggcattagggccagcactgtgctgcagttgtgaagatggccactgggttgggggttgttctgcaccaaatggccccagactccctgtcagtggctacttgttgcagccagtgggcctgagctgaccacccttatttatgctcctgatgtgcagccttgaatgcatcctgggctgtgggaggcaaccaggccagaagatgaccttgatagctgagcactgacccttcatcagctgtgtgtccttacgacctcctccctttctgaggccttctgtatgtgatgtcatttggtgggtggctaaagttgctagaagtctggccaccaggaaggccacgactgtcacactttgtgctttgctgcataaaaagggagtctcatcatgatcctcaggcctgctgtgcacacctgatgggcatagcagcgtttgcgtcttgaaaacattcatttcacaaactcctagcacacccaaaccatgccaggttacacactgggcactgaagagaccacacatttgtcagtttccgaaactctactgcccagtattggaagaagagagctgttaaatcaggtcctgcaatggcagataggccccaagtcctatggcagcagggggctcaggccatgtctcaagctctgggagaaggtcatgggggcagatgggttctctgggttggaagagcctttggaattaaagagtcctatgtcctcatgttgcagatgagaaactgaagcgtgaataagaaaggggacttgtcctgacaccaagtcagtggctgagttggaaccagaatacctgtctcctaacactcaggccattgcctcttccaatctctgctagctgagcttgaagccttagactagtggggaactcaccatcttccagacagcctgggcccaccctttatgtacatgagagggtctcttcctctgcgcttgcacatggaggccctccctggtccaggtggaggggctgctgtcccgcagtgtggccccagcctccacccctgctgctggaccagctctccccaggcccctccctgggggtgcagcacgtgaactccagagaggcgcatccttgggcccatggggaggtggaaccactctgccaggctgtgcctgtggatggggcgggcccaggatctgcttttaatgacacggtttgggcagctggactctgtctgttccagcaggtaaattacaggcttagcaagtcagaaatcaaataaacactccaactcccagtggctgttccaaggagaacagcggtttccgggaacagtggaggccgagacaaacctccccacccaactcagcctaattactgcctgtcactccctgggacagggaccttttctttgactcacagacccaagacacaggacagcgctggtgggcacccagggtgacgccaattttggtggccagcttgttcataactcctagacacaagcaaacactggcagtccccacccttgccccatgcctggccggagactgccagtcaccctgctttggatggaatggattgctctgcagtggggcaggagggggaactgaggtcttattgacaatgcctggtggtggctgtctgcagttctgtgctgaggcctggaggccctgtcctggttcagtgggaaag

SEQ ID NO: 25 - DNA, 2956 bp, Homo sapiens; identical to SEQ ID NO: 24

SEQ ID NO: 26 - DNA, 2956 bp, Homo sapiens; identical to SEQ ID NO: 24

SEQ ID NO: 27 - DNA, 2956 bp, Homo sapiens; identical to SEQ ID NO: 24

SEQ ID NO: 28 - DNA, 2956 bp, Homo sapiens; identical to SEQ ID NO: 24

SEQ ID NO: 29 - DNA, 2956 bp, Homo sapiens; identical to SEQ ID NO: 24

SEQ ID NO: 30 - DNA, 3336 bp, Homo sapiens
ccgagaatcaattacaaccaaaataaaagagcctttaataggtattgttaagtacccccaactactattaacctttaggaaatcactagctgggtacacctgtccaatattaaacctgtttcttatgagtccctgtaggagtaaaaggaggacatcatgacctacacttgtgaacttgtagcaggatgagccgcagacaaaacctctcagacaccgagttgtagaaggaagggctttattcagctgggagcatcggcaagctactgccttaaaatccgaactccccaagagagcaattcctgtcccttttaagggctcacaactctaaggatttcacatgaaagggtcgtgattgatttggagcaagcaaggggtacgtgacaggggctgcatgcaccggtggtcagagagaaacagaacagggcagggagtttcacaatgttcttctgcacaatgtctggaatctatgaataacatcggtttttaagttatgagttgatttttaactactgggtttaggccaggcaggcccaggcttggtttcgggcctggcgctgggctgcctgtctttggttttacttccttgttttttttttttttttttcttaaaataggtactgagtataaaacaatataaaacaatatgagaaggtctctctctcccctcatttcccccctttgagactctcactttctattagtgggagttctgacttttatttttgctacttatgtctttttgtgcaatagattgatagtgatttatatagtacacttgtgctaaagcattttggtgaactaagatagtgatgaagctttttatcatttgaagaagtacaggtagcaaacaaggaagcagtaaacaggttcttattactattataaattctattataagagttttaaatccttctagtgctgggaactaatttttaaacatggcttcaggatcgaattcatgctacacttgcatgggcacatgtgtcagttttgtcatatttttaactatgtctttaactacttgcctttgattatctatgtgtagacagtaattagtaaggttaaatttcttatagacctctctttcagctgctagcaagtagttgagagccaatctattttgatagatagcatttcttatctgagtttcttgctgggccagaatagtcaaggcttgactggttttactagtgatgatttctaaaacagcttgcagctgtatgattcagttgagcatgtaagtgggggtccagtatccccatgagccgtcttgtgtctaagtggcaggcctatagtattatataatttttttttgaaggtcatttatcatctttccaatttcctatggctatgcttcattttccgcgggaagcatagacagggaagcccaggagtttgcctgtttttatggtcagtagaaagaaagatggtttaatagtgccaataacacaactacctgtccactggtcaggcagcttagcttaagctctatgtctacgtattcagtataacttggtgggggcagtccagtcccggtggaattccaggtgggcccagacagtctgcaaccttggaaatttactgaatggatctctttctatataattggaacttcaccatgtaactgtttttttgcggtaccattatacagttcttggcccaaacaactaagacatcctatagaatgagtgaattctttcttttttctagctatgtaatattgtccaataattgagacttttagaacctagagatgatcagggtgattcttgtgggccaggaattcatcaggaactgcgtctgtaggcactaattcttgggctttttatggccattgagctcttattacagttttttcacaaacataacatgaagtgacatttagagactgggctacacgctcggctaattgcaaaaacaaatttctggtttttcctggagtctcttggtactggcaaatttagttcatcatagaaagtctgaaatactggttccagagagagtttacaaaactcctcttttactaagatatttgctgtaggacctagtcttttcctattgatgcccagagatacgtgttctccttttttctaccttgggtttaagggatttgtaattattaatttcaaggggttccaatgtccactcgtataggaggggctgcattctcctttttggagctaaacaggatctttttcatcctttttctaagtagtctagatgacacaagaccagtaattacacacatttgcacatgagcttaattcatggcagatatacttatttcctgccgtgtaaactttttttttttcaacttaaagaactgcatcttattttatgccaattactattgatagtggcacaagcattaaattttagggttatatgcttggagacccctctttcttctgtcctagctattactttacttgtgtcgcctagaaaaggaccagtcattaattttattttaaaaactgatcatgggaggcttaaaatgggtcataacacgcatcaggttggttatttcctgggctacataccttggatagaattgcattatacaaacaacttttagagtcctggtacacttataataaccataaaataataagactttagcaatcttttgtccctcagtgacttgatgtatatactgggaacagccctcagtcttaggaaggtcagttgaagtccttacaatacaagtccaaattttaaggaaaatgagtcccctgctatgagtttcctcatgcttcagctgtgtgtggaccagtcagcttccgggtatgactggagcagggcttgtcgtcttcttcagagtcactttgcaggggttggcgaagctgctcccatccgcgtacagctcccagtctactgctgtttaaggatggtctcggagtttgggcccactagaataaactgatttcagatgtccggactccaagtgccagttccttcctggtgttcagccactgtgttaatcctctgtgggggcctgctacatgctgctctggcgacgcgttccactggggcaattgcctacccgggagcactctttggatcgcgtcactcaagctgtctggagtcccccacagggacgctccacagggcaggtttaagccggccgtcagtcacctcgcttcccggtcagggaaccaagaaatgtagcaggacaagccgcagacaaaaacctctcagacaccgagttgtagaaggaagggctttattcatctgggagcatcggcaagctactgccttaaaatccgaactccccgagtgagcaattcctgtcccttttaagggctcacaactctaaggatttcacatgaaagggtc

SEQ ID NO: 31 - DNA, 3336 bp, Homo sapiens; identical to SEQ ID NO: 30

SEQ ID NO: 32 - DNA, 1816 bp, Homo sapiens
ccagcacattgagcaaccggcttccttcctgccccgggtcaggagctgggccagggaaagtgaagaaacctgtttggggcctcggcagggtgggcgtgggtggggccctgccgggaaaagaggcgcctagaccagttagtttcctttgctccaggaccggatgcggagccgggactcaggtggaggcaggagaaatacgcaccctgggtgcacctacgaaagtgggaagacggtgcctaccccaaagcgtcgtgggaatgaaagtcaatgaagtgacataggaaaggtgcctagcacatggcagattcctatcaggcgaaggccgcctttcctggcctcccccacaggcccgccagcgattcgtccttacaaggctagcctccacgggctgccctctgtgtaaataaagccacagacttccgcccacaggtcgccgcaggtcccgcccgcagcgccgggccgcgggggaggcgggaactggtgctacggccgctacgcaggcctcgggaggctcggagcccgccacgccccagccctctcgcagggccggggagccacggggccaaaaggaggagcaggtggaagaaatccaggctcagaccgtcggagtccccacccatgagcacccttctccactgatcactcagaacatggtaggccctagagagacagcagcccgaatcttcccagaaaccctgcaggagattccttcttcccattttatagaagggaggctgaggctcggcacgttgaaatggcttgaccaaggtcccacaggcaaaaaaatggtacagcaagatattgtaacccaatatctggctgcaaaacccagtctctccccaacccacctatcgtcaccgagattgtaaaacttctaaccgggaagaatcaaatacatgcacaacgggttacaggttaacagacagatgggagcggaaagggacattccagcgcttccctgggcgtgtcgcacagggcaactccaaccacaggcgaattttcctgggtgacagttaaactcctttttgcatgaaaaaatacagattcttattaaaacaataatcgattagactataaaactctcaaagttatttcggatcaaaattattttcggctgtttccacacctttttttctcgattgtgcagaaattcttcacaccgtctgcacagatgggcaaactgagacccggacgagtcccattgagagagagaggcagagccggggttgggagaagactgagatttctgggatccggcttggggtgtttccgctgggtgggggcgccggtttgcgaagagctttcctcggacagctactgctgatttttgtcgctcagccagccaagtgggggcgattctgagtaatcgcaggcaatcagcgcggctggggttaaaagcgaaagggactcgcgggcgaacggccggggagggcggcgggcacagagcccagacgccggcaaaggcggggcgccgccggggttccctcggtgcgagcgcgcgcggcacttcctgcttttgctcctccctgcggtcctgccggccgttgtaaactggcgctgcgggccacacccgtgttccaggcccgctaacccaccggcggccccagagccccaggcggccccagagacccagcctcaatcctcagtcctcgtacagtcctcaggtccaagttctggccataggaacgccagccagatctgcagctcagctagctgaatttcaggttccagagacctggcccttttcttccatgtaggggacagtcaggttctctggcctgggttttctaaaagtacccagagttgaactaccttc

SEQ ID NO: 33 - DNA, 2148 bp, Homo sapiens
ctggcactcagtaaatgtttgtgaataaattcctcctgtcattgtctgaattttctgcccatgctgtcctcttggccaagagatctaaaagcaaacgagctggggcttctggaaagtcttccaaggtcagtggatgcatgtgtgatggaggcccagcaagaggtcagtgtgttgccctggggcaagcctgcaggatggacccagagggctggggtggccggcttcatccagctcatttttcccaagggatctggcgctcacaggctgcacatagagcccacgtgttgtgttgcgtgaggacccctaaggatttgttgagtggtcctaggtgctcaagtcactgtacctgcagggtggcttgagctgggcccacctgactgattggctggtcaataggtggcctgagaaccaaaactagcctccagcacattgagcaaccggcttccttcctgccccgggtcaggagctgggccagggaaagtgaagaaacctgtttggggcctcggcagggtgggcgtgggtggggccctgccgggaaaagaggcgcctagaccagttagtttcctttgctccaggaccggatgcggagccgggactcaggtggaggcaggagaaatacgcaccctgggtgcacctattcctatcaggcgaaggccgcctttcctggcctcccccacaggcccgccagcgattcgtccttacaaggctagcctccacgggctgccctctgtgtaaataaagccacagacttccgcccacaggtcgccgcaggtcccgcccgcagcgccgggccgcgggggaggcgggaactggtgctacggccgctacgcaggcctcgggaggctcggagcccgccacgccccagccctctcgcagggccggggagccacggggccaaaaggaggagcaggtggaagaaatccaggctcagaccgtcggagtccccacccatgagcacccttctccactgatcactcagaacatggtaggccctagagagacagcagcccgaatcttcccagaaaccctgcaggagattccttcttcccattttatagaagggaggctgaggctcggcacgttgaaatggcttgaccaaggtcccacaggcaaaaaaatggtacagcaagatattgtaacccaatatctggctgcaaaacccagtctctccccaacccacctatcgtcaccgagattgtaaaacttctaaccgggaagaatcaaatacatgcacaacgggttacaggttaacagacagatgggagcggaaagggacattccagcgcttccctgggcgtgtcgcacagggcaactccaaccacaggcgaattttcctgggtgacagttaaactcctttttgcatgaaaaaatacagattcttattaaaacaataatcgattagactataaaactctcaaagttatttcggatcaaaattattttcggctgtttccacacctttttttctcgattgtgcagaaattcttcacaccgtctgcacagatgggcaaactgagacccggacgagtcccattgagagagagaggcagagccggggttgggagaagactgagatttctgggatccggcttggggtgtttccgctgggtgggggcgccggtttgcgaagagctttcctcggacagctactgctgatttttgtcgctcagccagccaagtgggggcgattctgagtaatcgcaggcaatcagcgcggctggggttaaaagcgaaagggactcgcgggcgaacggccggggagggcggcgggcacagagcccagacgccggcaaaggcggggcgccgccggggttccctcggtgcgagcgcgcgcggcacttcctgcttttgctcctccctgcggtcctgccggccgttgtaaactggcgctgcgggccacacccgtgttccaggcccgctaacccaccggcggccccagagccccaggcggccccagagacccagcctcaatcctcagtcctcgtacagtcctcaggtccaagttctggccataggaacgccagccagatctgcagctcagctagctgaatttcaggttccagagacctggcccttttcttccatgtaggggacagtcaggttctctggcctgggttttctaaaagtacccagagttgaactaccttc

SEQ ID NO: 34 - DNA, 2148 bp, Homo sapiens; identical to SEQ ID NO: 33

SEQ ID NO: 35 - DNA, 580 bp, Homo sapiens
gtcagcttcttctgcgggctctgcaggatggccatggtgatgagcgcgatgtacgagtgtggacaaatcctccaagatttaacttccaagaaaaccggcggcggagcgggtggaggaggcgaggatgtgtggccaatgcacgcggagtgcaaggccgcctagttgggagccgcaagagcctgcctggtgtggcaggcacacggaacccaatccctgtctgtccgctgcggcctgggaggggagcgccggcctcaccagaggaaggagcacgaggggaggagttccgagaggaaataattagtgaaatatttgcagaagatgctgggatgtggatttaattccggatggacagtggtgcttctgattccctcagtctgtttccccacccacgatctcctctttccttggcctagacacaccaaaaataattcaataaaataaaaataaaaatttaaaaatctgtaaacttgcttcattacaggcattgagacacacagattgactttcatccccattagacagtttcccaggatataacactactcatctgaggctgggagcagggtagggggtggtgaca

SEQ ID NO: 36 - DNA, 580 bp, Homo sapiens; identical to SEQ ID NO: 35

SEQ ID NO: 37 - DNA, 1714 bp, Homo sapiens
gtgggcagctcattctgcaggtccatgcaaccgatcacgtggtccagttcagaaggggctggcacccccatgaagccagccacactcccatgggggtgggaatatggagacatgcatggggaggggatgccctctggagacacaaggcaggggcctccagggctcccagatcctggactggcccacagggagttctgcagctgaaaagagagggaaagaaggcccatgagcctgtagcctcaggagctgacttccctacccaggggctttctctttgtccttggggccccagaaactttccaggaaacctccacttggctcagatctaccccctctcacccccaacactggcagtggcatctcaggaggcccctgccactgttctcaaaacgaaattttcttctgtgattcctttgtgttccgcatgcgtcattcatgagacaggcaagagccccggtttgcagagaaagaagtgaagtggtgtacccactgtcatacagaacgctgacgctctccaggtttcttcaggccagacctcatattctttttggtgaccctgccaggtcctggttcaggtagggctggggtcttacctgagggtggctgtcagtacggggcagcacagagatgtcataggcagccgtgaaggggttccgcccctcctggatcttcccataacgctcgcgcttccgccacttggctctgcggttctggaaccagacctgggggcaggttgtgggggtttgagggggtgatagggcagccctgaggaaaggagcctgctagggagagctgatggttgtgtcctcttgtgggatggggagcaggctccaggatggaggatctcaactgttaatccacactgttctccaggccagggaagcctgggaggaagcctgggagaggcccaagcccacagtgggtaattggccccatgggcctccagctgtcactccccaggttgaatcactgtggtcctccagcctggctgtgtctagtaagggtgttgtgggggcatctgtgggcctcaggggccctaggtacttcctgggtatactgtgtacatgtgttgggtttctagtctccctgcctcatctccttttccaggctacccacctcatagcatccgaggaatcttagacatttctgttcaggtcatggtcctgtttaaaccctcagtgactccctggagaccttggtccagagcatagcttcttaacaaggcccctgcctctctgcacagcctcatatcctgccaggcaaacacatttattcttctggttgcctcccaagctcccgcccagctcttctgaaacactgctatcttgctccttccatcttttgcttaggttttctcttcctgggctactcatcccctcaacacatacatccacactgggcatcctccacaggacttccaaaataccctggacctctctttgtactcaccccattccattaccatgatctgttttggaatctgtttctcccatttatttgtgagcccttggcagataggggtggcacatctgtgtgttgtgcacatctgtgtacatatctgtgatgaattcgttgtttggtatatgtgctgtgactgttacatttaactgtattggtatatatgttttgtatttctatcatttaatcaacatttatgtgtcagcctctaagctaaatttaacaatgtcaaaataaaaccaaccaaacaaaacaa

SEQ ID NO: 38 - DNA, 853 bp, Homo sapiens
ttccgctcaagttcctccgccgcgacctcaggacaggccgaagaggcgcgcactactcacgtgtcttccaagtgctgctccaaggtcgcctccatcccacccaccgaccactccggctcagaacccagcggcacggcacgtccttctccaccacaggcctcagtcacttgacgcgagcggggcgtggaccgtaacggcgcctccaaagggacaaaattgatcacggtgcaacgtccgcgttctttactggaaaacatcactgcgcttccgtcgcacagagcctgacgaaggcttgggctccccgcgcggtgaccgtcgaggtgacctgcacctggctccatggcggaaccggccggcacggattattcccctctcgggagaggtctgcagccgggcctcagtgcttcagttcgtggcctggcattttgtgaagagtgtcttcatctctgcatccctagtgcaacagagcatgacaaaaattcaacaaatatttattgaagagtcttgatgtcttttgggaaaggaactctatggttacctttactctaagttaaaaacaacaacaacaacaacaaaaacacaaaaccctgaggctcagaagataaatatttgctgaagatcactgtgcttattagatgggtgttactgattcttacctcagagaagagaatgtcatggagacaaaatgacctgcttagagttctgcaccccccagcatggagagcagagcgcaaagatttcttccggactcccacattccccttggaatccaagaactggtctactgtcacaacactttagtaccctcttctcccaaggaggcagcagaaactggggtaatcacaacggtcaa

SEQ ID NO: 39 - DNA, 853 bp, Homo sapiens; identical to SEQ ID NO: 38

SEQ ID NO: 40 - DNA, 853 bp, Homo sapiens; identical to SEQ ID NO: 38

SEQ ID NO: 41 - DNA, 1082 bp, Homo sapiens
gctggagtgcagtggcgcgatctcggctcatcgcaacctccatctcccgggttcaagcaattctctgcctcagcctcccgagtggctgggattacagaagcagtatctgactgtgttgcccaggctggtcttgaactcctggtctcaaatgattctcctgctttggcctcctaaagtgctgggattacagcaacgcgaatgaaatttggtgccatcactcggatcaggggacctcccttgggagatcaatcccctgtcctcctgctctttgctccatgagaaagatccacctacgatctctgctcctcagaccaaccagcccaaggaacatctcaccaattttaaatcggatcttctcagcttagcggctgaagactgatgctgccagatgactttggaagccccctggaccatcacagatgcccagctttggataactcttacagtggaggaagacaggaatatcaggtctctgagcccaagctaagccatcatatcccctgtgacctgcatgtatgcatccagatggcctgaagtaactgaagaatcacaaaagaagtgaaaatggcgcgtgcctgccttaactgatgacattaccttgtgaaattccttctcctggctcatcctggctcaaaagctcccccactgagcaccttgtgacccccactcctgcctaacagagaacaatcccctttgactgtaatttcccactacctacccaaatcctataaaacggccccacccctatctccattcactgactctttttggactcagcccacctgcacccaggtgaaataaacagccttgttgctcacacagaacctgtttggtggtctcttcacacggcgagtgaaatttagtattgtaccaatggtaaattgacaaatgtaccacgtttatataagattaacagcagaggaggccgggggcggtggctcatgcctgtaatcccagcactttgggaggccgagatgggcggatcacgaggtcaggagatcaagaccatcctggctaacacagtgaaaccctgtctctactaaaaatacgaaaaaaaattagctgggcgtggtggtgggcac

SEQ ID NO: 42 - DNA, 1336 bp, Homo sapiens
tcaaatgctgcccagtccccgctcctcagtcgcttccctctactacgcgcccgcatctccccccgacccctcagggtcaggcctctcggtggcttttcctttttctcttccagaaactaaggggtgagaccgacgtttgtgtgccggacgcgtgcaggtggcggcgacgctcccgggagacgcggggggagaaccagtctgtgcgcgcggctgtgagaagccccgaccaagctttccacgcgcttgtttcgggcagcagaggacgcgagggccgactgcgtccccagtgcgcaggctcggccgggggcgcgtaatcaggcagcccagcggtcccttcaaaccgaggcagggaagctctacgtcttgggggccgcatggtgccgagagcgcagaccagacccgccccgcctctccgtgccacgcacgcgctcggctccgcgcttaatgcaacgcgaatgaaatttggtgccatcactcggatcaggggacctcccttgggagatcaatcccctgtcctcctgctctttgctccatgagaaagatccacctacgatctctgctcctcagaccaaccagcccaaggaacatctcaccaattttaaatcggatcttctcagcttagcggctgaagactgatgctgccagatgactttggaagccccctggaccatcacagatgcccagctttggataactcttacagtggaggacaggaatatcaggtctctgagcccaagctaagccatcatatcccctgtgacctgcatgtatgcatccagatggcctgaagtaactgaagaatcacaaaagaagtgaaaatggcgcgtgcctgccttaactgatgacattaccttgtgaaattccttctcctggctcatcctggctcaaaagctcccccactgagcaccttgtgacccccactcctgcctaacagagaacaatcccctttgactgtaatttcccactacctacccaaatcctataaaacggccccacccctatctccattcactgactctttttggactcagcccacctgcacccaggtgaaataaacagccttgttgctcacacagaacctgtttggtggtctcttcacacggcgagtgaaatttagtattgtaccaatggtaaattgacaaatgtaccacgtttatataagattaacagcagaggaggccgggggcggtggctcatgcctgtaatcccagcactttgggaggccgagatgggcggatcacgaggtcaggagatcaagaccatcctggctaacacagtgaaaccctgtctctactaaaaatacgaaaaaaaattagctgggcgtggtggtgggcac

SEQ ID NO: 43 - DNA, 787 bp, Homo sapiens
gagggatggagcctgcagagtctcctggaaccccggcgtcctggtccttgcaggatctccccacccccactccgcattatctccaggcctctcactcccccagcccctcccccatggaggggacgcgacccagtactccctcccgccccggaccctccagatatcgggacaaagaagccccgcggcagccggcgagcgtggctgccgggcactggtgcagcagcggagacgcggaaaaccactcgcagccggagagacacccggacacaaagacctcgtgccagccgcagacccaagtttctcccggagagactgggggtccgcccgcgttcaccgcgagaacacacaaacggacggacagaccgacgcacggacccggggacctcgacactcgctaggaggcaagccctattcctcagccgggcgcccctcgtctcccgctctctccatggacccctctcctggcaaatcgcccgcagagcgagcttggagatgcgagggaaactgaagccccaagggtgccccgtcctgggagcctggctgtctgcggggtcccccgcattccgcagtagtaatacaggagggccgggggcttctaccccaacctccgctccccttcgggtctctcctggctgtgcaagcgatgggccagagggctggacgaggctggctcccaatccagaatcccgagctggggagttctctctaggttctggggctcctgggaccggggctttggggaagggagatcgcaggacggatatccaggaagggagggggccctggg

SEQ ID NO: 44 - DNA, 2848 bp, Homo sapiens
ataatgagaaaacctgaagaggaaggaaaaacagtgttctctttgccttagtattctcaccattcttgaaaatgtcacacacttcagatcgtcagcctcctagacactagaccttgatcattttgtgaatatcactcttcagaacctattcaaacttgttcgtcagacagaggtttcatctgcctgcaggaagtgttcctggacgtaaccaagggtcaggctgcttattctcatggcccaataatgagatgcagatgaactgggaaagaagagagtttatttctgcaaccagcttcagggagaaggccaggaaaatattgccagaccagctcaaaattacaaagttttccaaagctcatgtaccttctaagtctacgtgctccactggcagacagcagagaaggggagaagaggagaagcagctggacattgaagactctggtttgacataagagagaagcagcttcacttcagagggacaacttgacattgggacatcaggggaagaatgccttcttcctactccatcccctttccagctccccctctcactgagagccacttccatcagcaataaaatcccccacatttactatccttgaatttgtgcaacctggtttttcctggacaccagacaagagcttgggatacagaaaactgtcacactaaccatctgccctcatgaaaaggcagagggtccactgagctattaaacactgaagctgtctgcagacagcaaagctaaaagagcactgtaacacactccctctggtgcttcaggggtaacaggtagtcccgtagacaccgccatcaggctacacggagttttgctccttccagtacccaaaagcactcactccagcttctgcacctgctcacctgcatgctccccctcccacgaggggttgaaagctgcgggctgagtaagtgaggcacccctgtcacaaggcttgagaagggatcaaggaaaatttcctgtttcattatgctttgttcatgcctatctctggacaagcaactatggccagggaaaaggggttgtacaatatgttcaggagaagagaagaagctactcttttggccattttgaacaatagccaattcaccacacagcataattaatggtttagaattttttcttcttttatttttttctttctgtagagacagtatctcattgtgttgcccaagctggtctcgaactcttggactcaagcaatcatcctgcctcagcctcccaaagtgctggggttataggcatgagccaacacgccctgcctagaatttcatttctattcattaaaaatacatcaaatggtttttatattacagtaaaatcactatttcaaatgattattccatatattttatgtgcaaaattaagagctgccatattgtctttaaaggcctgcaggtatagaaaggactcactgctttttatgaacacatctctcctattcacacctccaagagttattgcttcttggtaaccctccattaagcgtttgattaagttcaaggtgattagattattaacactttagtcatggtctggttggcttatccccctacccctctccattcttttaatcactgctctattcatccactcaacaaatatttaatgagtgcctattatatgccaattctatagatactaaacataaatagagataaataaagcatgatctctgcatttaagggctataccaaagatgggacatcagacaaataaacagattattataatactgtgtaagggccaagtccccttcatcctctgaaagttcactgaaaatcaactgacaaaaagtagactaatacaagaaaaagcacacattctattaacatgctataggcgtcttacaaaataagatctcttaaaaaggcaaatgattgacccacttatgccatgtcgaggttacagaactaataggtgtctggatcatggcaaaactaattacaggagggggagaagaggaggcctggctagcaaaggtgatcttgttctgtggatgaaacctcacaggcctcagccctcagaaagaatagatggtaaatgtttattttaggcttttaaaggtgtcagactcttggccaatctttcctagatctgacaaagcctggctgcatcaatgtagattctctacagatgcaaatcaccgcctcaacacacagttttacagagctgcttctgtttgcagaccctctgaatgttacaggtagttagacaggcatgagctgggcaggagagggctctcctcaacccaccaggaatgtcaggtgatgattcaacgattagcacattgcttctctacagatgataatttggcagcaggcaccagggagaagcaaaaataacttccaataaaatctcaggtattgggtgaatgagtctagacacgtagattaggagacaaaatggcagagcatgaccttccgggggcagtccaccagaaaagagaagaagacctgagatgtgcctgtgtacaacctcctgaatacactgcgtgtgctcacttcccaagcataaggagggcactccacatgcaggcagcccaccctaagggaagaatcatgggaaagggggacgtgagaagcaggaggtcggccagcctataaagtcctgggatcaaggttaaacaccactcttgacctcgatgcctcgttgggtctcttccaagtgtatttttctttctttcctgttctaaggtctttttaaataaacttccactcctcctctgaaacttgcctttgtctctttttctggctattcccctcagtcgaattctctcttctgaggaggcaagagttgaggttgctgcagacccatatggattcgccaccg

SEQ ID NO: 45 - DNA, 2848 bp, Homo sapiens; identical to SEQ ID NO: 44

SEQ ID NO: 46 - DNA, 2315 bp, Homo sapiens
tgcaatagcactgacacttaaagttaagtgttttcttgcttggtcttagcactctagccaaatggattttgagggcctcctattcatgggtcacagctgcttgactcaaggatttttgcctatgcatgccctgacagtcagatactaactcacttggatgcctgcctctcacactgctctactttatgaagtcaagaccattaataaaatccagtttacagaaaggcctagagaaggttatttctctgaacacttcgctgtacctacttccataacagatgaacttaccagatgtaacagaagcggttcttctgttctcgtggaagatgaagttgtcctttgttttgatgagtcctgaaggacttaaaggaacaggacctagaaagaagaggggcagctttgttggaatttattgctggttctgcacaggccctggcccgggtcccagggacatcagggcccagagacctcacgtggcttgtcctcacctggcttgcctaggtttgaggtgttgctcaagacagagcctttgctgctgcccctgaacactgcctgccagcaccccagcccaccaccctgacctcatcaccccggaaaggagcaagctcatcaaataggacagtgcttggggtcttcgccagtagctagcactggctgctgtttatgagcatctgttatacacaaggcagtggagcattctcacatttaatcctcaacacagtgctatcagagatgggggtcttgttatgtcacccaggctggccttgaacgcttggtctcaagagatcctcctgcctcagcctcctgcgtaactgggactacaggaacataccaccatacccagttactttcaaggatctgaattcaggtctgttagtctccaaataactgtacttttaaccactactccttaagaatttggtcattcaggattaagtttagctgtataaccagaaactccaaataataaaagtttaaattagatacaaatttattttccactcacatgaagaagtccagaggtagtcaagttgtggctagtgaattctattaggggttcaggcatctgcagtgttcttgctttgtcctccttagcacaatgtttccaccactgggtccagagtggcagcctgagctcagcaattccatctgcattccagccagcaggagtaaggatgaggagaaagggcatgtttccttcctttgggggcgttttttagacgatacataccaaacttctacttgcatgtcatttgccataacttagtcaatggccatactagctgcatgggaagctaaaaaatgttacctttgttttgggcagtgaagtgaccagcttaaaattaagaaattgattactaaaaagggaaaaatggttatcaggatacaactagtaagctcaactacaactgttagacctaagtctgcaatgctaagccacatagtaaatgatgaaaagtcaaaagtagagacttgaatatatgatgtaaatttttctaggtcgcaattttatgcatggtttaatgtttcatttttgtccagttgttaaactgtttgctagattaacaatattcatcttgaatgtaaaatgttatagccactatggaagacagtttggtggttcctcaaaaagttaaatctagaattaccctatgacccagcaatttcactcctagatatatacccaagacagctgaaaatatatgttcacacaaaaatgtgtacacaaatattcatagcagcattattcaaaatagacaaaaatgtaaacagcccaaatgtccagtaatgatgcatggataaacaaaatgtggtcggtccatacaatgaaatattcagcaataaaaaggaatgaagtactgatacatgctaagacacaaatggaccttgaaagcattatgctaagtgaaagaggccagacataatggccacatattgtatgattccatttacatgaaatgtctagaatagggaaatccacagagacagaaagtagagtagcgattgccagggaatggtgggaaggaggcacaagggtgaggtttctgtttggaatgataaaaacgttgtagaagtagatagtagtgttggttgcacaacataatgaggacactagaaatcactgaagtggatactttaaaatggtgattttcagccaggcatggtggcttacgcctggaatcccaacactttgggagggtgaggtgggcggatcacttgaggtcaggagtttgaaaccagcctggccaacatggtgaaaccctgtctctactaaaaatatatatattaaaaaattagccaggcatggtggcggg

SEQ ID NO: 47 - DNA, 2315 bp, Homo sapiens; identical to SEQ ID NO: 46

SEQ ID NO: 48 - DNA, 3056 bp, Homo sapiens
tgcaatagcactgacacttaaagttaagtgttttcttgcttggtcttagcactctagccaaatggattttgagggcctcctattcatgggtcacagctgcttgactcaaggatttttgcctatgcatgccctgacagtcagatactaactcacttggatgcctgcctctcacactgctctactttatgaagtcaagaccattaataaaatccagtttacagaaaggcctagagaaggttatttctctgaacacttcgctgtacctacttccataacagatgaacttaccagatgtaacagaagcggttcttctgttctcgtggaagatgaagttgtcctttgttttgatgagtcctgaaggacttaaaggaagtgttcctggacgtaaccaagggtcaggctgcttattctcatggcccaataatgagatgcagatgaactgggaaagaagagagtttatttctgcaaccagcttcagggagaaggccaggaaaatattgccagaccagctcaaaattacaaagttttccaaagctcatgtaccttctaagtctacgtgtaagtgtgcattcatctaaagacataagctccactggcagacagcagagaaggggagaagaggagaagcagctggacattgaagactctggtttgacataagagagaagcagcttcacttcagagggacaacttgacattgggacatcaggggaagaatgccttcttcctactccatcccctttccagctccccctctcactgagagccacttccatcagcaataaaatcccccacatttactatccttgaatttgtgcaacctggtttttcctggacaccagacaagagcttgggatacagaaaactgtcacactaaccatctgccctcatgaaaaggcagagggtccactgagctattaaacactgaagctgtctgcagacagcaaagctaaaagagcactgtaacacactccctctggtgcttcaggggtaacaggtagtcccgtagacaccgccatcaggctacacggagttttgctccttccagtacccaaaagcactcactccagcttctgcacctgctcacctgcatgctccccctcccacgaggggttgaaagctgcgggctgagtaagtgaggcacccctgtcacaaggcttgagaagggatcaaggaaaatttcctgtttcattatgctttgttcatgcctatctctggacaagcaactatggccagggaaaaggggttgtacaatatgttcaggagaagagaagaagctactcttttggccattttgaacaatagccaattcaccacacagcataattaatggtttagaattttttcttcttttatttttttctttctgtagagacagtatctcattgtgttgcccaagctggtctcgaactcttggactcaagcaatcatcctgcctcagcctcccaaagtgctggggttataggcatgagccaacacgccctgcctagaatttcatttctattcattaaaaatacatcaaatggtttttatattacagtaaaatcactatttcaaatgattattccatatattttatgtgcaaaattaagagctgccatattgtctttaaaggcctgcaggtatagaaaggactcactgctttttatgaacacatctctcctattcacacctccaagagttattgcttcttggtaaccctccattaagcgtttgattaagttcaaggtgattagattattaacactttagtcatggtctggttggcttatccccctacccctctccattcttttaatcactgctctattcatccactcaacaaatatttaatgagtgcctattatatgccaattctatagatactaaacataaatagagataaataaagcatgatctctgcatttaagggctataccaaagatgggacatcagacaaataaacagattattataatactgtgtaagggccaagtccccttcatcctctgaaagttcactgaaaatcaactgacaaaaagtagactaatacaagaaaaagcacacattctattaacatgctataggcgtcttacaaaataagatctcttaaaaaggcaaatgattgacccacttatgccatgtcgaggttacagaactaataggtgtctggatcatggcaaaactaattacaggagggggagaagaggaggcctggctagcaaaggtgatcttgttctgtggatgaaacctcacaggcctcagccctcagaaagaatagatggtaaatgtttattttaggcttttaaaggtgtcagactcttggccaatctttcctagatctgacaaagcctggctgcatcaatgtagattctctacagatgcaaatcaccgcctcaacacacagttttacagagctgcttctgtttgcagaccctctgaatgttacaggtagttagacaggcatgagctgggcaggagagggctctcctcaacccaccaggaatgtcaggtgatgattcaacgattagcacattgcttctctacagatgataatttggcagcaggcaccagggagaagcaaaaataacttccaataaaatctcaggtattgggtgaatgagtctagacacgtagattaggagacaaaatggcagagcatgaccttccgggggcagtccaccagaaaagagaagaagacctgagatgtgcctgtgtacaacctcctgaatacactgcgtgtgctcacttcccaagcataaggagggcactccacatgcaggcagcccaccctaagggaagaatcatgggaaagggggacgtgagaagcaggaggtcggccagcctataaagtcctgggatcaaggttaaacaccactcttgacctcgatgcctcgttgggtctcttccaagtgtatttttctttctttcctgttctaaggtctttttaaataaacttccactcctcctctgaaacttgcctttgtctctttttctggctattcccctcagtcgaattctctcttctgaggaggcaagagttgaggttgctgcagacccatatggattcgccaccg

SEQ ID NO: 49 - DNA, 3056 bp, Homo sapiens; identical to SEQ ID NO: 48

SEQ ID NO: 50 - DNA, 3188 bp, Homo sapiens
tttttcaatgcaatgagaaacagctgtgcttgggaataaatgacaacgaattttttttatctcaacagctgtcctgagagcatgtctctacatctctacctgcattctggattcagggagaaagccaaaacggacgacaagacactagatcagccgtgtccagccctttgattacaaggacttttccacctatctgtggtggggttcctggcaagtcatttctccctcgggccttcggtttcctcacctacaagatgagagggctggaccagatggaaattcagggggtaaggggatgtcctcacgcagcccacccccacccccacgggaccctggagcctccatcccagttcccaccacgcacccgctccacaaatcctgcccaaggtaactctttcctgataaggcgaattgcttgcttccttgaattctgctctcaaagatacccttcattttctacctaatattaataactttaatcattcattattccattactatgctctatagtgtatacaatttctgttctttgtcatgttattaactaaattatttattgggtccagtaacgtattccataaatattgtacacataaaaattgtgttatttttattcctgtatgctcagctgcccaataacagtctgaggattaacatatttgttaaatgcacaaatacattctttcacaaatattagtttaataattttatattaaactccctctatacttacaatatgaattagataattcagaataaacattccattggaaaaagctacacaatttgttataaaacatccttaaaagcatcagaaaattaatacagcaatgaagaattacaggaccaaattaagaatggtatgaaagcctgtttgtgacgcttatgtttgggttatctctttatttgagtgactataaatctcaaaagagaactaaagggagaaataaccatatctactaacatgctaagggtacttaaacatctcttagtaattgagaaaattgaaagaaaagaaaaaagagaaagggagaaagagaaacagcgaaagggataatgaaggcgagaaagaagaagagaaaggaagaggaagaaaagtaaaaaggaggagggggaaggaagaaggaagaaaggtgaaaagaaagaatggtaaactttttaacaacataatttatccttctagaatatgaatgttggtctatttgatgatgtcccacaaattcattagtctctgctcattgtttattttttattctttctgtttctcagagacagtattttccattttcttctcttcaagttcatggcttcctctgtgtgtgcaaatatactcttaaatccctctggtgatttttaaatttttatcattgtagttttccactccagaatttgttatctctttgctgatattcctactttttaatattttttctgattcctttatttctttgtttatgttttccttttgacatttgagtataatgaagagagttgttttaaagtctttgtctggtaagtttgatgtctgggtttccttagggatattttctgtcactttattttgttcctttgaatgagccacactttcccattctttgtatgccttgtaacgttttttgaaaactggacattctaataattataattactatgtggttactctgtaaatcagacctccccctacaaacacagtaatgttttgtggttttaaattttctttacttattatattgttaaggatttttttttttagtgaaattttccaaagtgatttacaaaactgtttggtttataaggtgtggtcaccgaagtctttttgtttccttaacaaatgttaagctaatgttttgacagtgattttctggtatgtcaggaaccaatcaaacaggcatatacaagaaaaacaaaaagaaaagcaagtaatcattgtccagcaaaatatgtctgtaggccatgcagactggctttgtgctgggttctttaaagccggcacaaagtgtgtgttcactcttgcactgagtgaagttcaagttcactcttgcacagagcttgcactgaggggagggatcggccaaggtaaaagtgtagggtcttcttatgacatttgtcagcatgtggcttaacctatgaatacgtgtgactttgtagactctcccatgtacgtgaatgaggcatgcgccaccacgcccagctaatttttttgtgtttttagtagagacgaggtttctccatgttgatcaggctggtctcaaactcccgacctcaggtgatccacccgcctcggcctcccaaagtgctgggattacaggcgtgagccaccacgcccagcagatttatttattttttaatctttctttttttttttttaggcagagtcttactctgtcacccaggctggagtgcagtgacacgaccttggctcactacaacctatgcctccccagttcaagtaatcctcccaccttagcctcctgagtagctgggattacaggcgcctgccaccacacccagctaatttttgtgtttttagtagagacagggtttcaccacattgtccaggctggtcttgaactcctggcctcaagagacccacccgcctcaggctcccacagcgctgggattacaggcatgagccgccatatctggcctatttattttttaatttttcaaatgagaaggttgggttaggtaatttttaaaaatcgcttcaagtttcttaactccacaattattttcctgagactcttgcaagcaactgatctttataggtcatgcctcaaattcccaattgatgtcatctgggcaaatcagtccaatgacagccacaagtggtcagaaagctttcttagcagccctcttggtcactaggcacactacctaggagtcaagctgtgacaagaggctgcttcttaaacttacaaaagataggatcttccaggatgtgctgctctgatgtttttgaagggcatagagaaacacacgggcaatgtttgcagaggcaacagactaaagaaagcacatctatagttgtattggctttgtgtgggttgtatggtaaacaggtagtcaccctgcttaatgtgggtatcccattttccataaatgtctatttcaccaccccaaaaagccctcttatcatgaaattaatcatctgcaaacttaatttttcctttcttggtcatcagaag

SEQ ID NO: 51 - DNA, 3188 bp, Homo sapiens; identical to SEQ ID NO: 50

SEQ ID NO: 52 - DNA, 3526 bp, Homo sapiens
tttttcaatgcaatgagaaacagctgtgcttgggaataaatgacaacgaattttttttatctcaacagctgtcctgagagcatgtctctacatctctacctgcattctggattcagggagaaagccaaaacggacgacaagacactagatcagccgtgtccagccctttgattacaaggacttttccacctatctgtggtggggttcctggcaagtcatttctccctcgggccttcggtttcctcacctacaagatgagagggctggaccagatggaaattcagggggtaaggggatgtcctcacgcagcccacccccacccccacgggaccctggagcctccatcccagttcccaccacgcacccgctccacaaatcctgcccaaggtaactctttcctgataaggcgaattgcttgcttccttgaattctgctctcaaagatacccttcattttctacctaatattaataactttaatcattcattattccattactatgctctatagtgtatacaatttctgttctttgtcatgttattaactaaattatttattgggtccagtaacgtattccataaatattgtacacataaaaattgtgttatttttattcctgtatgctcagctgcccaataacagtctgaggattaacatatttgttaaatgcacaaatacattctttcacaaatattagtttaataattttatattaaactccctctatacttacaatatgaattagataattcagaataaacattccattggaaaaagctacacaatttgttataaaacatccttaaaagcatcagaaaattaatacagcaatgaagaattacaggaccaaattaagaatggtatgaaagcctgtttgtgacgcttatgtttgggttatctctttatttgagtgactataaatctcaaaagagaactaaagggagaaataaccatatctactaacatgctaagggtacttaaacatctcttagtaattgagaaaattgaaagaaaagaaaaaagagaaagggagaaagagaaacagcgaaagggataatgaaggcgagaaagaagaagagaaaggaagaggaagaaaagtaaaaaggaggagggggaaggaagaaggaagaaaggtgaaaagaaagaatggtaaactttttaacaacataatttatccttctagaatatgaatgttggtctatttgatgatgtcccacaaattcattagtctctgctcattgtttattttttattctttctgtttctcagagacagtattttccattttcttctcttcaagttcatggcttcctctgtgtgtgcaaatatactcttaaatccctctggtgatttttaaatttttatcattgtagttttccactccagaatttgttatctctttgctgatattcctactttttaatattttttctgattcctttatttctttgtttatgttttccttttgacatttgagtataatgaagagagttgttttaaagtctttgtctggtaagtttgatgtctgggtttccttagggatattttctgtcactttattttgttcctttgaatgagccacactttcccattctttgtatgccttgtaacgttttttgaaaactggacattctaataattataattactatgtggttactctgtaaatcagacctccccctacaaacacagtaatgttttgtggttttaaattttctttacttattatattgttaaggatttttttttttagtgaaattttccaaagtgatttacaaaactgtttggtttataaggtgtggtcaccgaagtctttttgtttccttaacaaatgttaagctaatgttttgacagtgattttctggtatgtcaggaaccaatcaaacaggcatatacaagaaaaacaaaaagaaaagcaagtaatcattgtccagcaaaatatgtctgtaggccatgcagactggctttgtgctgggttctttaaagccggcacaaagtgtgtgttcactcttgcactgagtgaagttcaagttcactcttgcacagagcttgcactgaggggagggatcggccaaggtaaaagtgtagggtcttcttatgacatttgtcagcatgtggcttaacctatgaatacgtgtgactttgtagactctcccatgtacgtgaatgaggcatgcgccaccacgcccagctaatttttttgtgtttttagtagagacgaggtttctccatgttgatcaggctggtctcaaactcccgacctcaggtgatccacccgcctcggcctcccaaagtgctgggattacaggcgtgagccaccacgcccagcagatttatttattttttaatctttctttttttttttttaggcagagtcttactctgtcacccaggctggagtgcagtgacacgaccttggctcactacaacctatgcctccccagttcaagtaatcctcccaccttagcctcctgagtagctgggattacaggcgcctgccaccacacccagctaatttttgtgtttttagtagagacagggtttcaccacattgtccaggctggtcttgaactcctggcctcaagagacccacccgcctcaggctcccacagcgctgggattacaggcatgagccgccatatctggcctatttattttttaatttttcaaatgagaaggttgggttaggtaatttttaaaaatcgcttcaagtttcttaactccacaattattttcctgagactcttgcaagcaactgatctttataggtcatgcctcaaattcccaattgatgtcatctgggcaaatcagtccaatgacagccacaagtggtcagaaagctttcttagcagccctcttggtcactaggcacactacctaggagtcaagctgtgacaagaggctgcttcttaaacttacaaaagataggatcttccaggatgtgctgctctgatgtttttgaagggcatagagaaacacacgggcaatgtttgcagaggcaacagactaaagaaagcacatctatagttgtattggctttgtgtgggttgtatggtaaacaggtagtcaccctgcttaatgtgggtatcccattttccataaatgtctatttcaccaccccaaaaagccctcttatcatgaaattaatcatctgatgcacttcaagtaccagtcacaaaaatgatgaactcaggcagaattccactgctagacaagcccagacaaaaactgttactgttagccaaggaaatttgcacacaattttgataagtggcactaaagccacataagacaggaaatgggttagaggacatcaatgtattgagacagaaagtgaaagggtgggcaggatttgcgaggttaccagtttgaatatggccattcctgcttttactaaaggtcaatttagaatacaaatgttacagaattcatttagagccaaaaagtaattctgacaaagactgtcttaaaatgcaagatttttagaattatggaaaatttttatttccttctttttgcttctaaa

SEQ ID NO: 53 - DNA, 3526 bp, Homo sapiens; identical to SEQ ID NO: 52

SEQ ID NO: 54 - DNA, 3526 bp, Homo sapiens; identical to SEQ ID NO: 52

SEQ ID NO: 55 - DNA, 653 bp, Homo sapiens
tcctgggggagcaaaatggacgaaaggcgaccccccaggcaggggcgctgggtgccttgggaatccgaggaatcccttctctttgccagtcggaggggactagatggagccgaaggggccggagatgggccgagcgctgccccccgggggtcctcggcgccgggcgcagcttacgagcgcagcgcagcaggctccattcccggccgccgccgctcagcccattacgcaaacctggtgggtccaaccaaccccgctctgccgccgctgctggaacccaggaggcgtgcttgcaggctttgggcactacgtggggctggaaataccacgcactgccccttcgcctagacccccgctcgggccacgcgggttctgccctcaaagctgccacacacgtcgcggtcagagaactgggaagggggcgctgggtccgaggttctggaaaagcaagaactcacctgcaaacaggcagtcctcagctctggacttctggatcacgacgtcgatatccttctgaattcggtcttgccttgaacacatccccattaaataaatccttggaaaagaagcagccgctatttccaccccacccccctcgcacgctttcagctttcgtaaatattcagttaaaaatgaaacctctggccgaggcaggg

SEQ ID NO: 56 - DNA, 2635 bp, Homo sapiens
catgtggggtggggcagggaagtctcacatgtcttcagccctgcacaaggccaggagggctgactggcaatcccctttcactgcatcctgcagacaagggaattcagtgttagaaagatccaccaccactatggcccaagtgctctctcccctcctttgggctggtccatcacagttcatctgggagggaagggtcctcccgggagctcagagtcctgcactacattaaccaaagactcctgggttttcttttttaagatggagtcttgccctgtcacccaggtgggagtgcagtggcacgatcttggctcactgcaacctctgccttctgggttcaagcgactctcctgcctcagcctcctgagtagctgggattacaggtgcacgccaccatgcctggctaatttttgtatttttagtagagacggggtttcaccatgttggtcagggtggtcttgaactcctgacctcgtgatccgcccacctcagcctctcaaagtgctgggattacaggcgtgagccactgtgcctggctaactactgggttttctatggggcaagaatatgctcagctgtgtgcagggagtgagggtggaggtgaggagtgaaggcctgaggctccaggctaagaagtagccaagtttcacctggagagaagagtagagggacttcccaaatttcttcctgaactcagctctgatactcagaaggtcagtctcacatcgagagataaggatgcgaatcaggacttggtaattgggctcagtttcctagtaggggaagaaagagatggggggtagttagtgagagtctcactgagagtaggggttgaatggcttggagggttattgtaggaaggggaggcaaggtgggagtcaagggataagagtgtacattatacattatctcgggacaaaagttatgtttgtccatcctcaaggaagatgacacagcaggaaagatcagtctctgtgggggcagcttgagtatttatttctttccacatgtctttcctgcccctaccattagcttagagctgtgtacctccagaatttggtggtgagcagctccaaagataggtacaccaggaaggctagaaaagatttggtgcatataaagactgccagcatgaaaaccaggaaaactgcttttaactttcaagttagtgaatatccaaggaggatatacctgccctatccctaaactgagctgatgaggctctgatagggttcaaggttgtgtgacttctagttctgattccaacccaatagggccatctcacagccccatctctgcatattagtttctccggttggacccttaggctgaaacattgctatcttcctcctgtacatgcagcaggcctgttttttggctaaagaaagtaatgaaaggttcagtttagaaataacaggccaggcacagtggctcatgcctgtaatcccagcactttgggaggatgaggcgcgtggatcatctgaggtaggagttcgagaccagcctgaccaaaatggtgaaaccccgtctctactaaaaatacaaaaataagccaggcatggtggtgggtgcctgcaatcccagctacttggaaggctgaggcaggagaattgcttgaacccaggaggcggaggttgcagtgagctgagatcgcgccactgcactccaacctgggcaagaagagcaaaactccgtctcaaaaaaaaaaaaaaaaaagaaagaaagaaaaaagaaataacaggccaggtgtggtggctcatgcctgtaatcccagaattttgggaggccaaggcaagcagatcatttatggtcaggagttcgagaccagcctggccaacatggtgaaacccccgtctctattaaaactacaaaaattagccaggtgtggtggtaggcgcctataatcccagctactgaggagggtgaggtaggagaattgcttgaacctgggaggcggacgttgcagtaagctgagatcacaccactgcactccagcctgggacagagcaagactccgtctcaaaaaaaaagaaaagaaaagaaataacacaggtacaagtcatcaaaatcctgaattataattgattatactaagtaatgtgttgttatgagagatttttaaataaaaacttttaattgtaaaattcctgtgtttttttttttctgtgcaccagtgttgtcatcaattcctaatatcctcattttcagagtttcctgagtcactttactcacaagactcttcccagaactgcctacaacacatacttagggcatcccaatagatcataaactcctttgacaaaacaaaagaaaatgaagtaaaacaggatgctccaattcatttagactcattacctaattgtcagtggacctaatgtctacttcattttaacttttatgcatcattagttttgtattgtcataaagattgccaattgctccccagtatccattcttctcttcttccaacgcttgttactctaaagttacagaattgggcaagagtcactcattaactgaatactctcattgttgtacaagtattcttttttcttgctctgtcacccagagtggaatgcagtggcgtgaattcagctcactgcaacctccgcctcccaggttcaagcaagtctcctgc

SEQ ID NO: 57 - DNA, 5210 bp, Homo sapiens
ggccggggcaggtggcggcccgtggaacagggattcccgccggcgcgtgtgcgggctctcgggcaggaaggcccagccttcgcggcccgccagggccgagagggtccaaatcccgtctcagatgggagtgctcggcggagcggggctgggcgaggagcgcagaggagtcagaggctagtcaagtgaagcaatgggagtggagatggaacaaagaaatctgcaattggttgtgatcaattagttgtaaacactactgcacttggaccaacctcttccttttcctgactgcttaggaaggatggaatgtatttccttccttctgggagtgtttgaatgaagattagactctccttgaccatgaatgaagagcaaccagttttttagtatacagtgatttagactctgggtctagagtgtagatatcatgggcactgtgaaagcacagaaggagaaaaggtttttatgtgagtatatgggagaggaaatagtttattgtcataagctttttggctatggcctccattacatctctagcttttggaaggcactaaattgaggccattcaaatccatgtccacctatcctttgcccgtcacgagactgatggcttaggaagcatgtggtctaggtactagagagggagcctgacccacctacctcaccgctgctgctgaatttgtgcacaactctctgacctggttccatgtcacaaagggtttcattctctctgattccctgaatccccagctctagccgcagatcctggaaccctagcatatgcctgaagctgaatattttacttgccagagtaagagtttttacatagactctgtcatcttctactggccctcctcttaaactgaggcagcggctgctagctactcaccaaacctattttactttctttttctttttttttttttttttttgagacagagtcttgctctgtcgcccagactggagtgcagtggtatgatctcggctcactgcaacctccgcctctcaggttcaagcgattctcccaccgtagcctcctgagtcgatgggattacaggtgtgtgccaccacacccagctaatttttgtattttttggtagagatggaggtttcactatgttggccaggctagtctctaactcctgacctcaaatgatccacccacctcagcctcccaaagtgctgggattacaggcataagccaccgtgcctggccccccattttactttcttctttaacatatagttagaatgaaaacatgttgaagggatgatggcattagaaaattaccactggccactatcacagtaataattgctttaggcaagaatgatcgataaaagctaaaattaatgggcaaaagtatgatgagaaacaggatatttatacaatcgcaaagtgcctcccaataagatacttattaaaaaggtaaaaatggtaattttcagtggagaaatatggcagacaccatagtaaccaactgatcaaagggaacattggcattaatgggacaaatcagcatcacgtttctcttgtcatgaagcactgagaaggccacagcattgcttctgaaatattgcaacaaaaatgaataacttgaatctaatgatgaggaaacattggagaaatccaaaccttggaacacgctacaaaacaactaactcgtactctgagaaacatatcagtggactggattccaaacagtggctcatgcctgtaattttaacactttgggaggccaagtttggtggggctttgtgtctgaattctggccaatggaaccacgtggaggcctggcccagaacatctccctgtggattctctcatctggcaactggatgcctacacgaagggtgattttggagtcatgtgttggagatcacaaagcttttgtcagccaggttcctgaatgactgctagacaccatgggctgaactttatgagctccagcaccacctccagccttcagtgactgtctggagcaggcatccggatggaagagaagggggacaaccatgaacttggtgacccacggtcagcctgatttcccttgtggacacatttatgcccagtgtgcattcctcctgaggtctgttccaagtctggaggcagcagagtagagtggagagaacagtggacttggaatctcacctcccagattagagtcctggatctgactttgattgctggtgctgcctcgggcaagttactttagctgtgtgcatctccatttccccatggatagaacatgggttttgggtagaagtgtctgatagctgtactgtgctttacggttcatgagcacgcacacataggcccataatatcatatctctggtcaccctggcaggtagatattattgccccaggtttcaggtaagaagactaaagaccaggggtcaattgcttgctcagagtcccacagccagcagcagccaggcaggacaccaagtcagagtctagattccggatcttgccctcttccaagtgtaccacattcttctcaaagtggcctctcaggtcttttgtccagaaaattttgagactttgatgagaagcccatatctgcacactggggattaggccagataaccctgtgtgtccttccaggcctggtattgtgaggctgaagcctagtgccccacactcccttcctcaccccttagagaaagatagagactccagggccagcctggtgggtgctgaacctgccctgctgagccaagcccaggaggcagccaaggtcctaccagtgaccttaccctgggggcccctccaggtaggagcctggttggaaaagacagaccgacttcttctgggttggctggaaaaagatgacatactcaaagccttgtccttccacttggatgcacctggtgaagatgcgacagtcacctttgtctggggagagataggcagtgttgcagccggagaagggagggtatggtcaggatgcagcaccatttggttgagtcttgcctctggtacaagattaaggagagaaaaccagaggacaccaggtccacccccagggagccttccctctgggagcagaggcacagttgctgtcctcacagagcctttctgtctagggcagaaacatgcaggaagtgccctggctgagaatggagataggatcagggccagggcaagactttaagagaccataagcattgaaaattgaaaatgtaattactcatgtaactcacatataattcaaaagaataatagtaaacagtaaaataagagcagaaaagtccatcaaagttctgattttttttttccaagacagctaccactactacatccttttttggaagtatcaaattctttgaaaaaaaattatgttggtattcctgctttgtttgtgccataaacccaagggtagtctgtcccctgtaccactccttcatcactaggcaggaagacaacatatatgagtgagagagacagggagatacacatgcgtgcacacacgagtgcacacacacacacaagaaggtggaagctctatcattaggatccattaggatcattaggtgtttcaggagtgctgctccagaccccgcacagcagggatgatgtgcagggcctcagtggaaggggtgtggggtccaagggctttcatggggttggggcggaaggcttgggatgaggcttgatagttagggaggggcagtcagtgagaagtcggggcaggagctgggctggctgtcctccagtggggacatgcttggctgggagcgaaggtgggcccaccagggtgtgctgcttcagatgggaggaggggagctggagacctgagaggacacccgccgcctgttgcctggggctgcagcatcaggggtggagttggacagcaggaagaactcgctgagaactggaaggcggtctgtgaagttgcttctcagtcttagaacacagggaagggcggctggggtgtgtgtactcatggtcctgtccttacctgaggaaactgccagtccagatgggagcttgagtccccggatgtggtctctgttggacttgaaggagggcagcttgatccagccgctagacttagtcttctccagaaattcttggtacaggctcagcatgtccgaacaccagctggcattgggaagagcataatccttcaagtctgtcttctctggcaagaatcttgagaactgggcaggaaaaatcagaatgactagacagcatcctggaggggggctgctgcctgggctcgggacctctaaacagctgttcctgggtgctggggcttctcaatcccttctgccagagtatcgatccaagggaaagggcccatattccttgcaggggggctgcggacccctatgggtgacggggcataaggatgctaaagagcaagggaagggcgggcagggagtggggccagagatgatgggcatgctgctcgatgtggtgccttacccttgttctgcttaaaacatgtgagcagttctttaaagttgacaactgctcatattagcctcactgtacagatggggaaactgagggaatacggccaaggttgccaagcatgtgactgtgagagctggtggtcgcactagatgctgtctcctctgcagggcagggtcacagttgttgaggaccattctagcaacccccacctcaggggctactccagctctgcccactgctgtgggcctgcctgggcagggtggctcctttgaaacacatttgggcccccacagaggtgtggtgccatggctggggcacagactatgtgcccatctgtgtgacgtaaggaagtcctctgtagcgtcacctgctcatacaccagtcacaactgtagacagcatgtgagctgcttgccaatgccacagatggggtcctctgtctggggataccccagctttgctgcagtagtctgagtcccacaggaggaaagtcatttgttggtggccacacaagacacagagccagatgcaggtctcctggtagttttagttttgaatgggggcaacttggtatcccagagcactttctctttgccaaatcaaatagctcctccgaacactgcccacctgccctggccatgggctgggaagaggagatttggggtgctccttaagccctaggctcctgggaaaacactgcccatctggctgagctgggaactcaccatggagtctgtggaggatccaaatgctgaggcagggttgagtctgggcaggatacggggg

SEQ ID NO: 58 - DNA, 6470 bp, Homo sapiens
gcgggctctcgggcaggaaggcccagccttcgcggcccgccaggctagtcaagtgaagcaatgggagtggagatggaacaaagaaatctgcaattggttgtgatcaattagttgtaaacactactgcacttggaccaacctcttccttttcctgactgcttaggaaggatggaatgtatttccttccttctgggagtgtttgaatgaagattagactctccttgaccatgaatgaagagcaaccagttttttagtatacagtgatttagactctgggtctagagtgtagatatcatgggcactgtgaaagcacagaaggagaaaaggtttttattttggtggggctttgtgtctgaattctggccaatggaaccacgtggaggcctggcccagaacatctccctgtggattctctcatctggcaactggatgcctacacgaagggtgattttggagtcatgtgttggagatcacaaagcttttgtcagccaggttcctgaatgactgctagacaccatgggctgaactttatgagctccagcaccacctccagccttcagtgactgtctggagcaggcatccggatggaagagaagggggacaaccatgaacttggtgacccacggtcagcctgatttcccttgtggacacatttatgcccagtgtgcattcctcctgaggtctgttccaagtctggaggcagcagagtagagtggagagaacagtggacttggaatctcacctcccagattagagtcctggatctgactttgattgctggtgctgcctcgggcaagttactttagctgtgtgcatctccatttccccatggatagaacatgggttttgggtagaagtgtctgatagctgtactgtgctttacggttcatgagcacgcacacataggcccataatatcatatctctggtcaccctggcaggtagatattattgccccaggtttcaggtaagaagactaaagaccaggggtcaattgcttgctcagagtcccacagccagcagcagccaggcaggacaccaagtcagagtctagattccggatcttgccctcttccaagtgtaccacattcttctcaaagtggcctctcaggtcttttgtccagaaaattttgagactttgatgagaagcccatatctgcacactggggattaggccagataaccctgtgtgtccttccaggcctggtattgtgaggctgaagcctagtgccccacactcccttcctcaccccttagagaaagatagagactccagggccagcctggtgggtgctgaacctgccctgctgagccaagcccaggaggcagccaaggtcctaccagtgaccttaccctgggggcccctccaggtaggagcctggttggaaaagacagaccgacttcttctgggttggctggaaaaagatgacatactcaaagccttgtccttccacttggatgcacctggtgaagatgcgacagtcacctttgtctggggagagataggcagtgttgcagccggagaagggagggtatggtcaggatgcagcaccatttggttgagtcttgcctctggtacaagattaaggagagaaaaccagaggacaccaggtccacccccagggagccttccctctgggagcagaggcacagttgctgtcctcacagagcctttctgtctagggcagaaacatgcaggaagtgccctggctgagaatggagataggatcagggccagggcaagactttaagagaccataagcattgaaaattgaaaatgtaattactcatgtaactcacatataattcaaaagaataatagtaaacagtaaaataagagcagaaaagtccatcaaagttctgattttttttttccaagacagctaccactactacatccttttttggaagtatcaaattctttgaaaaaaaattatgttggtattcctgctttgtttgtgccataaacccaagggtagtctgtcccctgtaccactccttcatcactaggcaggaagacaacatatatgagtgagagagacagggagatacacatgcgtgcacacacgagtgcacacacacacacaagaaggtggaagctctatcattaggatccattaggatcattaggtgtttcaggagtgctgctccagaccccgcacagcagggatgatgtgcagggcctcagtggaaggggtgtggggtccaagggctttcatggggttggggcggaaggcttgggatgaggcttgatagttagggaggggcagtcagtgagaagtcggggcaggagctgggctggctgtcctccagtggggacatgcttggctgggagcgaaggtgggcccaccagggtgtgctgcttcagatgggaggaggggagctggagacctgagaggacacccgccgcctgttgcctggggctgcagcatcaggggtggagttggacagcaggaagaactcgctgagaactggaaggcggtctgtgaagttgcttctcagtcttagaacacagggaagggcggctggggtgtgtgtactcatggtcctgtccttacctgaggaaactgccagtccagatgggagcttgagtccccggatgtggtctctgttggacttgaaggagggcagcttgatccagccgctagacttagtcttctccagaaattcttggtacaggctcagcatgtccgaacaccagctggcattgggaagagcataatccttcaagtctgtcttctctggcaagaatcttgagaactgggcaggaaaaatcagaatgactagacagcatcctggaggggggctgctgcctgggctcgggacctctaaacagctgttcctgggtgctggggcttctcaatcccttctgccagagtatcgatccaagggaaagggcccatattccttgcaggggggctgcggacccctatgggtgacggggcataaggatgctaaagagcaagggaagggcgggcagggagtggggccagagatgatgggcatgctgctcgatgtggtgccttacccttgttctgcttaaaacatgtgagcagttctttaaagttgacaactgctcatattagcctcactgtacagatggggaaactgagggaatacggccaaggttgccaagcatgtgactgtgagagctggtggtcgcactagatgctgtctcctctgcagggcagggtcacagttgttgaggaccattctagcaacccccacctcaggggctactccagctctgcccactgctgtgggcctgcctgggcagggtggctcctttgaaacacatttgggcccccacagaggtgtggtgccatggctggggcacagactatgtgcccatctgtgtgacgtaaggaagtcctctgtagcgtcacctgctcatacaccagtcacaactgtagacagcatgtgagctgcttgccaatgccacagatggggtcctctgtctggggataccccagctttgctgcagtagtctgagtcccacaggaggaaagtcatttgttggtggccacacaagacacagagccagatgcaggtctcctggtagttttagttttgaatgggggcaacttggtatcccagagcactttctctttgccaaatcaaatagctcctccgaacactgcccacctgccctggccatgggctgggaagaggagatttggggtgctccttaagccctaggctcctgggaaaacactgcccatctggctgagctgggaactcaccatggagtctgtggaggatccaaatgctgaggcagggttgagtctgggcaggatacggggggcctcaagaaggcctctgtggtggccaagtcttgctgccacctggaagcatctccttatcatggccaagtgcaaggatccagccctgcttggatggagggtcttggctgactcccaaggagtgctttcagctgcacttggggccgcttctctcccttctgttgcaggctttctttcagagagctaggcgaggctgggctggtgtgctgcaacacccacagatgctcggcgcctttagctggtctaggagccccacccagtgcttggggagggacagatgctgcttgggcatgaaaaggcagcaggactggcttgagttgcaaaaggagtaaacaagtacataaacaaatagtatggggtatatagagccttggagagctgcctgggggttctgagggagaatccaagaatatttccagaaggataagggaagcctgtcccttgattggagggtgctggtggagtgttcttggtatgtgctctgcagtgtataccggactctgaaaactctggtatgattttgtgactcagaaaaccaactcacaggccgggtgcggtggctcacgcctgtaatcccagcactttgggaggccgaggcggcggattacgaggttaggagatcgagaccatcctggctaacacggtgaaaccccgtctctactaaaaaaaatacaaaaaattagccgggcgtggtggcgggtgccggtagtcccagctacgcagggggctgaggcaggagaatggcgtgaacctgggaggtggagcttgcagtgagctgagatctagccaccgcactccagcctgggcgactgagcgagactccgtctcaaaaaaataaaaataaaaaaataaaaaaaaagaaaaccaactcacagccttagacacctcttttttttttttttttttttttttggtgagacggagtttcaatcttgtcgcccaggctggtgtgcaatggcgtgatctcggctcactgcaacctccgcctcctgggttcaagtgattctcctgcctcagcctcctgagtagctgggattacagacacacaccaccacacccagctaaattttgtatattttttttagtagagatggggttttgccatgttagccaggctggtcttgaactcctgacctcaggtgacctcccaaagtgctgggattacaggcgtgagccaccgcacccggccaacacctcttcttatatcccggacaagggttagcacaggagagtttcacctgctggtctctggctggggataggagttggaggtgggggagggcttgacagggagggcagaaaataatttgggaggaaacagcttggcagggatactctcatttttaaattgactaaaataaaagcatgttctaaagatcagtcctcgcgcagtggctcaaggctgtaatctcagcattttgggaggccgagtgagaccttgtcttaaaaaaaaaaaaatcagaactgtgcaaaggtggaatcataacagtgatgatgacgataataatagttgtgatgattatgacattttggcaggttccaaaagatgaaactgatttaatgcggaaatttaaaagatttggttcaccctctgtatttggttgccctagaagaagactagaatataaatatttcccctcacctcctgcaaaggtttgaattaaacttcctcaaggactgggggaaccatttttttttgttgttgttattttgtcagagtctcactcttattgcccaggagtgcagtggcaccatctcggctcactgcaacctctgcctcccaggctcaagcaattctcctgcctcagcctcccaagtagctgggattacaggcgcttgctactacgcccggctagtttttatatttttagtagagacggggtttcatcatgttggccaggctggtctcaaactcctggccttggctgatctgcctgcctcagcgtcccaaagtgctgggattacaggcatgaggcaccacgcccagctggaagtttttttggttgattcagcctctgggtctaagcaaagatatttgagttggttgccatccccagataagtgagaatatctggcagcactcattttcagccctgggccgcagccgttgctgtgaggcagaaattaaaaaaagatagtaagtactacattcattcactccaagaaaagtaacagacaaggctataagaaggtcatagtgacctagtctgagaagtaaaagccaaggcccagaatgtggcaaggcaaaggttaaaaagaaaggaagagcaagtttttctctgcctagcaagctcacttcaaagacaattataagataatgctcttcgagaagtcgaaaccaaaggaataggctccagacatcccccgtctggagcaagggtgaaggaaaaaaaaaaaaggacaaatgtctgtctgtatttagccagttcttgttttttctttccacgcagctacaaggccaccagctatgcaaagccacaagttatgccaagtcatcagttatgctatagattatgtgacctgtcattatatgattaactgcctgttttgcttctgtaagcctgcttataaaaatcctgctcagtctttgttcaatgctcagctttttggatgtgaatccactgagccaatgcctaccttaaaataaacatcgtcctgtttttccata

SEQ ID NO: 59 - DNA, 6470 bp, Homo sapiens; identical to SEQ ID NO: 58

SEQ ID NO: 60 - DNA, 6470 bp, Homo sapiens; identical to SEQ ID NO: 58

SEQ ID NO: 61 - DNA, 1032 bp, Homo sapiens
attctcctgcctcagcctcccgagcggctgggattataggcatgtgctaccacgcctggctaattttttttgtgtttactttacccatctttattacaattactataatattaggacttattctgccatttaattttatatttttcatgtactgtgccttctttgttgtttctttccccacctttgttactttccattacatagagccaacattcttctcatgttttgaaaactatacattctattttcttgttaatgtagttgctttaatttgactttatgctacttcattgaataatttttaattatttatattcttcctaataataaagttcctttcacaccctcctatcccatcagtcttgtcttttccttcctctttttttttttttgagatggggtcttgcactgtctcccaggctgaagtgcagtggtacgatcttggctcattgcaacctctgcctcctgggttcaagcaattctgcctcagcttcccgagtagctgggattacaggtgtgcgccactgtgcttggctaatttttgtatttttagtagagacggggcttcaccatgttggccatggttggccaggctggtctcgaactcctgacctcgggtgatctgtctgcctcggcctcccaaagtgctgggattacaggtgtgagccactgcacccggtccgttctgcttattttcatcatattcatagtatctataattcaggttttttttctttttttttttttggtgtaagttcccaaccaatggccttgtccttcgagtacttttcctcaggctgatgataaaagttctgtgtgaaggtccttttgcttcagctcatctatgggacggagtccagctgcaaatatatgacacagtaactagagactctactctccaaccaatcattccattctgattatctctcactctcctccacctcttctttctcagactctctcccccttttagcttttgttgatattcaattttattatgtcatttaatcatgtttatttcctatattgcag

SEQ ID NO: 62 - DNA, 1032 bp, Homo sapiens; identical to SEQ ID NO: 61

SEQ ID NO: 63 - DNA, 1599 bp, Homo sapiens
attttatcagttgttgttttatatattttgaggctatatgagtaggtgcttttatgttcctggtgtttgtattttcttgtattacctcattctttgtcttttatatttttcctcttgtatcctcttttgtcaaatattaaaattacttccctgatttttttttggtttatatttgcttcatgtattttcttccttttgtttattccttctattttcttgtttaaatatttgaaatggttttttattttttttcagatggagtttcactcttgttgcccaggctggagtgcaatggtgtgatcttggctcactgcaacctccacctcctagattcaagcgattctcctgcctcagcctcccgagcggctgggattataggcatgtgctaccacgcctggctaatttttttgtatttttagtagagatgaggtttctccatgttggtcaggctggtctcgaactcctgacctcaggtgaaccgcctgccttggcttcccaaagtggtgggattataggcataagccactgcgcccagcccgtgataaagtttttttattttcagtgtttctcttgtatgcaacatattgctgaaccttaaggaagaaactcaacccaggaacgtttgtcttttaagaagtgtgtttactttacccatctttattacaattactataatattaggacttattctgccatttaattttatatttttcatgtactgtgccttctttgttgtttctttccccacctttgttactttccattacatagagccaacattcttctcatgttttgaaaactatacattctattttcttgttaatgtagttgctttaatttgactttatgctacttcattgaataatttttaattatttatattcttcctaataataaagttcctttcacaccctcctatcccatcagtcttgtcttttccttcctctttttttttttttgagatggggtcttgcactgtctcccaggctgaagtgcagtggtacgatcttggctcattgcaacctctgcctcctgggttcaagcaattctgcctcagcttcccgagtagctgggattacaggtgtgcgccactgtgcttggctaatttttgtatttttagtagagacggggcttcaccatgttggccatggttggccaggctggtctcgaactcctgacctcgggtgatctgtctgcctcggcctcccaaagtgctgggattacaggtgtgagccactgcacccggtccgttctgcttattttcatcatattcatagtatctataattcaggttttttttctttttttttttttggtgtaagttcccaaccaatggccttgtccttcgagtacttttcctcaggctgatgataaaagttctgtgtgaaggtccttttgcttcagctcatctatgggacggagtccagctgcaaatatatgacacagtaactagagactctactctccaaccaatcattccattctgattatctctcactctcctccacctcttctttctcagactctctcccccttttagcttttgttgatattcaattttattatgtcatttaatcatgtttatttcctatattgcag

SEQ ID NO: 64 - DNA, 1658 bp, Homo sapiens
ccccaactcgcaggccggagaaaacacgagtagctaggtgggcggccccaaacctcaactcccggcattgccaagcaacagccattcagttcggttgctgggacacgcgtcaccatggcgacggctccgcgccgcgcagtctgagtacttaaagagcaagcgcgcgcaacgcccgggcgtcggaaagcggccttctgggactccgcaaactcccgttctccctcccccctcccccttgccattccctttgccttccgggcgccaagtctctctggcctccaaggtgaacccaactccccagcgcgccccgggttcccgggtcgggccggcttcaggcggtggggagcgggatcccgggccccgggcgggcgggagggacgggacgcggtgcagtgttgttttttcccccgccaatattgcactcgtcccggcctccggcccccccggccccccggcctccccgctacccctagcggggcagcccccgccctcctggctctccatcccggcggatctttgatagactggagtgtcgccgctgccaccgtgaacgggaaaatgggtcatggaggagtgacttcaccaacatcactcataggtgcttgtgtccgtggtgagaagggtgatggagagaagtggctgcagttcccacccatggagaggtcactggtgaatcccagctaaagaggaaggacaggcccggcctgagtcccacaggcttaccatctgagtccttctgattgggattgggtaccaggcggcagttatcgggaccaggaggcacataatctgggatgccatcattgtcatcatccccatcacactcatctccaagtccatcgttatcagagtccagctgggagctatttggcagctgtgggcagttgtccttggtgtcctgatgcccatccccatcgctaatcagaagaacaggttggtgaaagtcccgaactttgtctccccacccagaggacaactggccaggaaatctgcctgtttcttgtctcaccctctagtccacactctgcctaacactacgccctacctcacattcctattgacatctgctgcagatcacacccttgtgatggacaaactgctcagtacagtcccacccacccagcctccttgtcctgggcacgaggtttttgcctccctgatttggagtatttggcccttactagagagctgccagatgagaactcagaggctcctcccggctcacctgcatcctcaaatacgccttctgtccagtcctaatctccagcccatcgacctccgctggaggaatgggggccagtgctggaaggcctgcatgttggtcacccagtttgcagtccacgtagagatgtagggcagggctgggtctggagggacctcggagtcgcaggagaactgtgtgtgtgcgcccatcagccaggcccgcttgctgtaggttcacggcgtggactttgccatcctcccgctggtatcgcaccagtactgcccaggaggggagatcagtatgggcgctatcccccaccccctgcctcccagctgagccttggatcaactctgctagataccacatctctagggcccctatccctaattctactatgtggctctcaacaccttgtatttaataggtacacaataaatgtttttgaaattgcttt

SEQ ID NO: 65 - DNA, 1852 bp, Homo sapiens
caaagcccctaacaacagactcgctgggaccccctagacttggcatggaggctgggtgcagacctagaagacagaggtggtgaagcccggccagtgaggacaagagctgcggggaaggacaccgagtgtttgcagatggagtcgaatgtaaccccccgggaatggagccgggagggtcagagaacgcggctgcgctctggatctccgaaggggggcgggggcctggaagaggtccgggcccagaatggacctccaggtccctgctgccgcaatctggccctgccctccagcctaccccttactcccagaggaagggacccagggagacccacccagatgccctgaaaggaggtggaggatgggggtggggcaatacgcagagtttgtctggtgaatgcaggaaaggggtgggggctggagaggaaaaggatggagcagccgtcagcttgtcaactccgcatctgctggctgcctcggccgggctccagcctgcgccctcgcccctcggaacagcggtatgtccattctctccgcattcgtctccatcgttcagccaccaccgcaccctttctctattcatttctcctgctcccttgtcctgccccgcccctcgtgcccaggtccatcggtctacacccatgggccgagccctcctcaccagggtcctcctggaaccgctccggccttgggcttgtccgcggctcccacggtccccgcccggcggggcacagagcgggaggggaggggcactagcacaacctaccctgcgctgcgcagctgcaccccttcgcgcatgggcgtggcgtagctcagacccgcccccagcgtttagcgtcttttgtcacccacctagagggtttgatatatcctaagcttttggcccctgggtcctggttccgtgcagcgagtcctcccagcaccccaccctgcacattctggaaagagccagactctggctgggccgagcaagaacagaaccacaagaaggttacacgattatttattgagagcctcctctccccgcccttgcaatctctaggtcactttctccgcttgtagattttgcgcgcaagccccagaaagacggctgggggcaggggtgctgcgtactgttcaatgagagccataatgtggctgtaactgtcttcctcatattgcaagaacactgctggcagatccagctcctcatatagcgccttcacccgggccactttctcagcctccttctgcccgtaattttcctggaagaggttgaaagacaggaaaacgggcttggccttccccagagcctccaggacccctccactcccctcattcacatattccagaacatctccaaagccacccactcctttcctccctccaattttcaagtgtctctacgtagctaaaatcccaagcttcccttccctatcccaaatattgcctcataccaggcatcctctactccagggtttctccaccttggcactattgaaatttgggaccagataatcctgtctgggggagctgttctgtgtactacatgtttggcaacatctttggctcctgccaactagatgtctgtaccacatgcacacacacagagttgtaatgacaatggcaaaaaatgtctgctgacattgccaaatgtcccctcgggaggaaaactgcctctagttgagaaccactgctctatccctttccaccaactcagggacccaccaccctctctcaggcaccttcaggatctggtactgttctggagtggcccgttgcagacactgaaccaccagccagctgcatttgttgtcctggatgtcagtgccaattttgccggtcacactggggtccccaaagaggtcaaggtaat

SEQ ID NO: 66 - DNA, 1852 bp, Homo sapiens; identical to SEQ ID NO: 65

SEQ ID NO: 67 - DNA, 7499 bp, Homo sapiens
cgtcgattttcccatcatccgcctctaagagctcagaggtagggagatcctgctccgccctctcgtcctcttcctccaagcctggggaagggacgtcctggcaggtggtcagggcgttgcagttcgagtccaggccaggatcgggtgaagaagaagctccggagcaggaatcaggagagcagcagaagctgtccggtgcagacctagaagacagaggtggtgaagcccggccagtgaggacaagagctgcggggaaggacaccgagtgtttgcagatggagtcgaatgtaaccccccgggaatggagccgggagggtcagagaacgcggctgcgctctggatctccgaaggggggcgggggcctggaagaggtccgggcccagaatggacctccaggtccctgctgccgcaatctggccctgccctccagcctaccccttactcccagaggaagggacccagggagacccacccagatgccctgaaaggaggtggaggatgggggtggggcaatacgcagagtttgtctggtgaatgcaggaaaggggtgggggctggagaggaaaaggatggagcagccgtcagcttgtcaactccgcatctgctggctgcctcggccgggctccagcctgcgccctcgcccctcggaacagcggtatgtccattctctccgcattcgtctccatcgttcagccaccaccgcaccctttctctattcatttctcctgctcccttgtcctgccccgcccctcgtgcccaggtccatcggtctacacccatgggccgagccctcctcaccagggtcctcctggaaccgctccggccttgggcttgtccgcggctcccacggtccccgcccggcggggcacagagcgggaggggaggggcactagcacaacctaccctgcgctgcgcagctgcaccccttcgcgcatgggcgtggcgtagctcagacccgcccccagcgtttagcgtcttttgtcacccacctagagggtttgatatatcctaagcttttggcccctgggtcctggttccgtgcagcgagtcctcccagcaccccaccctgcacattctggaaagagccagactctggctgggccgagcaagaacagaaccacaagaaggttacacgattatttattgagagcctcctctccccgcccttgcaatctctaggtcactttctccgcttgtagattttgcgcgcaagccccagaaagacggctgggggcaggggtgctgcgtactgttcaatgagagccataatgtggctgtaactgtcttcctcatattgcaagaacactgctggcagatccagctcctcatatagcgccttcacccgggccactttctcagcctccttctgcccgtaattttcctggaagaggttgaaagacaggaaaacgggcttggccttccccagagcctccaggacccctccactcccctcattcacatattccagaacatctccaaagccacccactcctttcctccctccaattttcaagtgtctctacgtagctaaaatcccaagcttcccttccctatcccaaatattgcctcataccaggcatcctctactccagggtttctccaccttggcactattgaaatttgggaccagataatcctgtctgggggagctgttctgtgtactacatgtttggcaacatctttggctcctgccaactagatgtctgtaccacatgcacacacacagagttgtaatgacaatggcaaaaaatgtctgctgacattgccaaatgtcccctcgggaggaaaactgcctctagttgagaaccactgctctatccctttccaccaactcagggacccaccaccctctctcaggcaccttcaggatctggtactgttctggagtggcccgttgcagacactgaaccaccagccagctgcatttgttgtcctggatgtcagtgccaattttgccggtcacactggggtccccaaagaggtcaaggcacgctgcaatcctgtaccctgaaaccagctagatgagcatgtcctatagaggccaaggctaccatgggcaccctctgggcatcgggccctgtctgcaatacacctgcaggaagagctcgatcaggttcaggtaatagggctgctcccggcaatagagcttcagcaggcggtagatacatgcttccaggaggttagcatcattgatggcatccaaacccacgcccggctgtcatgacagacagaaaaacaagcaatcaatctctagtctcggttcatactaagagccatcaccccaacacctcaaccaggccatatataaccacctccctgtggcctgtccccatacccactgctattttcctgcccacattaccttctgataccagcagatctgtccccggcgggtaagggatgaatccatgatgtcatctgccaccaggaagaaagcttgcagctagaaagagtggaataagacctgcagggctcctcattactgttccttctatcagcaacagagctgctactttatatctgtatatagttttgcttttttttggtaggggacagagtctcactattatccagtgcagtggtgcagtcacagctcactgtagcctctaactcccaggctcaagtgatcctcccacttcagcttcctgagttcctgagaccataggcacataccccatgcctggctattttttttttttaatttattttttgtagagacagggtcccactatgttgctcaggctggttttgaacccctgggttcaaatgatcctcctgcctcagcctcccaaattactgggattacaggcatgaggcatcacagccggccagagctgctgcctttgacagtccctatgagctgggaaagtcaggatggggagacagaagacttctgtgctatggagacttggaaagtgacataacatgtttggctcagactccccgcctataaaatggaactaaaacactcttgttttaggttaagaaactagaacagatctttgacatctctaatgagccctagattattcctggtgtcagggagattaggaaacaccttcatataccgtactctattcttgccaaaaacctcaatgaatgcttaaagtaagatctattcatgaaactgacttcacattacttcctaaataaaagaaggctattcccacattgcccccagcactgtgtttgaacaccctggtgactaggaacacagccttacctaaagcagctccttagcagtgcaggtctaataaggtggaactgaaatctgactttgacctatgagtctcagacatctttaaacatctttaaacattaactaagggcttactcttctgagtgcccatctgaaggtacctgaacgtgtcgggtttcccactagaccatgatctccttggaagcagggacagtaacttccccctcttagcatttgcagagcctagcacagcattaggcctggagtgagagtttcctaaacacttgtctgacaaagaaattaataaaacactctaacattccctgtgatacttcttgcagtcagtcaaactatgttttggttccttaaatagcttttctttttttttttttttgagatagagtctcactctatcacccaagctggagtgcagtggcgccatgtgggttcactgtaacctccgcctcccaaattcaagcgattctcctgcctcagcctcccaagtagctgggactacaggcacctgccaccaccaactgctaggccagctaatttttgtattttcattcagtagagactgggttttgccatgttggccaggctggtcttgaactcctgacctcaagtgatccgcctgcctcggcctcccaaagtgctgggattacaggcgtgagccatcgtgtctgaccattaaatagcttttcaagacatggtttgggttgcttttttaaagagacaagggtcttgtcatgttgcccaagttggacttgaactcctgggctcaagtgatcctcctgtctcaactcttgagaatctagggatataggcacacaccagcgcacccagctcaagacatggtttttattttcataacttatttcctttttttgtttttccacttctagatacatacccaggtttttgtttttgagatggagtttcactctcattgtccaggctggagtgcaatggcgcaatctcggctcactgcaacctccgcctcccgggttcacgcgattctcctgcctcagcctcccaagtagctgggattacaggcacgtgccatcacacccggctaatttttgtgtttttagtagagacaaggtttcaccatgttggtcaggctggtctcgaactcctgacctcacgtgatccatccaccttggcctcccaaagtgctgggattttaagtgtgagccaatgcacccggccctatacccaggttttaatttttattattattttcttttgagacaggatctcactctgtcacccaggcttgagcagaagacatggtttgtgtgtttttttttttttgagatggagtttcgctcttgttgcccaggctggagtgcaatagcgcgatcttggctcactgcaacctccgcctcccgggttcaagcgattttcctgcctcagcctcctgagtagctgggattataggcatgtgcctccacgcctggctaattttttttttgttttttgttttttgtttttttttgagacagagtctcgctcttgttgcccaggctggagtgcagtggcacaatctcagctcactgcaagctccgcctcccaggttcacgccattctcctacctcagcctcccaaatagctgggactacaggcgcctgccaccatgcccggctaatattttttttgtattcttagtagagacggggtttcaccatgttagccaggatggtctcgatctcctgacttcatgatccgcccgcctcagcctcccaaagtgctgggattacaggcatgagccactgcgcccagcctaattttgtattttcagtagagatggggtttccccatgttggtcaggctggtctcgaactcctgacctcaggtgatccacctgcctcagcctcccaaagtgctgggattacaggcatgagccactacacttggcctagaagacatggtttttaagactttatcccatcctaatcctgtgtgctgtagtggatccacattgcaaaggaagcatgcaacaccgcctgccagagcccagcatgggccgtggggaaaggaccgttgcaatcactgctgttataggcagggtcctcagggaaggaggcatccatctgcatctttacctctgacctaaactcagaagagtagtgtggaggtcctgggctttccacatcaaaggcacatgtttaattgactctgtgtttatttggagtagcatggtttccctgaagccacccattcactgcctctcccaagggtgactgcaaggacaatcttgtttcagccaccaccactcaaccatgatggtctccaagataattaattccatggcctccccaaatttcctctgcctcctagcactgattcttaaccccaccagcactttctatttattagggaaattaaaaaaaaaaaaaaaacccaggccaggcacagtggctcacacctgttatcccagtactctgggaggccgaggcaggcagatcacttgagcccgggagttcaagaccagcctgggcaacatagtgacactccatctctaccaaaaaactatttaaaaagccgggcgtggtggtaggcacctgtagtctcagctacttgggaggctgaggtggaaggatcgcttgagcccaggaggtcgaggctacagtacaccatgattgcaccactacactcaagcctgggcaacagaatgaggctttgtctctaaaaaaaaatttagaccaggcgtggtggctcacgcctgtaatcccaacactttaggaggccgagatgggcagatcactcgatgccacaagttcaagaccagcctcagcaacatggtgaaacctagtctctaaaaaaaaaaagccaagtagaggctcgctcctgtagtctcagctacttgggaggctgaggcggtggaagggtggcttccgctccagaggcagagattgcagtgagccaagatcatgccactgcactccagcctgggtaacagagtaagaccctgtatcaaaaaaaaaaaaaaattaaaaatttttaaaaacttacaggtgaaactagggtgctgctagggttaagaactgattctaggccaggtgcagtggctcacacctgtaacgcctgtaatcccagcgctttaggagggcgaggcagatggatcacaaggtcaggagttccagaccagcctgaccaatatggtgaaaccccgtctctactaaaaatacaaaaattagccagggatggtggcatgtgcctataatcccagctacttaggagactgaggcaggagaattgcttgaacctgggaggcagaggttgcagtgagccaagatggtgccactgcactccagcctgggcaacagagagagactccatctcaaaaaaaaaatgaactgattctaccagttaaccactggcccctcaaggtcttgcttcccttggcccccatagctttactcctctgctctgccctcatcctccttcccttccttccttgcctgtcatctccatattttgaacccctcagcccctcagcatccctgtcatccagggccctctccctggatgccatgggcctattacctccttggaagcaaatctctattctccagacccatctccccgacaagttccagactggaatttccaccgcccacaggacaggcagatccacctgctccacccataccaagaacgtacccgggctgactgtgctcagcacgtcttcccttgagccagctgctcctctcaggccaggcactcagcatcatcgtcactcaccaagttctgaatgctcttcccttttgggctcactgccaccctcctcgggcatggcacccctcccagaacccagtccccctgccactaatgaaagctttaggccatgccagcaaactagacaccttcaagaccaagacgaactggtatagaagacaaggggatgtggggattggagcaaactagagaaagcacacaggagaacacatgccgtcttgcagaagttgcatccactcagcttcagccaattgttgctatgcgggaacatggacccaaatcttacaatttcccaagccatgctagaaatctaggttttagtgtgaaatctctttgttaaatttaggagacttaattgtaaaacattttcaaaatactgtcagtgagctgccagttttcaatttctgcttctgaatagcctttggaagacctctgtcacctttttttttttttttttttttgagatggagtttcgctgttgttgcccaggctggagtgcaatggtgcaatctcagctcatcgcaacctctgcctcccaggttcaagcgattctcct

SEQ ID NO: 68 - DNA, 9412 bp, Homo sapiens
cacacacacacggactgggccaggggttggactctgtgcaggacgctgagtcacccgtggaccagctccgccttccccaggaaacccaacaaagccaggagagggcttccgtttccgggccccgccagaacaccccagcaggtgtcagggacagggcagtattccagcttcagcctgtctacctctggagctctcctgatcaatacatcagagaagatgatggagccctcctgccgctcttggggagagttgcgtcgctgctgtcatcgatgccgtgctggacctcacagcgatagatacctgagtcgttggggcgcagctcgctcagcgccagggagacgtcggtgagcgacgctgggtacgcaggcagtgccacgcggaaccggtaggcctcgttcaccttgacgcgcactccccgcgccaccagcacctctgcctcccggccccgggacaggaaagtccacttgacccgcggagagcccagcacagcccggcggctcggcggtggccgcaggtagtggacgtggcaagggatggtgagggcgccgccgagcacgccctgcagtggcgcgtcgcccgcgatgcgcacgcgaaaagcgcggtcctctgtgaacgggtggagccggctggaacttaacgctgtcgaccctcagagtcccacccggtggcctccaagccccgctccaggatccctccttccggccccaggattccccggcccccctaggaccaggggccaggggccaggggccagggtcctgcagccctacctctaggtcctccaggaccaccccgacggtctccagacccatcccccaaagtctcccagtcaattcagcccccaggattccttgccctgctctcagagtcttccacttcctctccaaaattcctagaccacaccccagggtcctccaacctcgccccctgagtcctccagcccagtttcccagtctgctccctttagggcctccttcagggtttctcccagttccacccctttcccacctcctagcttcaggatcccctatcctccaccttaggggcccaaagccttgcacccagtgcccttccctagtcctgccccatgatttctccaacccaccagatgctcacagctcagcccttatttccaagtgttccagcctggacgcttccccacagccctccaattctctctcttcctggggcccctaagcctggaagcagttggttagggctgaacaagacagagacggtgaccccaagtggggttgcttacctgagctgtctccttccagaacatctgctaaagctgcaggagcctgggccaggaccagggctgccagcaggggcaggaacagctgggccatgctgcaggctgacagagggacatgagaaggaaagatggggttagacttcaggatggacttcccccctgctccctaccacacccatgtgggttcacacatatcctggctccagaagtcccctaccttcacatcaccatggactctctgtttctgatccccatcttcccagcaagtgatttcttctcagaaccaaaacccgagtcctagtcaactcactgtgtgacctaagccaagctccttaccttctctgagcctttattttcttacttataaaaaagcatcatcattactatctcatgagttgagataggaccatgtgctttgagagtgtttagtatcttaaaactcctgtacaaatgcatagcaccaggcagacagtaggagctcagtttacagcatgaatggtgggtgctcttatactcagaattccatctgctcctcccagtgccagactccttcctcgaacccagagccttctcccatagtatctctttagcctcttctgccttctagactgtccctgcctccagggacaccatactcacctggccttttccaggagggcctcctagaccgaacgcaagtaagcacagcttctcctgagcccaccctctcctctacttcctccccaccattatttgtaaggaaactcctctctttactccccaacattctccatcccccttccttggctgcctcctcccttcttcttcccagcctctcctttctgcctggcacgggctttcccaccggaactcttggctcagaaatcagttgggacaaagcccctgtctctgccagtctggcctctatccagcccctcccttcccccaccctaccttttgtgaaagccttgggctggagggtggactaaggggggggagaataaatgggaggggctaccccttcctacccctggctatcagaagctctagaacccagaatattcctccaaagatctcgaagcacttacactctcataaaaaggatgtgttgtgacattgagaaatggagactgaggctcagagaaggatagggctgaccctggatccctagtaaagccaagtcaggcacgagggcaatgtgctcccaggagagaagactcagagctacatcatctttaagggttgggctaaacttagaagagcatggagatccaggtatgccatggaataggccaatgatgcagcaagagaattgaaggttagactacaggcaggacttcctagagatcaggtttattccactggctgtgcactcccattccaggcccactgtttatcccccatcttccctgccctctcagcatctgccttcatacctgtccctgcactttcctaagcctgagatgatgggaaatttcctacttttcccagatcctcccacctccctgccatcataacccccatctcccccactgtgtctggatatcattccctagggtcagagttgggagaggagtggcacaaccagatgcttagggcctctctctgacctttcagagggaggaggttcttgatggggccagattagaggtgcggagaccagctccaggcattggggtgcttgggaggactgttctggggctggagtggggaccattgggcaggagcagccagtgcccaccgggtgctgggaagactgtttgccatgcatctgagctgtgccagggcctgggcctggcccccttctggtgccctccctcccttctctctgggctggagctggagctgctcacagacctggctcccatctctctgacgggcagcccagagacccatatagttggagtcattttggggccaacaccctggaccaccctttcacctctgtctgacagtgggagagtgagggaagagggcctaaggccaatgaggacctaactgctctggaacatggagggcaacctacccttgaccccaaaaatgggagtcactgaccagtgaggccaagagggtagccccgtgcagttctgagagagctctgtctctccagtctcgggcctcagcctcccaattgcagctaggagccctgaggaaactcagacttccccacatccggtaccagcctcagaacccaggggtccagggttctgtggccttctctatcccacacaccactcatctccacttcctcttctcttcctccagagcaggccacacctctccaactctaaccctgagagctcagcagtcatgcggtccgttcccttgacgccacaacatccccctctctgtttcagctccagcgtctgtatctctgcccttgttttgaatttcttgagctgttcaggaaactttcctcttgtcacatcatttctgtctgacccgggatgtccatctccctcacagtcttcatagacccaacccagagagttaagaccaggtctctctctctctctctctctctctctctctctgtgtgtgtgtgtgtgtgtgtgtgtgtaggcatgcacgtgtgtacacacatctaacaacacccaccacctccatgctgaatgcccatcagccggcagccaaggtctgtcccataggaactgagctccagcactcagcagggtcagcagggaggcacaagaagccagagctttggctatagcaggagggaagctctctgctacccccttaacggcttcatgaggagcaacatgagcctacacaatataagcagggccttagggcctgtagaagtaattgcaatcatcatataaatagtcctttttattggaagcaaaactaataatactattagcaatgacaccagccgagcagttgcagatccctctcgtatagaatctgaaatgtggatgatgctgttataaatagcaaagttagccatagcaacataggcactggtaatactgtgggtgggtctaagggtaacactgttccctgatcttactgtcatcatctgcaatctaagtaatgcagataataatggtgccccttggacttgacgccaatctcttggtcctattagaaccatgtaggcagagctattccaataggtgggggaatacctgacaggatatggaaatacctgggagagggaattcccaggcccctggcagtgctaggaaggaatgcaatagtggtaaccgaattccagctaatagttactgatgtctacctgagccagttctcctaaatgcttcctgtggataacctcaactgtgagaaaaagattgtttatgttttgctcattacaccgatgaggaacccgaggttcagagaagtcaactaactaccccaaggtcacagagcaaggagccgagttgggattccagccgaaatgggcactccgaccaccccctagagcggctctgatcggctgtcctgccggactacagtaaggtgtccccagaagggttgctggccgctgctcctggagctgcctgtgcgtgggggcacggaggcaaggactgatccggaacgctaccgccctgcctgggacaaggtcggaaatctcggcggccgcgctgggacaggagcgcgcagcagggaagatgcgaggacccgaggggttgctgatcagactgcgagcagcaggggggctgccactggcagagctggaagcatgtagatcagagatggcagcagcagctgcaggcgctcggggctgtccagcagcctaccccgctgcggtgtcaggagtcgacgagttgggtgccccagagcctcgaggcaagggctgacaggcggggggcgcagaccaggcaggcactcccttctccctgtccccgaccccacggcgggcggcggggctgcggaggcactcacctacccagggctggggttgggtcgcggcactgcgaagtttgtcgcctcctccgggggtctcctccgggtgcacggctcagtcctgcagctgcagctgagactgcggcggagactgcgcgagcgtgaggagaggctggggccgcaggacattcggaagagggcgccggccctcccggcgcagcacaaaaccccctttcttccccccgcccctgccccgccctccccggggccgcccccgccccctggtcgggagcgcggggctctcgggacggtcacgggacccgctgccttctctgcttcggctccggcagcagcggcgagagcaaggacgagcgaagtaggacatcgttcagcggatgagaagccgagggcttggagtagggaggaggggcaggaggggcggggagggagcgttcgcccagcgttcgctgagctaaaggatgacgatgttgcagctggaggggtggaagttggacaactggagagtcttctcgttgttcaaagaagaaggaggagggagtcaattagactgtaagaagtggatgaagggagaatgggggctttgctcctgaaaagagacaccctttctaataaaaaaaatggaaaactcttttctggaggagctgactttgcagctggaaggatggaggttagacagcagaatcatgggttaagcaaagcaattcaggaaatctctagacctggggtgggggtggggtgagggtggccctgtgaagggacattaccagtcatgcaaaccaatgtgcaaaatgcaggcgttgctgggagcccagaaggcctactggccagggctgtcgatgctgaatgtgcagcctgatgccagggggtgggccttgagtgctgcccagccaggaactcctcagcgcccagaataccaatgaccctcctttcccccagctccagggcctctgcttccctctcctttcccaggctctctttgcttttccctcctccctcctgggactgtaggcaaagcccctggcacggacagtgggcaggacagccagatgcctagattccctcccctggataccaatattggcaccaaggatagctttggagggctttgatcctcataatctccacagcatcttcaaaataccccaagtaaagtaaggtgcattcaatgcaaatgcaacctcaaggcagatccccagccttccatctagactgcaccctaggtccctcttgggaactctggactgctccccactgaatgtgccaacgcccccactcaccactgcctggctttcactcccagtgccatggacttggttccaaagggctttgagaacctcacataaaaacccactccaaatctttgagggtctaaagggaagattctggccccttcccagagacccatctactgtagggacaggaaaagaagacctggggggtagggaggggtagatggtaaatttccttaccaagaaaaatgccagccaggtgcggtgtctcatgcctataatcccagcattggaaggccaaggtgggcggatcacctgaagtcgggagttcaagaccagcctagtgaacatagcgaaaccccatctctactaaaaaaatacaaaaattagccggtgtggtggtggacacctgtaatcccagctacttgggaggctgaggcagggaggattgcttgaacctgggaagtggaggttgcagtgagctgagatcgtgccactgcattatatcctgggtgatagagtgaggctccctctcaaaaaaaaaaaaaaaaaaaagaaaagaaaagaaaagaaaagaaaaatgccccagaaaggatgcaagactgaaggggacagaggaaggtgcctgggacagtctggggaggaagggacctcgatctatttacttcgttagaccaatatgagttgaattgaattccagctgtggaccaggaactgctcgaggcctggaaatgcagttccaattcttctagtagaaagagcggatctgagaaggccttcggggacagatctgggcagccttaggatgtctttttgctccccttagaagttgcatttcagagctgcaagaaaaccccccttcctcaggacagtctcagcatggatgcatgtgtccagcctacctccacactggctctacagggcttgaggccagcagcacctgggtctggacaagggctggtaccagacagtctgttccaaaaagcagatccctggtgggagaccagacgtggtgagagaacagacagctgctgttgcgcagacgaggactctggcatcacaggcactgaggtcaaattcctgttttgtcatttgcagtggcaaacctcagaaagggccccgttcctcctctgaaactctctcttctgaacagtgggctgaataatatctactgcactgggcaatatctactgtacctgttctaggcaagggaaacccctggcccatgactcgggcttagcaaaatctagttcttttcctttcccagtcacacacacttgcgcacacacacagcaacctaatctgcccagatctcctggccaggaggtcagaggaccactgccctggagagctcattatttgggagtagagacctttccagaggatttctcaggggaggaaatgggcactctgaggcttttccaacatttccagctgagaaaatttatactgaaggctaacctgcagtttgaaccagcaattgctgatcagagactctctttacaattacggacacttggccatatgtgtcttcccccgtttctatttactttctgagaggaggcaagaatcagcctcctccagaggcaagaaccccctccagaggaggggctctgcctagcccctccagatctcagaaagagatccctggggattggctgaaagcaaacagaatcaatggcagcgggaagaatgaaagtcagatttcaggtagaacctcctgtctcagtaacaggagaaaaattcctccagtaaccttgaatatcttctgaacacggaaactgagacccaaagaggtcaagcaactgtccagagtcacacagcatggaactggctgaaccatgaccaaaaatcaagtctcctgactcccaggccaaggttcttgccagggctccccagatgtctatcaggggagggagaaagagggaggtggagagaagaaagagagagagggagagcgtgggcagctctcctccctctcccacgtgcagcccagctggctgcctcccagtctcctgggccctggggaattttccagcctctctggatgagaacaatcaatctcctgcctccaccggacccccaacatcccccatccatgccaaagctgaggccatgacccaagttgagaaaagagaatctgccctccacgctcctgcatcctgagttccccccatctccagtgttagccttgggccttcctcactggattctattccacagtggccactgggagagcctgtcctgccaacctccttgaacacctgccccctttctcccagacttggagtgggggcctaggcagctgagttcctctccgaggccctgcacgggcatctgggtcttgtgccataggcatgtgggagtagggctgaagagggggatgtggctctgaatgctggcacagctgtgttcagagaatgggggctttgatagcttctgaaagaggccaggaagcacgggaccccagcccaggcaggagggggtggggggcagaaatggctgagtgtggctctgagggctcttgctgccgcagacagggagtgtggagtgggaggggatgtggagcagtagggagacagcaatggggactacaggctgaacagcatcatcagagagcccccctgctgcaccagcaggagccagcgtccccatgagctggtcagaccgcgctttgagggttgcaaacccatgtgttcagaggagaccatcagcttgttgcacaaagaacagcgggaggaactggagggctggagcccgagtacatctgaatttacctcttgaggtcccaccagaaggctgcctgtagtgcctctcccagcctcctatggggaaggaccactcatttgtctgtgatgttggggcaggtactaatctccctgtgcttcagtttcttcacctgtaaaatggtaataaccccttgttgtatggttttgatgttggagccatgtaaatattttatataattaaaatacgaaattaattagagagagtttacattaattttaattaaattaaaatgaagaaaaatgaagcaatccctaaaagtataaaacaaattgtaacaaat

SEQ ID NO: 69 - DNA, 9412 bp, Homo sapiens; identical to SEQ ID NO: 68

SEQ ID NO: 70 - DNA, 9412 bp, Homo sapiens; identical to SEQ ID NO: 68

SEQ ID NO: 71 - DNA, 9412 bp, Homo sapiens; identical to SEQ ID NO: 68

SEQ ID NO: 72 - DNA, 9412 bp, Homo sapiens; identical to SEQ ID NO: 68

SEQ ID NO: 73 - DNA, 902 bp, Homo sapiens
tgcttatttgctctcagctctattcccacccttctgtgttccttgtttttcagaaggttagaagtctgcaaactacatttatcatttccattgtcagatggcttctgattagattttgtcactgggtggtattggttaaagttggatggaaggaataaattatatatttttccataatcttggtttctggtaatgttttcagtagtggcagtgatagcagaagatgagtaccgcttcagggttcctggtgtagcagtgcagttccagcaagcatgtcagaagtcttgctagtgtggtactggtgggatcaggctttgatggtggcatctgcagtgcaggaacagaggtgttgcctgcacaaagatgctgggaagagaaagtcagagtcatggccgacagatcttcatcctcccaagccaagattgtggaagccactggagacctggttcagaatccaggctctactgctctctagctatggaataatggagaaggccagaaggtcatgacagctggatcttagacagacattctgagtcatgaggaggaagccaagttctgaggatggtggagcaggaagatagaagttggaaccccaatgaccttgtgaactattctactgactgtgaactgccaactccgcacttttttacatgagcaagaaataaacctctttcttgtttaagccattcttattttagtgtctctggtacttactgtaacactgaaatccagcgggtttagagatcatccacagaaatggcgtgggtgaaggagaggagggtcattcaggaagagtaagcctgaagtccacgactgagccctgcgagagtgctcacatttatagaagagacaccatcaaaagaaacagaagagaccaagcagtaagagtgcaagagagg

SEQ ID NO: 74 - DNA, 1533 bp, Homo sapiens
acaaaatacctaagttaaaaaaatacaattaaaatacaagcctctaaactgcaggttataccacggatgtgaatattttagaaaatgttaatagaaaattctgaaaaacgttactggatattaagtaatatctcctttcttcaatcttgtgattaacaggacttttattggtagtaaactagagcaaacaatcagaataatacatatgcagtattcagtacacacaataaaagttaaagaaattcaaaacctgtataaaacaaactggagaaaaatcatacagcttaagagatacagtggtaaaggtcctctccatcctttgattacagcttgtactctgtactcaatagaacttaccgcacttactgaaataagaaataaacactttttagtactcagcgtatttaagattaagtacattttctaagaatcttgcaatgacaagttggtgaccctttagctgctaaagctaaagggaggaaagtgggaaaaggaaattaactaatactttgtaaccatttttaatatttcttattttccaaacactgcttttataacagaagtgttttacacttgcacaatattaattactttattatacatggaagcctgcggtaggctgattacacaataagactgcaaacaaccagtggtacttttctgacgtcagaagagtacataagactgaaacatcaccaaaagtacataaaaaactcatcagcataaacatcaaagtacattaaaaaatataatcaggaaaaaaatacaattgctaaaaagcagttttagagtagagccactgccaatcagtagcttcaaatggcaattagagttcatagcaagttttgatgactttacaagacccctgtacaatactaatgcaccctttcattaaaatgtacattaaaggccgcaatttcacaaagaggttctgatgttattactataagcagacacattcttatccctcacaggagttatgtcaccagttggaattacaaccttattaatatctatccaagaacacggggttttattacatatggaaatctgtatgggtttttttttttttaaaggtgggttttggggatgtttaccctattgttttttatttggatgccctaaggcatataaagcgcatagtgaattacctactggaatgtaaatggttctaaaattaaaactgttaaaatagaaagagggaaaaggaaggcccaagaactcttaaagagaggctgagaacaagaacaaaaaaacccagaagtgtaggtaatacgtaacagcgcagacagaaccgttgtaggccatgtatattaaatgatgaaatgtatatcatactatctgtaaattggatattccattacagtgataacgtacagaattcccatgcgttattacactttcctgagagtaaagcaattagaataaccttaatcctagcaacaaagttttttttgtaggttttttttttttggtttttttttgtctttttttttgcgtttaaaacatttgggctattccctgacgatctat

SEQ ID NO: 75 - DNA, 4404 bp, Homo sapiens
gcagttagttttggggctggaaatttgagcagagagaatggcagagtcttttcaggagccagaaatgcatgtgaggaccaagaacttctaacagtagaggaactctggctggggtagttgagggggaggagaaatgaggatcaagggggcatacagtgcatgaaaacaaaaggtgaggcccaagatcagccaaagtgagtaaaccacggttaccatggctactcttcagtggagacggaaggaagccctgtatcctccccttccaaccacactacgctgttccactccccatctccatctcctgtaccccagacacactcaggcaagcacagcaccaccctggatgactctgcggaatgcctctcagagacacggaactagaaacctaggggaagagggacatcaaggcttttgcctcacaagctgactctggaacaaagagccaggctgaggggctggaagaagaaacttccagcagagccacccagatatgcttcccccaccctctagaccttccacaccaaccagtgtccagtcagtccacagagcatcctcctgggctgtggtgactgaagttgaagggaagaaaatataataataattttgggcaggtcgtctttctttactgtattggatggatatagaatcaataaatctataggtttatcccatttttctgaacaaatttagaggtcaaagatgaaccctcaaggggacagaatatgaccagcaggactattgatatcgtctgccctaggcactcctccttaccctcctctcccctatattttgggggcagtcatattcctcagcagtcagttgctctgcctccagtcctaactggcttctgaaaaacagttctggtccattcattccctgtctcgagacttccggagcttcctgacctgtgaatgaaatccacaggcccatcacaagatggctgcgctctccagtccccggcaccccaggctgctctgaacatgtgagagctcctccctcaaggcctgaattttcgcaggtcttcatcacactcagcccgccatcattttttcagattcagttccaatatgtcactctgtctgtagagccttccctgaatctcacagacaaatgcggcagttccctttgtgggggatattcatcatgtttttcctcattggcctatgtttttgcctcttcttgtagatgtccatctaggctgggagctcctagggggtaaacgcagcctctcactcacctggcacagagtcgatgctcatggaatgatacgtgatggggagagtgagtaagtgaatgaatgaatgaatgctattctggaaggaagagggagagagggagcagggaaaggtcagaagggggcccagagtcttcagcacacaatgtgggtgtatcactgtggccaggaacaattcgcttctctgcctgcattactttttgggaaatgggagagctgaggctcagtgtaggcaaactgggtccagtcagcagggaagccatgagctccacggtttaggggaggagtccggtgcttaaggaagctatcacgtggaagatctccctgccctcctcctattggtctgtattggtttttcttcttcaccagtggaggcttttcttctcccaggaagaatccagaatagttcagacaagcttcaggtccgccagaaccggggaaaacaacgtgtagggtttgttttaaagggcttttaaatggggtttgggagatccaggtagattagaatcttgactctgcactggctgtgcaagacagaaattcacctttcaaaacttctgttccccagtctatgcggtaagaagtttagattagctgatttctagggagattttgggcaggcatgattcagttccatgaagggctgtgggacaggactgcactaagaggtcctatagattggattcttcagttccctcccttccgctggagaatagaggaatctgccttcgctgcacactagatttacctggagaacaaatggaaagcaggccaggatcctgggtgaaatgtggcacatttgaggagacttcaacttcccttgccctccagtgtggtcttttccccacccccagacatgaaagggaagcaggtcacaaagcctttcggattataaaagaaacacttgcttctcacaaggggagcagcagacttactctgtactaaatgccaggataagcctctggctgggcctcgactgtgaccctccggcctctttctacagctctgcctggatggactggcctatctctgctggattcccgaagtgcattgtgtagagacagcaactcaggtcaggctaaaagctcaagcaagcaagcgcgcacacacacgcgcgcacacacacacacacacacacaaacactcagcttccttaggacaagataaaatcttagcattcccctctccccgattaggtaggtctctgggaggactaaggcttcaggtgcaaggctcagataacctgcagtgtctctccaactctgggatgacaaagacctcacttcccttttctggtgttcacacaacaatgagaaagtacgggtagcctgcagaaagacctctccattcatggtcccccaggggtgtgggttctgagaggtgggaccagctgccaggccctttctccattggttgagttcagcaggtaacctgaagctttgctgagaggtgcataaataaagagtgaaactagtaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccgggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaagcctctctgcctctatgttttataccatcggatgccaactcccggccttctaagccacctcccctttaggctaaaactggtccccaggcaggtggctgggacactatttgcaatcagcaaggaaccctgctgcccttagactccccacagagcaagcagaacttgcagaatggggtaaaaacactctattaaagattttttaaacctatttatattgtaataaagtaaatgtaaataaaatttaagtgaaggcagattgcagatatttccgatgctatacaagatatatctcatagtatgggtgtagattctgcaaaggttaatgcagttaaacatatttgacacataaaaatgtcagatccaacattaatcattcaccaattgtaattgcctttctatgggtctcttctccccaagacatagcttaaaacaccaggctcggtagaaatctgggaggaaaaaagcaaataatacctctcagctgtcagggtctatgatacgctttgatagatttagcactgatttcattctctttacaattcagtgtgattgggtgtgcgtgtgtgtgtgtgtgtgtgtgtgtgtgtgtgtgtgtgttactccatgtttctcctttttaaggaaggagaaggtgtggaacaagagaaagttcctaagtctgaaggaagtccaacccagttatgaagggaatgccatccacaagccttttttataattggcccctgcctcaggtaaaggggtctcctttaaggagccagtctggctaaattggcagattctgaacaaagcctggccctgacaagtcttcagaaaaaccggttttcacctccagaatgtgccccag

SEQ ID NO: 76 - DNA, 4404 bp, Homo sapiens; identical to SEQ ID NO: 75

SEQ ID NO: 77 - DNA, 2753 bp, Homo sapiens
ggcttttcttctcccaggaagaatccagaatagttcagacaagcttcaggtccgccagaaccggggaaaacaacgtgtagggtttgttttaaagggcttttaaatggggtttgggagatccaggtagattagaatcttgactctgcactggctgtgcaagacagaaattcacctttcaaaacttctgttccccagtctatgcggtaagaagtttagattagctgatttctagggagattttgggcaggcatgattcagttccatgaagggctgtgggacaggactgcactaagaggtcctatagattggattcttcagttccctcccttccgctggagaatagaggaatctgccttcgctgcacactagatttacctggagaacaaatggaaagcaggccaggatcctgggtgaaatgtggcacatttgaggagacttcaacttcccttgccctccagctctgcctggatggactggcctatctctgctggattcccgaagtgcattgtgtagagacagcaactcaggtcaggctaaaagctcaagcaagcaagcgcgcacacacacgcgcgcacacacacacacacacacacaaacactcagcttccttaggacaagataaaatcttagcattcccctctccccgattaggtaggtctctgggaggactaaggcttcaggtgcaaggctcagataacctgcagtgtctctccaactctgggatgacaaagacctcacttcccttttctggtgttcacacaacaatgagaaagtacgggtagcctgcagaaagacctctccattcatggtcccccaggggtgtgggttctgagaggtgggaccagctgccaggccctttctccattggttgagttcagcaggtaacctgaagctttgctgagaggtgcataaataaagagtgaaactagtaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccgggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggaaaggaccaaccacaccgagctcagttatggcacacacagtgggacctagacaaagggagagggtgaccgacatcccaactagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaagcctctctgcctctatgttttataccatcggatgccaactcccggccttctaagccacctcccctttaggctaaaactgagacatgaacttgaaaaattgacactggcttcctctctctttagggtccccaggcaggtggctgggacactatttgcaatcagcaaggaaccctgctgcccttagactccccacagagcaagcagaacttgcagaatggggtaaaaacactctattaaagattttttaaacctatttatattgtaataaagtaaatgtaaataaaatttaagtgaaggcagattgcagatatttccgatgctatacaagatatatctcatagtatgggtgtagattctgcaaaggttaatgcagttaaacatatttgacacataaaaatgtcagatccaacattaatcattcaccaattgtaattgcctttctatgggtctcttctccccaagacatagcttaaaacaccaggctcggtagaaatctgggaggaaaaaagcaaataatacctctcagctgtcagggtctatgatacgctttgatagatttagcactgatttcattctctttacaattcagtgtgattgggtgtgcgtgtgtgtgtgtgtgtgtgtgtgtgtgtgtgtgtgtgttactccatgtttctcctttttaaggaaggagaaggtgtggaacaagagaaagttcctaagtctgaaggaagtccaacccagttatgaagggaatgccatccacaagccttttttataattggcccctgcctcaggtaaaggggtctcctttaaggagccagtctggctaaattggcagattctgaacaaagcctggccctgacaagtcttcagaaaaaccggttttcacctccagaatgtgccccag

SEQ ID NO: 78 - DNA, 2753 bp, Homo sapiens; identical to SEQ ID NO: 77

SEQ ID NO: 79 - DNA, 2336 bp, Homo sapiens
ggcttttcttctcccaggaagaatccagaatagttcagacaagcttcaggtccgccagaaccggggaaaacaacgtgtagggtttgttttaaagggcttttaaatggggtttgggagatccaggtagattagaatcttgactctgcactggctgtgcaagacagaaattcacctttcaaaacttctgttccccagtctatgcggtaagaagtttagattagctgatttctagggagattttgggcaggcatgattcagttccatgaagggctgtgggacaggactgcactaagaggtcctatagattggattcttcagttccctcccttccgctggagaatagaggaatctgccttcgctgcacactagatttacctggagaacaaatggaaagcaggccaggatcctgggtgaaatgtggcacatttgaggagacttcaacttcccttgccctccagctctgcctggatggactggcctatctctgctggattcccgaagtgcattgtgtagagacagcaactcaggtcaggctaaaagctcaagcaagcaagcgcgcacacacacgcgcgcacacacacacacacacacacaaacactcagcttccttaggacaagataaaatcttagcattcccctctccccgattaggtaggtctctgggaggactaaggcttcaggtgcaaggctcagataacctgcagtgtctctccaactctgggatgacaaagacctcacttcccttttctggtgttcacacaacaatgagaaagtacgggtagcctgcagaaagacctctccattcatggtcccccaggggtgtgggttctgagaggtgggaccagctgccaggccctttctccattggttgagttcagcaggtaacctgaagctttgctgagaggtgcataaataaagagtgaaactagtaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccgggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgaggaaaggaccaaccacaccgagctcagttatggcacacacagtgggacctagacaaagggagagggtgaccgacatcccaactagggtccccaggcaggtggctgggacactatttgcaatcagcaaggaaccctgctgcccttagactccccacagagcaagcagaacttgcagaatggggtaaaaacactctattaaagattttttaaacctatttatattgtaataaagtaaatgtaaataaaatttaagtgaaggcagattgcagatatttccgatgctatacaagatatatctcatagtatgggtgtagattctgcaaaggttaatgcagttaaacatatttgacacataaaaatgtcagatccaacattaatcattcaccaattgtaattgcctttctatgggtctcttctccccaagacatagcttaaaacaccaggctcggtagaaatctgggaggaaaaaagcaaataatacctctcagctgtcagggtctatgatacgctttgatagatttagcactgatttcattctctttacaattcagtgtgattgggtgtgcgtgtgtgtgtgtgtgtgtgtgtgtgtgtgtgtgtgtgttactccatgtttctcctttttaaggaaggagaaggtgtggaacaagagaaagttcctaagtctgaaggaagtccaacccagttatgaagggaatgccatccacaagccttttttataattggcccctgcctcaggtaaaggggtctcctttaaggagccagtctggctaaattggcagattctgaacaaagcctggccctgacaagtcttcagaaaaaccggttttcacctccagaatgtgccccag

SEQ ID NO: 80 - DNA, 2336 bp, Homo sapiens; identical to SEQ ID NO: 79

SEQ ID NO: 81 - DNA, 741 bp, Homo sapiens
ggaggtaattgaatcatgggggcaggtctttcctgtgctgtgctcatgatagtgagtaagcctcacaaggtctgatggctttataaggctaagtttcctagcacaagttctctttgcctgctgcaatccatgtaagatgtgacttgttcctccttgccttctgccatgattgtgaggcctccacagccatgcggaactgttgaaatacacactacctgaagctggataactcatgaactctgttgacaattatattctttgtctttttaattaactcatttggagttggtgtcctgaggacctaagcctaagaatcttcaagatggaagagtagagtgaacaatgaatgagccagagggctcttgtcctctgtgtgcagctctgggcagccagcaggtggatatgggacttggcctgctggaggggccctggcaagaggagctggcaggagcagatggcaaaggataaagcgctcccttgttggtgtccccacagtccaggctggtgctgatgccgtcctgccgtcctgcatcagagccactcatgcccgtgtgcgcactctttgtcggggtctgacaccgttgcatcgtatatcacctgtgttgtcatggtcagtgctcaacaaatgcccctactgattcaagtatatgagcaagtcaaataaaaaaataatatggccgggcgcggtggctcaagcctgtaattccagcactttgttaggccgaggcgggcggatcacaa

SEQ ID NO: 82 - DNA, 741 bp, Homo sapiens; identical to SEQ ID NO: 81

SEQ ID NO: 83 - DNA, 475 bp, Homo sapiens
taaaacttagcaatttaaatagaaatccatagacttactcttcagaattaaagtgcaaactacttagagatcataaatacttttaatatcagataaatcattaagaaattgcattctgtacttgatgaccacacgggaaccttgctagagtcaagagaacttgtcactagtaattatgaagacacctttacggtgagcgttattaaaaccctactagaggttttgggtgggactcaagagcaaggggtggccacctgtggacgagggttccctgttgttaacagaacacgttgcccacctcgcaagtatgcagcccaatcagtccccagggtctcggttcccgttgcgcccttccccatggccactgcgctcattcatgagcctagggtgatcaggcctccggcctataaagaactgcaggatcagtgcggctcttttctcgagatagtaggtggctctgaaaagagcctttggg

SEQ ID NO: 84 - DNA, 475 bp, Homo sapiens; identical to SEQ ID NO: 83

SEQ ID NO: 85 - DNA, 475 bp, Homo sapiens; identical to SEQ ID NO: 83

SEQ ID NO: 86 - DNA, 475 bp, Homo sapiens; identical to SEQ ID NO: 83

SEQ ID NO: 87 - DNA, 475 bp, Homo sapiens; identical to SEQ ID NO: 83

SEQ ID NO: 88 - DNA, 475 bp, Homo sapiens; identical to SEQ ID NO: 83

SEQ ID NO: 89 - DNA, 475 bp, Homo sapiens; identical to SEQ ID NO: 83

SEQ ID NO: 90 - DNA, 3863 bp, Homo sapiens
gccgctggctccgcccaccgcgtggtccaaggaccaccacccgccaccgccgcgcgagcgtactattgcggccgccctctgctgcgcctgaagagagaggcgactctacaagcctcacagcatgcactgttactaaaaagacgatgcgtcctcctggacctgagatctgtgtgatcgtgggaaagcgacgaaaaacgaacaaaggaacagtaaatggagtaacttggctagaatatggcagtaactacaaggcatgttctgctctggcacgaagatgcagtctcgctctgtcacccaggctggagtgcaatggcacgatcttggctcactgcaacctctgcctcccaggttcaagcgattcttctgcctcagcctcctgagtagctgggattacagacaacccacctgaggcaccagacacatgagtgaagccatcttggacatcccagtcacagccaaactcactcctgagtgcatctgcatgatgaacccagcaatccccaccatggagcaaaggatccatccagtcaacccaaagaatcgtgaaaaataataaattgttgttttaaagttcttcagtttgggaatagcttgttatgcaacaatacataattaatacactggtctcccactttcaagtttgattaactttcagctatttttcacatagcaggcagagtgattccattaaaacatatatcagataatgtcactgcactaagtaaactctacaaggactctcatctccctcagagtaaaggtcacagttgttacaaggccctacgtaatgtggccctcaccaccactccattacctttttcttatctactatttgctaactttgctttgtcctcttttctgttctgaaacaggctaggcatggtcctgcctcaaggcctttgcaccacctactctgtctgcttggattgttcttcccacagatttcttgctcccttcttccttcatgaagaaatgtcatgaaatgtccttccttcatgaaatgtcaccttctcatttgaggccttctgtagtaccccaaagaatggtccccaaagatgtccacatccttatgcccagaacctgtgaatgtgttatcttaatggcaaaagtgactttgcaaatgtgattatatttaaggatcttaaggaggagattatcctggattatccaggagggcccaatgtaatcacaagggcccttataagtgaaagggggaggcaacagagagaaggagatgtcataatgaaaacagatccaagtgatgagattgctggctggggtggaggtggaggggggtacaatccaaggaatgcaagaagcctctaaaagctaggaaatgtcaggacacaaattctcccctagaacctgaggaagaaacccaggtttatggacactgattttaacccaataagtcccttttctgactgctgacctccaaaactgtaagataataaatttgtgttattttaagccaactgagtttgagataatttagttatggcagcaataggaaactagcacaccttcctagccatcctatctaaaatggcaacccatgtccttcctggcacttcctatctcccttccatgttttttttaaatcatatatacaatatattttactgttttacctattgtcttttccaccagaaagtaaactccacgtaaataaggattgtctgttttattctttgcagtatctccactgcctaggatagcatctgcacatactgcacactcagtacacatttgtcgaatgaggtcaggcgcggtggttcacacctgtaatcccagcactttgggaggccaaggcgggtggatcaccttaggttaggagttcgagaccagcctggccaacatggtgaaaccatgtctctactaaaaatacaaaaagtagttgggcatggtggcatgtgcctgtaatcccagctacttgggaggctgtggcaggagagtcacttgaatctgggaggtggaggttgcagtgagccaagattgtgccactccactccagcctgggcaacagagtaagactctggctcaaaaaaaaaaaaaaagaaagaaagaaaaaaatacatatttgttgaatgaacaagtgaatgaacaaatgttatgcaaatatattatccctatctgtagcttgccttttaattttgttatagtaactttggttgaaaggaagttctaaaatctttaatataatcaaatgtatcaatcttttcaacttgtatattttatgccttgtttaatcaactctgtcttatatcaaaattataaaagtattaccctgtattttcttataaaagttttgaatcttttctttttccacttagatcattaatcaacttggaattggtgttacatagtggtaaatgattgtcccaggaccacatattgaatattttatcatttctccactgatttgtaacaacacagtggttatatatcctgtttatacatgggtctgtctctaggtttccggttctgttccagtggtctgtttgcttacccttctactaatagcacattggcctaattactataactttataatgtggctcaatctctggaaaaccacatacctctcccctcctctttctacaatattcttatattttgcaactggcctttactgttttgtattatttttaacaataccttatatacccacatatattagatgctcttagcatcactatttatagcatctaaaaattggaaattatttaaatgtccaccaatacattagttaaataaattaggttatactcacatagtggaatacgatactggctttcaaaagaatgaggtaaatttacatatctacattaaaaggtattcaagatatcagaaaaaagggcaagttgcaaaacaatatttagagtaagaacctattcatgaatttttttaatgtaatttgtgttacatgtagaaaaaaatatgggcaagaatacatcaaaatgttaacagtggttatatctgaggatcaggaataggaagaacattcgctttctaaggtagaaaaaaaataaaaggaatccagacagaacaaagaatgaaactatggacacaggcatgagagaaatgcacttatttgtggcagtactattgcagagataatgggagaggtggtaagagctgagactggaaaagcagagtggagccagtgtgcagaggatccaatatggcaccctaaggagtctgacttcatcctgcagtggtgaatgggaaatcatctaagtttattattattcgtaagcacaggggcagtgtacaatttctgcgttgagaaaggagaattctgaaatggtagttttgaatggtggatttaaagtgggagattgatttgagcctttaacattgcagtttaaaaacaaacagaattttaaaaagcaagtgggagatagatattgaaagcaggaagaccattcaggagatagccacaatagtctagagagagatggggaaggtcagttgtatgtcagaccaagcagcatgtttgaaacactgaagaaaaaagctccagtgatccacgtatgagtggcctgacctacggagtatcgaggagaaggagaggaaggcaatagaaagaactagacatgggttgaactcttggtagcctgactagtgcctgactgttcttcaagactctctcctgaatagatttgaccttttggaccttctagggcccttttcatcacttgttaccagccattgctacctcctggagccccctttaatctggagccccctttgatcacttgttaccagccattgctaccaccctgcaccattgcaaagtggaatgtacgtgactcttctcaaagcccctagaactatatacacacatcattgtagcactt

SEQ ID NO: 91 - DNA, 1661 bp, Homo sapiens
ctggctccgcccaccgcgtggtccaaggaccaccacccgccaccgccgcgcgagcgtactattgcggccgccctctgctgcgcctgaagagagaggcgactctacaagcctcacagcatgcactgttactaaaaagacgatgcgtcctcctggacctgagatctgtgtgatcgtgggaaagcgacgaaaaacgaacaaaggaacagtaaatggagtaacttggctagaatatggcagtaactacaaggcatgttctgctctggcacgaagacaacccacctgaggcaccagacacatgagtgaagccatcttggacatcccagtcacagccaaactcactcctgagtgcatctgcatgatgaacccagcaatccccaccatggagcaaaggatccatccagtcaacccaaagaatcgtgaaaaataataaattgttgttttaaagttcttcagtttgggaatagcttgttatgcaacaatacataattaatacactggtctcccactttcaagtttgattaactttcagctatttttcacatagcaggcagagtgattccattaaaacatatatcagataatgtcactgcactaagtaaactctacaaggactctcatctccctcagagtaaaggtcacagttgttacaaggccctacgtaatgtggccctcaccaccactccattacctttttcttatctactatttgctaactttgctttgtcctcttttctgttctgaaacaggctaggcatggtcctgcctcaaggcctttgcaccacctactctgtctgcttggattgttcttcccacagatttcttgctcccttcttccttcatgaagaaatgtcatgaaatgtccttccttcatgaaatgtcaccttctcatttgaggccttctgtagtaccccaaagaatggtccccaaagatgtccacatccttatgcccagaacctgtgaatgtgttatcttaatggcaaaagtgactttgcaaatgtgattatatttaaggatcttaaggaggagattatcctggattatccaggagggcccaatgtaatcacaagggcccttataagtgaaagggggaggcaacagagagaaggagatgtcataatgaaaacagatccaagtgatgagattgctggctggggtggaggtggaggggggtacaatccaaggaatgcaagaagcctctaaaagctaggaaatgtcaggacacaaattctcccctagaacctgaggaagaaacccaggtttatggacactgattttaacccaataagtcccttttctgactgctgacctccaaaactgtaagataataaatttgtgttattttaagccaactgagtttgagataatttagttatggcagcaataggaaactagcacaccttcctagccatcctatctaaaatggcaacccatgtccttcctggcacttcctatctcccttccatgttttttttaaatcatatatacaatatattttactgttttacctattgtcttttccaccagaaagtaaactccacgtaaataaggattgtctgttttattctttgcagtatctccactgcctaggatagcatctgcacatactgcacactcagtacacatttgtcgaatgagtcactgcccccggctgcaaatatatc

SEQ ID NO: 92 - DNA, 1661 bp, Homo sapiens; identical to SEQ ID NO: 91

SEQ ID NO: 93 - DNA, 1661 bp, Homo sapiens; identical to SEQ ID NO: 91

SEQ ID NO: 94 - DNA, 1661 bp, Homo sapiens; identical to SEQ ID NO: 91

SEQ ID NO: 95 - DNA, 1661 bp, Homo sapiens; identical to SEQ ID NO: 91

SEQ ID NO: 96 - DNA, 4840 bp, Homo sapiens
tgacaagataaatgaggccctatcagccagcaataagtaccacactgagcactgagacagggtaatgagatctggcattgctgggtggctgctttccattggatggtcagggaggcttcttggaggaacaggatttaacttgaggccaaaacggcacaagggtagagccatataaaactaaggagaaaccattttaggatgagggaacaaaccctgaaggtgtgaacaagctcggtgcatctagacatgtaaggaaggttccagcatgtgaaggagcgaggacggagaagggtccggtgaggtcttacagcaacagagggtccagccacatgaggctgagcagccaagtgatctgcctaggccagctccccttcatcttctgccatgagtggaagcagcctgaggccctcaccagaagcagatgttggcactatgcttcttagacagcctgcaaaactctgggaaagcggaaatctggagaactaaaatatcttgctgaagatcacaatgcagtaaagcatagggcaagtttccaactcgaacatcaccccagaacacttccttttaaacataaattatgttgctaacttttttattgttacttagcaggcagatttcaaactgatacaaatgttgaaaatgatacaaaatgttttcccaccttaaaggcattctgaaacctagcacataacatctgtcactgaagtccatagtttccaatgccatgattggataaagaccctattgagactcatgtgtttgtctctcactgcttaaaacactcatgtgttttaagcaacatgacaagcacaaaagagaacaagtactgctcctgctctccaggaagttaccataaaataaaggggataaggtgccttccaaagaaaaaacaaatactaggagaggtcagaggagaagagagattattccagaaggagagactgaggcagatttcaggagggaagaatataagagtcccaaaagaagaaacaggaacccaggttagagagcaatgggcaaggggtaggaggtgagactaaactcacaaggaagttgcttcaaaacaatagtgccccaaatgccaagctgatgggttggacccatttaggaaaaacccacaaagtccacaggagagcagactgcacttccatgagcttcaagctgtaaacagtaacctcaaataaaacttttcccggatcggtaatttccatcctgaacaatggccaagtcaaggaagctgaggatcgagccccctaccgcatgccacaaagaacctcaagggaccccatgctctggggagctcgcaggaggaccagcacagaggtgtgactgcgttggggcagggtggccacatgtacaatgttgtaccttccaatgttcctccttaggctgtgcttatgaagtcccaacatgtcttctgggctgtgttttcaaccaagagagttaataaaaagtgggatgggcaccaactatgcctccagagacatcaggcagaatatgccacagcgtgccatgtcctcctgcaaacagtcagaaagaaaagatctctaaaagcagattggaagagactatatatacagagcgagtgccggtacagaagttttgctgcaaatacaccctctaatcccttgcaacccactgcaagctcgagagaccagtgcccttggtaaaacataggagagatcattaattaaagcctaggccctttctttgatcctgagggataaggcttgggaaaatgcacagtgataaaagtgaacattttaaaagagcagagtgagtgtgaattcccaaagagaccattcatatcaagacccaagccatgagaaaatgctacaatgcccttgatcaatactttataggcattttgacctcagatctaatcccatgaggcttagaccaagaccttgcttgatgcagacctctctgactgctgaaattggtcaggagctcagtgatgaaaatttggaaagtcaatgctgatacctgaagaaagtcccatcagagatctgtgacctgaatcttcataactttcacaggccctttctaaatgccaaggaggatgtgtgtggagaagaatatgccacctatggcatcccaatatgcctgtgcccgcctgctcttcaacaagggaatgaaacctgggtattctcataggttttttaaagcacttgtccacatattttattccgcaaataacacaatttaaaattcagctagaatttgccattttctgtcagggttgtgcatttcttccagtcaccatgacttcctgagatagccaaaacacaaaatttaaattgtgtttaaattaaataaacacaatttatgctgaagctgactttacccactctgttccaacattacttatcctcagcatctctgaattcaaatatcagccaggtgtggtggctcatacctgtaagcccagcactttggcaagccaagatgggaaggttgcttgaggagttggagaccagcctgggcaacatagcaagacccccatctctacaaaaaaattaaaaaattagccaggcatggtggtatgcacctttagtcctagctacttgggaggctgaggtgagaagatcacttgagcccaggagcttgaggtggcagtgagtcatgatcataccactgcactgtagcctgagcaacagagcaagaccccatcccttaaaaaaaatacctgccctctgtacttcatagcacctggggcattttgaacagttcttccttcacctgaggtcattatttgagaatccaattttagagactacaatgctctcattacttggattgtatcatttaatcttcccaacaatccaggaaggggagtctcttaatgattgtccttgatttccagttaaaaaatctagacccagaggtaaccttgtgaaggtcacagagtttcagagttctaagatcccatgcgagattgctgaacttgaacttgtttcttctgatctcatgtcaataagtgacttagtcaacacctgggtagaaatcatcactaaagtgagaaagcacatggtgagggggatgaatcctgtgcccacatggtccctttcacctgcccaatcctcaggcctctcacctggggtacccctcacacacatggcactttcctgaactcatggacatttcagtttgtaacgatcctcctaagattatctactttcacctatccacatttgaactatacttctttagtggaaaaaaagaaataaagccagtgctgagaatgatcaaactccagaaatagtagactgctgtataatttgtcttgcgtgacaccagatctttcaaggaactgcaagctcaagtgcacagttaagcaagatcaagatctacctttgtctttcagagccttcccttggcgaggtcaaggatatctgctgtgagcctgggctggctgaaccaaagggcaatggaggcggccaagaagccccagccaactgctcccctccccaacccccttctccctggaggtcccttcagctagaatttgccattttctgtcagggttgtgcatttcttccagtcaccatgacttcctgagatagccaaaagcatttgctgtgagcagagccccatggctggctttgcacatcaaacatttcagacagccatatatttcatagaatacaaggggaagataacactggacacacagaactttccaacagcttgagaaaatgtggtgcctggtgactgactaaatatacaatcggacaacagccaggccatagcaaaagatggaactctgatccacaaggtgcagcaactttcccagaaaacaatacccttacccacaaaaagcaaccccggaagctggcctgctctaaatcagacctgctggaagccaaattgctctctagtaactatccaggaagctaaataataacttctgtaacaattgactcaaaatgttcaggactggattaataactgatggcttccctaatttttgtccccgattccaacttaggacccaccagagaaagccaaatatggtcccctgaccaagcacacaggatgttcgcttctagtgagccgcctccagcttccccgcattgataacctccaatcagggcacacctgaagccttcgcctttttccactataaagctctcccactcgtctgcccacctttgagtctctgccaaattgcaaatgatggtgtctgactcccttgctgtagcaagctctgcataatagcttgtgcttattctctttgggtaggtcttcatttcttttcacaccagataggcatcatctttgaaaacatctttactgggtctcttgtctccctcctgcagccactgatctaaatcacagacttttttagaaagagggaaaatagtaaagaaagaaagcgattgagttgatgctcccagccactgtctgtaccctgaattttgtttttctgccatatgtcaggtggcctctcctggaccatcgtcactgtttctcctgcttccctgcagctgcagacacaggagcactgtgtaggtctggccttgagcacccacccacccagtacagagccagcccctgctgttctgaatcagtgcagtgaccacttagaacacagtgcccatgcctctgtgatctgaactgctctttccagttccatacaatgttaagaacccacttaagaatgttttaatcattcagtagtttttcgtggtatataataaaaaagtgatttaaatacaatctattttattttagattatatcattaggggttattttacaaagttacctttaaatactattgtaaataaaattaataacaaataagcaaaattcttacttttccttgtttgacaatt

SEQ ID NO: 97 - DNA, 9637 bp, Homo sapiens
tctaggatacaaacttgaatcttttcagaacataacaactagaggaggccttgcaaagatttaacagcaggaggagaggctgacagcaggaagagcacatgagaattcatagttatagctaagtgttttattagaaggtttacatatactgctctaccttttatataaaagaactatatggaaatggatattagtaggtatatttgccaggagtttttcacatattacacatatttaacaatttaacaggcattttactttttaaaagttttacagttctatatatcacatctatcatatttcatattatcacatatatcacttcagttgtccctcagaatgactagaataggatttcatgctcactttatagatgaggaatttgaggctcagagagaaaaaaattagaatgacttacccacaatcgcttagtaagaggtcagccgggattaaaactcaggcccaccagacaacaaagccccagcagaagctagcctcatgttgttgatttatgtatttgtgagttggttatcagccccagggtcatcgtgacccaagaatccccttgggccgccctagactgaccaccccacccaggtgggtgagcagcttggcccttcgtctaggagattgctacactcatctcaatcctgtgcagtaaacaacagattattattgtcagtttagctgctaaaggaggttgtttagggtggtatttccagtctcattagggccactgggactccccaaacttaagttcaaccacaaattcagggatacaggcactggagatgccaagtctgcagcgagccaggacaaggcagctgctgtatcttggccctgggtcaaccctggagcctatctgtagcctgtcttcagcctagttgagcctactgctctgtgtggcaagttcctcaccagtcagcccttaaaacaagaagccagtaccttcctcaccagtcagcccttaaaacaagaagccagtacctgttcccattccaccctctcagttcggaagaactttaatgctagtacagtcatgtaccacttaaccacattttaatcagcaatagaccatgtatgtgatggtggtcccctaagattataatgccacatttttactgtaccttttctgtttagatatgttcagatacacaaatacttacagtgtgacaattgcctacagtattcaggacagtcacatctgcacagctttgtagcctaggagcaataggctgcaccacgtagcctgggtgtggagtagtagggtgcaccatctaggtttgtgtaagtacactctatgacgttcacacaatggcaaaattgcctaacgatgcatttctcataacgtatccccaacattaaatgatgtaggactgtatttgattattttgtttctacaaatattattctcttcagtccttttttaaaggataatggtagtttattaaggtctaaatacctccagaaagaatgctaaaggcaaatatcagcaaagatgtctagcagggcttcaatgcatcctcaagcagtgttactcttaaaagcagaaaagagtagaatgcatttggttctgtttaaaaatcagatccagagggcatttcctaactgcagtctaatattttagagctgctataaggtcaaatattgggcccaaatccatagctatgtggcataaacccttgtaaatgacaagatgaaatttgtaaagaaacaagatgaaacagtaaagaaacttcaacttagttacaattctatttctttttcatgttaaaaacaaaaatccctgacttctttctactcaatatcatttacagtctgaccagtgcttctccaccatctctctccccaacttcatcccatatggaagatggaattggcacccatcttcattattacaaagctgatgcatttagcccttgataacaatgccagtttaggcagagagggaacctcaattgcaaaataattatggctggttgaaactgtgaagcctgaggaatcagagaattaattagccactcctgccctgacttaagaccaggtgcgcatgtgccccaaatgttgctatatgaatgctttacaaaatattaggaaagttaatgatcctgactgtctcttgggttaagagtaatgtgtttaagaaagatgcatagaaaagctgcgtctgattttacatccttcgtacccttgctgtgctcacccctgtgagtagttctcctatatcacctttacttagcaatgcaaagggaagtgaaaccaatgaatagttttggagcattccacatctaaaacctgagataaataagctctgaaataaagattcagaataattgaatcaatgagcgactccaaatgtcaccttcagatattctgaaatgagatattcctcatctattacagaggaaaagtaaaatcgattgaaatttgtttttgtcagtcaggcctttggagacgagccgactggtgtttaatcccatgctacccctcgctggctgtgtgatctcgagcaagttaccaaacctttcaaagcctccattccacgactgaaaaataggaagagcaacatccctccctcacagtgctgttcctgctgtagcagtagaaggtcctggacaggtcccatacctcacagcagccagacctcctcctaagcaccctctcccatgaaggagagtgtgtgagcccttggtaaacctctcaccttgtgcaccaaagctgtccaggttaacactttgctccctcctttccaaagacaaggtcccaattttatattctaagccttttgtaaaacagaggttcagaagagtggggaactctgcctcctcaaatgctcattcttccgccggcccatgagtgccgcattcccactcaactggcccacatgaagaccagccagcctggctgcccttctgtcctcacttctcatggcccttacatgtgagatgctccatgacgacgcatcacggccaactcctctccccatctctgtctccgccacagcctttggcacctgtaaaatggggacacctgtgctgggggagccccaagtcttctttcaggtctgcacttccacgtgaggtgtgaaatgatctcatttccacccccttcggacaggggtgaatgtaggcctgagcctgggtttagctatgtgagtgactatattcagtttcctgctgctcagggctgactgttttatagcaggttttgcagaatatttatcgccccaactctgcgagaggatgctcagtaggtacaggtaatcatctgtacattcaggttcctcaaggacataagagttagagaaaggcggcgaattacccactcagaacagtgccgtgaatctgaaagtcaatagccacccatataaccactggattgttagcacttaaagttgccttcgaaaaacacagttaaaaaatatactcagaagctcttgtcatccacatgccacagatgtgtgaggacatttatggtaacaacaactaacatatggatgagaatgtacagtaagtgcaggagaagcgctcagtaagtgctcgtcctgtggaaggcaggccccctttagaagtcagggcataccgacctctccaggcacatgatcctgggaagcactgctgcccttgctatgaccttcacaccctgccagtgctggtttccctgtaagagtgtctgagatgactaggtgacagcaacagcctaaggaaatccaaaattaaaacaatgagccatttgtgttcccacttctactgaaggctggttgaacagatagcagagagccagagcgtcggactttcccaaaagcaagagatatcagggcaattaaaaataaaaaatgaaccaaagacgtaccctttaaatagaagtgccccactttaccatatttaaaacaattctgatagaatattattttgctgcttcatacaagacaagagaaatctcttcttttccacttttcttctttttctttttcttctttttttagtgtatagagaactccaaaaacatttcttaacagagcaacaacttaggttgcattcgtacaggatcgatatctctacagtgtatttttttacctgtcaccatccacacaattatttcagaacattccctgtcaggttctactttgtgctccgcacaactcgggaagattttcatcaccccaaggacatgtgagagaaattcatggtttactagaaggttaagcaactcaggccctagcattgtacagacagacatgtctttcaaaaggcaacagatttacttgatggtcaactctggcgtcattggtaactcactaaaggctgtctgtcgtaggatcctacctcacgcctccgtctgttccctgatttagtgatcagtaacagtaatgccaatggggacacaataaagacagccaaggggaaggcacccccatcatccagggacccctccaccctcctctgttccttgtcacatgcaccaattatgcagtcctgctcttggcacactaccagagttctccgtaggtggggcccagccctcccacaggcatttactctttcacaaaaaaacagcacaaatcaagattaattaagatagagaaatctcaagcaagcagagatttagtgacactttggacaccatggtgagtgctatggaagcattttaatgtacagagtctgtctcatgcttccaaagttctgttcaaatcaaaccactgaatgcaataaggatcgaagacactagggaacaaaatgaaaaataagacccagtccttgctcttaaaaatcttacagtctataggagaaactgcatatgtgctcatgagaatataaaatcagttcctgaagagaaaccaacgtgttatggtggtgagaagacaaaggttatattgaggatcagaaaaggtatccgactctttcacgagcttgtataataactcacaattcacagtgaactgtgtcatgctttgtctttgacctaaaatcatacacttggaaagaacctaaaggatcatttgataagcaaaatggtatgagggaaacacacgcacacatacacacacatatacacatgaaaacacaaacatacactacaccacacacacacaccaccatcatcatcatcagagccctgctattggctcctggttattgacttggggaccttgggcatgttgtctaacctctctgagcactagtttcctcttctgtaaaatgaggataggccaggcacggtggctcacgcctgtaatcccagcactttgggaggccgaggtggatggatcacctgaggtagggagttcaagaccagcctgaccaacagggagaaaccccgtctctactaaaaatacacaattagccgagcgtggtggcgcatccctatgatcccagctactcgggagtccaaggcaggagaatcacttgaacctgggaggcagaggataataattccaccttgcaggattgttgtgataagtaaacgtaacacatatcaagaagctcagcaggtacaaagtgttcaacaaataatatctcctgataattggactaggttcctccaaagtgaacttcaaaagactgtcagttcttgtcttttaaatattcactcatttattcgttgtttcactgcaaacatttacagtaaggcctctatgtgcaagacactgcagagtatgaatataatgtaatccctgcatcatgggatatgatctaatggcatagtttgatactgcccaaaacttgatccaagacatcaggcataatatgcaagggacagggaagaaagggggcattaacacccatctccaattcacctatgcacaaaaactgaagatcactgaggttaagtaactggctgaaagttgcatgtgttattttttggacaaactgagaagtgatcggggtcttttgatgactagtcaactcacaagattatctttgaccaagtagatagaccatcctggacacatcctagagccttgctacacaaaggagaggtgagaacagcagcaataccatcacctggaaactcattagaaatgcagattctcaggctacccaggacctcctgaatcacacctggcattttaactagctttccagatggttcagatggatgttgaagtttgagaagcaccaccctagaggaacttcaaaagactgtcagttcttgtcatttaaatattcgctcatttattcactgtttttcactcagcaaacatttatagtaaggcttctatgtgcaaacactgcagggtatgaatacagtataatccctgcatcatgggatgcagtctagtggcgcagtttgatgctgccccaaacttgatccaagacaccaaacctgttatgcaagggacagggaagaaaggcggcattgatacgcgtctccaagttctccaagtcactgtgtacaaaaataccatctgcttgttaaaacaatcaaagtcacagacaggcctggagtcagaccagccctgtttctctctttgcccagggaagggacctcaggcaaactgcctccttttgatgaatcccacctaaaaaaataaagtcttggacttcaggaacatccagattcttcccagcagctctcttcatttcttcctaactcttctggttttattcattcacttggcaaatatttgagtgacactatctgctggggattgcttcagtgctggggacattggtgacaagataaatgaggccctatcagccagcaataagtaccacactgagcactgagacagggtaatgagatctggcattgctgggtggctgctttccattggatggtcagggaggcttcttggaggaacaggatttaacttgaggccaaaacggcacaagggtagagccatataaaactaaggagaaaccattttaggatgagggaacaaaccctgaaggtgtgaacaagctcggtgcatctagacatgtaaggaaggttccagcatgtgaaggagcgaggacggagaagggtccggtgaggtcttacagcaacagagggtccagccacatgaggctgagcagccaaggtaactttctggattattttctgtgtgtgaccagaagagtgctaggcaaggatctgattttaaattctcttcttataaaatgaggtatggaataggctgctatggactgaactgtgtcctcccccaaaacttatatgttgaatccctaatccctggtacttcagaatgtgactttttggagacacggtctttagagaggtgataacattgaaacgaggtcaagaggttgagccctaaaccagtctgatcggcatccctatgaggagaggagatgaggacacagacacacacaaagggaaggccatgtgagggaggacgcagggagaagacagccatccgcaagccaagcagagaggcttagggagagaccatttgtgctgacaccttgatctcgaacttccagccttcagagttgggagaaaataaacatctgttgtccaagccactcagtctgtggttttctgtggcagtaggcctagcaaactaatgtaaatttaagaacaatgatctttataataacagagaaaacagcaaattctcctgtacttctctaattggtacatgttcttataaatgctggcttagcctttataactctctccaaatcttaaactggacttaaaagtccttcaagctagtgatctaaactctagttctgcccaatcccagagtcttttttcaacagttcctgaactaatcacaggcaaatacctgagtttccttatcacgttatcctgcctgagtttctttcagctaagaaacataaaacaacaaaactcatgctgtttcttctggtttcagttaaaagcctccgccactttagttactatgttgccttaaattctaagatgcactgtcttttttgtttttcaacatttaaaaagtaaagatgcgatttggaactggcgtgtccctgcaccgtgagtgtctacctgcctttgtcaaacccaggatgcatcagacaatcactggcattgtagaagcaagagaatgcgacgattttctgttccttttgaaaaggtcgctgaaaagctaggacagagactctttttccacctttaactttggcagttatgtagtggcagaaattatagaaaaagtatagctctcacttaggaaggccagggtccaaatccctggatggctatgaagatgctgcccgcattccaaggcagacagtgtcttcgcagttgtcccgtcctgtgggcccctccatgggctttgccctactgcctggatcctccatcactggttagcaagctctgcatgcccagctccttctgaaagctgcctcctcctctctgccctaacagtgacctggtcatccctggagggtctcatggcatctgcagccactcgagtgtggatgctcactccccacccctacccaagcagtcagtgtcctcccacgtccctaacgtggctctaccttcaggtataatctgttgctgcttgaaggctcagggcattcagcttcaccccaagctgtccttctcattgctctcatctgggacatcccccttctctgggggccttgatcctggacctccacctcctccccaccccgagccctgccgccatccttgcatcaccaggccgacacctgggcttctgggtccttggtctcaccatcccacctcacttcaccttggcttcatctgcacccaaactgagccaccaagctcccagccaccttgccactacttttcccacaccctagttatttctgcccctgttccacgaccacatccagccacccacccctcaacctatcactttccctcctttaccagcctccagtgtagacatagccatccatcacttcactcaccttcctgccactccgttcggctcccgaacccagttgcctttctcctctacctgcctggaaacccccagcctggcgtgctcgctgttgccattccctctccctgaagcaggctgctgagcacagctggggaaaatgcatgatctcagggacactgtccccagaagtcactgggccaccttccaaatgggcaccaaatccacctggcaattctgtgttccccgtgccaggtctccccaccttcaaggcaccacagcagacctttccccactctcctcaaacctccccccgccggccttcctcccattcactcactcacttgctcactcatgtattcattcaaaaatgtttgtggagaccacagccaaacccggtccagagctggcaccaggatgtggctcagtcattcatcacccttctctgctttctctttgtaaaccaaaaacaaaattctaagttcctcaaccatgtaaatggacttcctgccaggccagagaactctaaaatttaaccagaaagactggctcaggctatgacgggaagtagggttgaacatgcctcaatataacctccggtattaacatcaacacagaccttacatctgataataaatatttacaatctagtctctctgaagcctgccacctggaggcttcagctgcatgagaaaactttggtctgcacaaccccttatcgaaacccagacattccttcttattgataataactcttctttttcttttttttcttttttttttttttttgagtcagagtcttgctctgtc

SEQ ID NO: 98 - DNA, 9637 bp, Homo sapiens; identical to SEQ ID NO: 97

SEQ ID NO: 99 - DNA, 13412 bp, Homo sapiens
tttgtaatttctttattagctagttcattactgttatacagaaactactgatttttgtgtgttgatgtggtgcctttcagctttcagctaataagtgaattcattcattagcatcagtagctttttcagtggattattttggaaatttcatatgtgtagaataatgtaatctgtgtgtagaaatagttttacttattaggctggcacagtggctcatgcatggaatcctagcactttgggaagtcgaggtgggaggatcgcttgagcccagaagtttgagaccagcctggacaacatacacaatgtctttacgaaaaagaaaagggaaagaaattagccaggcatggtgtcaggcctctgagcccaagccaagccatcgcatcccctgtgacttgcacatatatgcccagatggcctgaagtaactgaagaatcacaaaagaagtgaatatgccctgccccaccttaactgatgacattgcaccacaaaagaagtgtaaatggctggtccttgccttaagtgatgacattaccttgtgaaagtccttttcctggctcatcctggctcaaaaagctcccccactgagcaccttgcgacccccactcctgcccgctagagaacaaaccccctttgactgtaattttcctttacctacccaaatcctataaaacagccccacccttatctcccttcgctgactctcttttcggactgagcccgcttgcacccaggtgaaataaacagccatgttgctcacacaaagcctgtttggtggtctcttcacacggacgcgcatgaaatttggtgctgtgacttggatcgggggacctcccttgggaggtcaatcccctgtcctcctgttctttgctccatgagaaagatccacctacgaccccaggtcctcagaccgaccagcccaaggaacatctcaccaattttaaatcaggtaagcggcctcttcttactctcttctccaacctctctcactgtccctcaaccactttctcctttctactcttcaatctctcccttctcttaattttaattcctttcattttctgggagagacaaaggagacacattttaaccatggactcaaaactcggcgctggtcacggactgggaaggcagacttcccttggtgtttcatcattgcagggacgcctctctgatcattcacccacatttcaaaggtgtcagaccatgcagggacgcccaccttggtccttcacccttagcggcaagtcccgcttttctgggaaaggggcaagtaccccaaccccttctctccttgtctctaccccttctctgcttttctgggggaggggcaagtacccctcaaccccttctccttcacccttagtggcaagtcctgcttttctagaggaggggcaagtaccccaatctcgtatctctgtgccccaatcccttatttccgtgccccaacctcttatatctctgcgccccaatcccttatttccgtgccccgaccccttatttctgtgctctgaccccttatttctgcaccccatcccttatttccacaccccgacctcttatctctgtgccccaaccccttttcccacttttctggaaggtaagaacccccaaacttcccttcatttctctactctctcttttctccaggcttgcttccttcactataggcaaccttccaccctccattcctccttctactcccttggcctgtgttctcaaaaacttaaaacctcttcaactcacacctgacctcaaacctaaatgccttattttctactgcaatgctgcttgaccccaatacaaacttgacagtagttccaaatagccagaaaatggcacttcgaatttttccatcctgcaaaatccaaatacttcttgtcgtaaaataggcaaacggtctgaggtgcctgacatccaggcattcttttacacatcagtcccttcctagtctctgtgcccagtgcaacttgtcccaaatcttccttctttccctcccacctgtcccctcagtaccaaccccaagcatcgctgagtctttctaatcttccttttctacagacctatctgacctctcccttcctccccagcctgctcctcaccaggccaagctaggtcccaattattcctcggcctccactcctccaccctataatctttttatcgcctcccctcctcacacccggtctggcttacagtttcgttccgtgactagccctcccccacctgcccagcaatttactcttaaaaaggtggctggagccaaagtcataatcaaggtgaatgctcctttttctttatcccaaatcagatagcgtttaggctctttttcatcaaatataaaaatccagcccagttcatgacttgtttggcagcaaccctgagacgctttacagccctggaccctaaaaggtcaaaaggctgtcttattctcaatatacgttttattacccaatctgcttccgacattaaataaaactccaaaaattggaatctggccctcaaaccccacaacaggacttaattaacctcaccttcaaggtgtacaataacagaaaaaagttgcaattccttgcctcctctgtgagacaaaccccagccacatctccagcacacaagaacttccaaacgcctgaaccgcagcagccaggcgttcctccagaacctcctcccccaggagcttgctacacgtgccggaaatctggccaccgggccaaggaatgcccgcagcccgggattcctcctaagccgcgtcccatctgtgtgggaccccactgaaaatcggactgttcaactcacctggcagccactcccagagcccctggaactccggcccaaggctctctgactgactccttcccagatcttctcagcttagcggctgaagactgacactgcccgatcgcctcggaagccccctagaccatcacggacgctgagcttcgggtaactctcacagtagaaggtctggggcaaggaaagtaccagacaaacctgaacattttgaggtgccagaaagtaaggaagatctcaaaaaaatgatgggaacatatcaaagccaccatgccaccttccaccatgattttgaggcctccccagacacgtggacctagcaacacatgttctaacatgtgtgagactgactgcctctcctctatgaagagatgccagtgacagccaggactggtgtaggctctattgagcatcacagtcatatgtgagtgcccaagagaagctattcactttctcagatgcggtttgcagagggaacttcacaggctctctgggattgctcacatttggcagctaaagtggaatcaccaatccaaaatactcaccccaggcgtggggtcactcccagtggcggagatgccctgcatttccattgcctggactgaggaacagatgaaaggggaaccacaccagggtggtggcctgggatgtgcctactccctaagccaagcttctctgtcctgagtgggcttagggtcccctgcagcgtgggtgttaaatgctgcttcctaggcctcaccctcagagcttccagttcagtcgagtccaggtccctaacctgtcgtcgtccaattgattttgatcaggtgccccatggccccactttgagaagcagatcgagtccacctgtgcatcttccctgttgtccctaaaaataaggctaaaaaaaggcaccagttcaaaaatccagtttatttgtttgaagttcaggtttacagttcctccaattctcagatcgcagaagaagcatctggaaggaaatgacccctgcacccaccacaccccaactacagccaagggagttcacgcccacaatctctgggctccttccacggcagggaagcctttgattctgcacctaccccttgagtctagaggtcataggcagccagtggacatttctgggttttgggtcagctgcagctgcattcctgggcgggggctgtgtgatgtgctgagtgtgtcttggaagggtcgctggaatccacttacctgggatgctgctcctaaacaccccttttccagctgcggccggggtcacctgcaacatcagttcagccacgcaggtgatccaaccggcttcatttcacccatcctcactagaatctcagtttaaccaacagagctccagtgttgttttcatgacaaaccccccatcttaagtcagggtctggtaagtggcccctgccttgattcctaggcttgagtttccttcttgataatctgcccattctttagttttcccaaggctgagactctactttcctatcttcaaaaaacttctccctggggacagagagtctgcttttgtagacaaattttgtagacatcgaatcctgctgtctgctgggtgcccctgtcaccatgccctgcctaggtgacgtgatatcacctttggggttcccagtttctcaccacctgcctggattgccccctgtgcagtagccagtctctagagccaccctctacccacctggccttgctttctaccatgtttccccacccagtccaccttgggactgttccaacttgctcctggcaaagggctattgagtttctaggtctcagtccctcttcaccaggcttgtctaaggcctagttccaacagatttaaaggcaactggaggccaggatcattggctcatgcctgtaatcccagcactttgggagaccgaggaagaaggatcatttgagctcacgagttcaaggccaagccactctgcttctacaagaaaaaacaagaaacaaaaaacaaaaaacacacacacattagtcagacgtggtagtgtgcctgtactcctagctacttgaaaggctaagacaacaggacacttgagtccaggagatgaaggttgcagtgagctatgattgcacctctgcacgctagcctgagcagccgagtgagaccctgtctccagaaaaaataaataatttaaaataaaaaataaaaatctcccaggggtataattgtttctcacttagcttctaaactggattgaaatatgagtcagggctcttggttagaaaactagtacccctgctatttaagcaaaatataaggctttgtgaagaaaagaaaacatgggggtgagaagcagagaggaatgagtagaaatagggagactggtggctatttccccacaaatcttagattgtatcctggaatctttcctttcctactctttggatcagcctgggctcttagaaaacatcctgaggcactgtcctcctgagtccccctagggtgactaagcaattggaatgcttctgctgcttccctgctctcagcccctctggggtcgcatgcgccatctggatgctgttctgccatccactctgacagcctctttgtgcctctctgctcttggtcccctgggaagcagtgtaacgtgggtgctgagagcattcacaccagtggggtggtttcaaatcccaactctgctacttatcacctgtctgacctcagggaagtcacttagtacctctgacctcagtttccccacctgaaaaggagcgtatgtttggcatatacttatgagggtgctgtgaggattaaatgaattaaatatgtataaggttcttggaacagtgcctggcccatagcaagtactatcccgtataagcattctttatgattattgtggctctctctccattctagttaattttctcatcatcttctttactacccagtctggtctgcatgcattcccataaggtttctataatctctttcacctccattcataacactgcaacatcttcctcaatttcagctcgattctgagcccacctcctctaatgtggaatccacactttcctaacaagcaagagagtagccatttttactagggatccttaatcagagttaatatttactcaagattttagtgaagcttctactatctggactgtcagatttggagtcaaaggtggtgcctgggtttctctatgcttctcatgtcttgcctgatactgggcagccggtggcatgctctctgcaagcactgcttcccttcactgtacactccagaatatcctttgcatgtgctaggctgtatgtctactaggtgcatagttggtttggccaatagctagactgtcatttaaagactgttacatggagcactctctgactgtgtgattgccatgactgcatgatggaactgtgagacaaaagcgagaccctgtccgtaatgaagaacccccctagaagaagctcttcttccaagtctataaaacaaacccatcttaagttggttactagggtccaaaattccaggactttcaccagaatactttacagatcaaagttcagtaggaaaatttaataaagctacagcctcgggtgtgattattctcaaagcatgacatttacatcagttcaccaaaatctcccctttaggccacagcgtttcagtaattcgggtctttagtaggggagataatattttttgccatgctataagatgttttcttttggaggtatatattttctgcagtgaacaccaagaatgttaaagggccatcaatttaactttgatttcatgaagtgtgaggaaagtggcagcaggctgcggcacttttgccagggggtggcaattaagcaggttgagaagggacttgagcaaggcagggactcactctgaaatgaaattactggaatttgctctgtcggaactgtgattcatgcagagatctgagaagcaagcctgaagactaatgaaactaccttcctttaaactccaagctaagtagctaacaagccctctctaccttgttggtaaagtcagatgttttttcagcttcatcacagaaggtgtccctgataactggttctacaatactccatgttgatggagaaccttcattttccacttatctgcatattgattgcataaacatatgtcccctagggaatttgtagtggcagtaaacttcacaggcttccttacatatttatagctggaagaaaggcctcaagggagtgttgtaccttgattgaggtgcccccctggaactccaggcttattggtaggaccactgaattccaagactagtgtctcaattcggaagatacaggatttagcagtccaacgcttttgatttcaaaagactaatttattcactgatattgggagatcagcctaggaactggcgctggtgatttatctgaaacatcattccctttctggacaggaagtacaagaggcaaatgaaattatggatcaaaagttatagtgtgtataaaagagtaaaaatacttggaaattgttaagggaatatttgttccaactaatgttctcttggacccaaggtgtcatagtatactgtatacacagttactgtatcacacttttgtctctctttcctgctctattattatatcctaaggtcagagtctgggtcttgttcagctttgtgtctctagtgcccacagcagagtcagcactcactaaaggcttattaaataaaagctgaattaaagaaggaaggctttgttttcgatcttgaaaaataagttagtttcagggcagtgaaatattctgtatgatactgtagcattggatacatgtcattatagcccataaaatgtacaacaagagtgaaccctcatgaaacctgtggactgtgggtgatggtgtgtcaaggtaggctaatgaattacagcaaatggaccactctggtggaggatgttgatagtagcgaaggctgtgcagtgtgtggggactgggtatacatgggaattccctgtagtttccactcgattttcgttaccaagctaaacttgggtctgcttgcccagcatgcagaaaaagctaaacattgacacctggatttgcagtgagagaaactgaggcatttattgcagaatgccaagcaaggagaatcaggcagcaaatgcttaagatccaacatccccaatggcttataagcaagggtttttaaagggaggaatgtatttcaggaaagcagaagttacaggcaaaatcataaatctatacatgaaaactatatattggcttggtctaagaaggcacgatatcttgaagcaggggattgcaggtcataggtggattcagagattctttgatttgcaattggttaaggaggcgaggctttgtctaaaatcttggggtcagcagaaaggaatgttaaggtctggcctgggggtgtgactctctccaggccccccaggaagaaatttaaaacaaagaacaactgtcagagttcagtcctcagttcccctttatttgagatctatgtgacggcagtcagtattttccatctggtggggggtcctggtttctgaaaaacaactctgaaacatatgttaagatgttgtctttagcttctatagggaaccaaacatcttgtgactaacttacttgagcgggtattaagcttattattcaataccttcatgcttagtgggttattcacttattttccaagtctaggtgtctggaatttaattccaagctaggtgccttgaatttcccttgagaggactaaagatttttcctttattttcatgcctgggggatctggagggctctaagtggggtccctgcaccatctcgtttcgctgtgaacctaaaactgctctaaaaaatgaggtctatttaaaaaaaaaaataagccagatttcaaaatggagtgatggtgagtgaagttattcaaggcagagaggacatcatgaggcaaaatactgaggtggtggtcctgtgtgggatgaggattagaaacacagactccagaaaattagtgacgttccagtttggcttctggaaactatatatgtaaggggaatcatgagagctaagaactgcaaaacagttcaaggagagaggatgaaggcctgggataaactaaaatcttcaacttagttgagtgggcagcagggagtcactgaaagcttctcagggtacattgcagcaaggattaaagttgctattaaatctgggtcaaattgttagattcctttatttcatctaggttagtgatctccaattgcactgcatcagttactcccttcaggtataaacagcagaagcatcaaatatatttgcctagagtcacaatgagttgtacacctcctcactatttcctcactctacattcagatagtttcaaaacaaaaacttactgtgattagactcaatggttttttttttattattacttccccctacttttgcctttttcttttagcttcaatacaacatctatcccagatccctcccacagatgtgcagtgaaggaggtaagagcagagatctggttaaagaaggcaggatgggggcaatcggcatgatgcccaggaagctctacagctcttaaagagacagcaggaaaaatgcttatctagaaatttcctcatgccaatactccttattccagggaactgcagagaggatagagaagtcaccctcagtcataagaggagctcgctcttaaccgtcaccagggagaggcactctgaaactggttgtcagtgagattcccttctgaccagatcctctctttgggctgctgagaacacccactttatgggaataccatcttatagtaaaggcaccaatgagaatgctttatgtgggctgggatgataaattcagatagtattgatatggtagaggggcagggaagtgatgggaggagagggctccacccccaggcctgtgaccacagacctaggtgaggacaggcatttctgttttcctgtccaaatgttgcattttccaagacccccttggcccaccatgcccccatcctgtgcctagaaaaaccctgagaccctagagggcagagacacaagcagctggacatcgagaggaacacactggcagaagagcacaccgacaggcactggcagatgccgtcaggccatggaccagtggaacaacatggagtttggccagggcggtcagatgagagccccgctgctaggctgcccgactccagggtgaaaccaccaccttcccactccatcccccttctggcttccccttccacctcactgagagctaccatcactcaataaaacattttgcacccatcctccaagcccaagtgtgatccaagtacaccaaggcaagaagccgggatatagaaagccctctgtccttgtgataaggcagaggggtcgaattgagctgattaaaccaagctgcctacagatggtgaaagtaaaagggcacactgtaacatgcccactggggcttcaggatctgtaaacattcaccctagacgctgcgatggtgtcggagcccacactccccatgatctgcccacctactctacctgctttccctaggggttttgagcagtggggcactgaagaagcgagccgcatctccatcgcatgccctggagggggacaaggaaactttttccatttcggtatggaatgctgagatggtaggaaagacaggtaattactgtagcattaacctggaagcacacagaggagatggtgaaaggaaacagattgggtaaataataatgctagcaaccagcagtccattctattgctttgcgatatttcctaactttctctccatgggattctcaccattgtggagacccagtaagaagagaagggggtggttagcacagtggttcctaggtcaggaagagttctggagaggctaacatttgaaatgatactaatgcaatagctgaaatgtaataaactctgccaattcctgttcaacgggcttcacctggattacccctcactgtaaggcaagttctattattaagtcccttccagaggtggggacacaaggtaaaaagaggttatgtaacttacttactgatgtttacaaggtatgtaaatagcagatcctgtctgtctatctccagaaacggtgccactcatactgctgaagaaagagctggtacagagagaaaggtgaaatgggaaaacataggctgtctttggacagcttcttcccagattgtttttgggaagcattttggtttggcattctcccaaaatgcttttcaagaccctttatataaaaacaaaagtctcttccttgactgtttctgttcctggttcaaacttccacagcttcatccatgccttatcctctgtctatgagtcacacagcatgcataccagggcaggtggctatcttggctaaggacacaaaaacataggcagaaaaggtcgatccatgtgcctgtgtgtacatgtatgtatggtgcattcttgcagggcagggagctgcactctgccttagagactgggatgggctgtgtaggtgggtagttcaaggccaactagttctggaaggctgttttgctttgtgtttgttttccttttggaaaatgtcaagttatttaaacttgacccacaatcactgataaaaatcttataaagtattttcctctgaaagcagatagcatttggccagccactcttgattatactatgttgcagggaaatgaaaaatgactttcttccacccctctatgttccttggctgggctacgaattaaattgacatgagacagatgaacaggagaaaaaaacatatttaattacgtacatacttatgggattctcacaaataagagacttaaagagggtcagatgactggggcttatgcagcttcctgagatacagaaaggactaggggattggggcttagggcttatggagtgggggtggtgactcaagttatggaagggttaggggaggaaatgtatagtgaacaaaggttgacttgctatgcagataagaagactttcaggtaataaaagttgtctctgagcagccttcacaagattaggtgattggtctgtctgggcatggtgtcaacctccaatctttctcttctgtgatctgaattaatcttctctgtttgagaagattcctagggaaaggattcatgacaattgagctccttttgcaggatcatctttaggcaggtaaggggagctcagggaagccactgcctgcatctgctaatattcccccaagtgccctcacttcaaagtaagcagcatactgaagtgtcatatcttggggtggcatttcctgaactccttcaatgtatatacccttccatgatacaggatagttaggtgtgggcagggtgagagctcaatgcagaattgaggaataatatgattgcagttatgaataaggcctccagatccaggacctccccatattccctcccttaagggccttaagggtctgttattctgtttcccttttcattcaactatcaagaaaatttagtgttttcaaacgggctaaggagagactctgtggggaaagaaaccctttgaccgtccagagacatctccagattgcccaaaacgtggcagaaataaatggtattattcttggaatcagtcctaatgttcaccaatcaaagattttaaaagtcttaaaagagccatggggtaggctaatgaggtacctaagagaaaacagcatgggcatgttttgagtcaacaatatgaaccaacaagtccctaggtgcaacatttgccatatcatctccctgtagcaatgtgaaagaaagtaaagttagggactatattcagagaaataagaccatgaccaaggcctttgcttcacattgctgcctgtgaagcaatattctgcctgtgtgcaaatattgccacaacccctaaatggaagcacttaggagacagaatttaccaacacgctcctcatcttgggtggagtcaggagctgggtcaagtaaggatgggaaatgcaatggagcaccagtgaaggcctcaaaggaaaagaaactatgcaaatcacatggatttgcatggctggaggagctctagggctgtcatcctgttggaaagaccttagacttggaggcacagaacacagatgagttgcctgcccactccctcagttctcccaaaactgctacatagccagaatcttctagatgcagagaggttaacttattacatactgtgaatgccttaggttgtgcattaggactcaattttttccagggagttccctggttgagaaattgcctttttttttaagtgtcaataatattatttattaaggaaaaatcaacttttcaaaactccaggggcccggtagggatgttgacctgcaagttggaggaggccatttcaacaaatacagtatgcacaagcattatgagggatgcagatgtgactgggatcgtatgaagcctgtttctgagattctggtaagatcagctcaaagccctcatccaagccccatggagagttggttgcctccctaagatttctgtggtttcccaaggattttgccttctctgatgcctttggccccagcagcctatcttaacagaatacttgccatccactttgtgtcatttaggtctttatttctaccctagtgttgataaaa

SEQ ID NO: 100 - DNA, 2024 bp, Homo sapiens
attgaattgggacaaatgataacctaggaggaaatagtggctttctgcttacctgcagtgaagtgatcattatgaaaagcattaatattttccggtaatttccttcttgaacaattgtgagaaattaagggttcattttaatcattcagcaccttgtttattacattattcatttgtatttagcatctaaattaaatgcatgcattatcacaggtaagtgcatttgttttacatcttgtatgatatactgtgatattcgcatttataaaacataaatagcgatgacacacgtgttcattttctccagctcagaaaggagctggagcaaatgaaatgggatctcagtgcacagcctcgtctgctgcctgcctgcctgtagcaagaccacctgcaaaattgggagccatcattactgagaagcttacggctgagtttaataagattggcaagagcttatgagcttctgggaaggaaacatccacaggcaaaagccagaccttctcttctcactggccagcatgaaggatcacagggcactccatttaatacaactggaaagggagttcaagcactctgatttcttaagtctctgctcaccattgcagggacatctccttccaggccctcttcagattcactagatactaaatctgagatgatgggcgcttcatttattttcccaacaactgttcaactggcatgtgttatgtgctacgtgcacagtgatgagaaagacagggccctctgctgtagaacctcatggtcaagtcaaataggagggggggtgggatccagctgaaaatgcaaattaaagtagtctcttgatatggtttggctctgtgtccccatccaaatctcatcttaaactgtactcccataattcccacgtgttgtgggagggacccagcaggagacaattgaatcatgggggcagttctccatactgttctcatggtagtgaataactctcacaagatctgatggtttgataaggggaaacccgtttcacttggctttcattctctcttgcagccaccatgccaccttccaccatgattttgaggcctccccagacacgtggacctgtaagtacaataaacctctttcttttgtaacctgcccagtctcaggtatgtctttaccagcagggtgaaaacagactaatatgctcctcaagtccaggttctgtcattaggacattgtcatctacgaaaatggagaatcagtggaaattgacagcaaaggagggatgtattaaaagcggataactaggaatgactggtttgcagggccttagcttccatctaccgcagttttttctctttttctgtgcctggagtgcaaacaaagctgaatagggggtgagggaaaaggtgggtgtgtaacttattgcagaggcataaaatcataacaatggcataaaaggacggaggatagagggcggctgctactgcctggcttgcctccttgttaatgtaaatctgaggtgatggattaggcagggtgtatatggtttacatcgagctctgaaagtgtgcacagttcaggcagccgcacattccaaaaatcaatctcagtaaatcggagaaataaacatctgtaagagaaattacaaaccaagctatgctccttcagggccggtgctgggcagtccgtgggaaatctcccaggttcatctgttgaggtcattgggatgctcctcccctaacgttgtgtgagctcatcagtcccctgcagtgaggaaaggatgcctggcctcttgcaggactgggatggccaatccctgggaggcagtgtaacttcatctctcaggagaagtgaagaaaggcgaagggacacagggatcatacaggaaacctgcctccaattagctaaaaagcagacagaattgtcctttaggttcccagttccattgttgttgtttttctttttcttttttttttttttgagacggagtctcgctctgtcacccaggtgggagtgcagtggtgtgatctcggctcactgcaagctctgcctcccgg

SEQ ID NO: 101 - DNA, 2502 bp, Homo sapiens
aatgggggtgggggttgccatggtgatgcccagtcaacagaatggagaaaagagaaatttggtttgaaatgaaatttgagtcttgagagagggctgatatgaaggagaatcaaacaagccacatgggagcatctgaaggcctggagataagggcctgttgcatggctgtgaaaatttggcctttaaaataactaggcatgggccagaaatcacagccggcggctgcgaccacccaaggcaggagatccagcgggggactatggagctcagtggagctgcggcctgggagaagcccacccaagagaaccatgtaactagaaaccatcacattcggcttcgtgtgagggagaagcagattgccaagatggtacagacagcagaagtggcaaaacaacacttaaactcaaacctgcccaacttcaaagtccacgcccttccctgggcttcagactgccgtctttgatgctatctttcattgagatgttgtttgcattaaatgggggatcttgcggcacacggtggaccttgcccagcacccactcttcctagggccagccttactctgtggggtcagcctttgaccgtctgggccatgaaggtggctgatgaggccccttcgacagccaagttggggcacaatctcctccggatgttgttattccttcacagtctcatcgcaggcggggaggaagtcagagggctgatttagaggacagagatacaaacagagtgagcagaggatgtttggctgcagttgctccagagtttcaagggagaaaacacaagcattgctgagcggccattaggggcttgcacgctcagctgggcacatgtccacaccgaggcatcacgtgcggtctgagctgagctctcatctctgggtttcaggactttcagcacagtcctggcccttcacgtttagtctgggtgatcagggatgtaaaccagcaattgcaaggtggtgaagcaccaccgtggaagggcaccagccgggccctggggtcacagaagtgccccaggaagtgtggccgttaagcctggtgagaggagagcgagccgggaggacggtgagagacaggcatgacggggcggtgagtgtgactgctgctgagcatgtctgagacggcaggcagtcaccaaaggcttgtaagcagaggcaacaccctgacttgtggtttggagagatcatggtgactgccgtgcagggacggaatggaggctgctccagtgactctggccgtgggcagtggtgggcgggtgaggggacagaggaaagtggatggagttgctgcccccacaaccctgctgagaaagtgcccacgggacctggcggggtgtgagtcacacttgggctgctctgcctggctctgcacctatttcgtgagctggaagggacagcctgagccccgtcccttggatggacatcaatgcaggagtaagggtctgtctctgaagctctctgagcaacggaagggaaggtgcccactgggctcaatgcagagatattggggctgatgtggcaggaggggtgggtgtgcaggcccggcggggaaggagacttccaaacagacgggctgccccacggggaatctggctggggccagtcattctcagagtcaaaccatcttcattcaactccgaggctgccccaggccagtagcgtccttcctgagagcgcttcctgcgagatttatgaggcaggggccaggcctggatcgtagaaagctagagaatgccttggctgcccagggaagtctggaatttcttccaaaccaagcttccagacgtccctctggactcctctgtctgagaatgggcactttaaaggcccaggagagaactcccatgacaccgttttccaacctcccatctcccctccccggcagctccccatttccggcatctcggcttggcaggacccctccaggacctcactcctctgagacgcactgcagacctcacaggtgacagcagcgttttgctgactcagaggcaactaccacgatgaccctccagcccgtgtccagacctggggcagcgacttggacagggggctgcagaagtgggtctgtgagggggacctgacggggggctgcagaagtgggtctgtgaggcggacctgggggggcagccctggggtgggctcactggggttcactccacctcgaagacttcaattccagctctggctggttttgttggattaggaacacacagccagccaaatcttggttactagggtgccagagatcacgtggagaaatgaaataaagagagaacccccaaacggtggtgctgccatgcattggagcctctcgccccaacagcattcttactttatttatttatttctcatccacattttgctggaagattttgcgcattcataatggcaaacagaatatggcgataagcttctgtgtacactatcatcaacagctttcaattcctaattaaccttattttatcaatattccccataatcccccatgctgtttcttg

SEQ ID NO: 102 - DNA, 11669 bp, Homo sapiens
ttgggggagaccaagggtgccctgctcaatgtcagccctgactctgtgccacgtgcactcagctctgccacggaggtgcatggctctgtagacgtggacggtgagctggggaggaaggtggtcttggagagaaatgccccatggggagctgagacctgtgtgtcatgggatcatcctggatttggcttaaaatccacgtggctgtggaaatcccagggtgcaccgaggatctgtgggggagcagggcctcaggggtgacacctcagagctcctgtttacctctttagccaccaggttagtaattttacacccatgcaagtgtgtacaggaatcttccggatccaagtggctggtgtgggcgttgtcttctgtctgaaccctggcccttgtctgtgcagattcctcccctcctgtccgggagagaagagacagtttcgatgtcatgtggagacaggaggctgtggtcaacgaggggaggctgtggtcaacgaggggaggctgtggtggggggtggcgttctgagtcacttggctggcttgggaatgtgagctgggccaggtgcaccttagagagcctgggtggtgctggggaccttcaggctctggagtcctgggtgaccctgacaggtgcatgtacccacatctccttggcccctgtctctgttgctaatgtccctgcacagaccccccccagccgtcatttacagattcccagcagtgaagcacacgggcttaggttaaaatcactgagccccttgcacagcggccttctggtcccctctgctgtaaggcaggaccacctgtcagcccctgtcttctggggaccccactaggcctaagagatgaggctgtggggttctgtcttctggaggccccactaggcctaagagatgaggccggcggcggaggtctggcctggaagagaaatgtggtgagtcaccccaggcctgacagattcactcagacctggtccttctgctcctaggctgagccatctctcagggaccctcctgccctccttcacctctcacctggcctgccccaaccagttctccaggcaagcccaaaccagttccacctggtttgtgactgtgtttggaaagagggtctttgccgaggtaattaagttaaaatgaggtcatgtgagtgggccctgagccagtctgatgggtgtccttacaggaagacattaggactcccagagggtgactccaggggcaggtggcttggaggactggccgtgcaaggaggcagcaaaggggcggccatctgcaagctgagggcagaggccttggaggaagcagccctgccagtgctggtaactcctgcaggtcggaagtccaaaccaaggtgctggaagggctggttccttccggacccttcaggggagaatctttctgcctctttggcttcttgaggccccttcctggcattgcttctttctccactgactcctaccatcagcgctgagtcctgcctgcctcttataagatcttcagaggccacctgggatgtcagaagcttccaggaaccaggaggtagctgcatctcctgtcccttccctgagtcaccttgctggactccacagtgtggtgcagacaagaagctgcaggggacaacatggaaggaagcggggatggaggagatggaatgggatgggctctgggcccggccaagcagagcaggatagggctgagagtcatctgagcacaggtggttcaaatggcagagaagctccacgctggagcggggaagagcttgggctttccggccagaaagcgcaggttttggccacggctcttctgccactcactagatgtgggagtttggaggcgttacccgagctctgagccttactttcctcatctgaaaaatgggaataatggtagggttaaattaaaccaaatttggtctgaggatgcctctgcactttgagtccaactgcgaccttagcagcaaatgaactgcaggcctagcttaggagtgtacttttgtaagaaatagccgagtcttagccaatcacagcagctgagcttctataaatcgcaggtggctgctgagtagtccatgttcaaacacggcaaaccaagctgtgaccaatgagctgtctctgcagctcacttccattttctgtctataaacactccctgcccacactgtggagtggagctcagcccttggaacctcttctggtctgagggctgcccacttcatgaatcctttgcttaattaaactcaattcatttcaaatgaaactcaattgattgctagattaatttaaatttaattcgtctaaagttttcttttaacagttcctaccttgttgagttgtcgtgggaatcaagtggaaatttctttttcacatggaaagggcttagcatagcctggcacgtgctgagtgttcagtgcacactggttatgatgatcacagttagtgtctccatctttggtctgttcagcgctacagtgtttgggggccagctaggcagtgctgcagctgcagctctgtgtgtgtgtgtgtgtgtgtgtgtgtgtgtgtgtgtgtgtgtgtggagggggctgtgagattggcgggctcaggagaagatgactactagctgttgccaaagtttcttttctgcaagggaaagccacaagtcactggctccaatgtggacttttaaaaggccttccttcctttctctcttacttctggggagcccatggataggaaatggcactaaactgacttcatctctgtaccctgatgcctccatcgccctcagagtttacgccctcgatgaatcacttagagtgaactgggagctgtgtatgaggtgacgtcaccctgagatagagctctgtggtcactgggaggtggctgtgtgcgttatctccctgtggcatgccaggaggcgtgtgtgtgtgcacgagtgtgtgtgtgcatgcatgtgcatgtgtgtctttgtgtgtgtgcaagtgtgtgtatgtgtgtggataagggagagggagggagggagctgggctgtctccccttccccacaagtggaccctgcagctcagagccggaggtgtgagctgagtttggcgtttgtatgttgcttgagttggaatttgaactcacaggggacaggaaaggatgcctgtccccaggactgactaacgacatcaggcctggctattgaacttcctgctctgcagatcctgggttctgggaggatgaggaaaggatgagcgaaggctgggggatctctggggtgggggtggactcagtgagtggaaagagtaaaggtgttgggggtggactccctgtctgtgtgaccgctggcaaagtccttgacctcggccagtctgcgtttcctgatccaggcagtggggacatggtcctttccctcagaggggtggtgaggattcaatgaactcctttaggtagagcttgctcaggagcatcagctgtaacacctgtcctggaaggttgctaggtgccctcaccctttgttctgtgcccacctctctccaccccctcttcagcccggatccagacgaggcctggggaaagtctcccagaaagcgccctgaccagggcggtgccagctgggttcctgtttgcctaaacccaagcagcaagctcttcaaaggaacctaacaaaccggacagagagctttgtttttttcctcacagcaaaggagacagaaaagtttgctgagggctggagagacttcttcatgaaggaatacagggacagtcacaggagacaggagcaccaagggattcggacatgtggctgacacagtcttctggagagccccggatggcatcagggggaaacctggcctgagacagtgccctgatggacaaggacaggaatacggtcatacctcctgcccacttgaccaacgaccaggatgagaagccaacagatgatgaatatgaattaaagttggacaactagcaagtttaaaacttggactgggacctagatcttccgattcctacagctagcctccctttccatcttctctgtggtcatcactaatgcagtttttgaccgtcttgtccagaagctgcaaaacagacaacagaagccaggactggccctgccttagatggctttcagtgcaggaaagtatcaagacagtcttgttcgtagcgtatatctctctccaccttttctgctaagcacctcatgtatgcagctgccaatgtaacacctccatttgcgtgtttaatcaccatctcaagctaatgtaaccaagcagacttcttggccttcatccctgcctcctctagtcttctcatctctctctctctctctctctttttgagacagaatttggctctgttgcccaggctggagtgcagtggcaccatcttggctcactgcaacctctgcctcctgggctcaagccatcctcccaactcagcctcctgagtagctgggtcttcccatctctttaaaaaacaattcaattgttcagaacaaaaccctggagtcatatttaattcctcccttcctcttgcacttctaaaccaatcattcatctctactttgaaaatgtttctttattcatccagtgcaccaagccaccatcacctcgaggcaggaatattcaacggcctcataagtggtctccctatttgtgttatattcaatgcatgtcttttcttactcaaaatcctataaaggcttctcttcaccatccacgactgtttcctgccttcctcactatgatcccatcactgacccctcaagactatgttccagcctactttctgctccttgaccaacacccttactctgattcccacttttgtgacttcacatgagtcccctgtctgcctggacactctgcccccaaccttgaagtgctcacccttccctgtcactcagttgaaagtcaaattccatttcctcatgagggcttccctgaatacccacttttaattaactctctgcctcctcccatcacttctgttttaccccctcttttagttccttcctatcttagtttcataagagccagggccgtttccgacttctttccccgtcaagcctccttagataggacaggtcctctgcctcaccgactttaatcagtatttgctaagtaaacagagcacaggaggatcctgttgtcatcaaagagcagctctgcctccaatggcgaaaggattgttggaacctcatccttccttcaagttctggttcaaaaaattccatgctatgcctcacatggccttgcccaggtgcctgtttgatttgcctgggttgtctgttctttcttccccactgtcctcatttgccatgtggctcggtggtggctggagacctccatgctggcccctgggagcagctgctaaggctcggcgcctcaggacaccttggcacctgtggatatcgaccaccaggcttctcttctgttcatgtctctgcaagaatgagaacctgcccccataccatttgtgctgtgtaggcctcaggaggcatggactcacgcatccagcttcctgcaagccctctggtacatcgcagtgttcacccccagctttctattacagccaccacccagggactctggtgcaggctccttagagagaggccaggaaactgccgaggtgataagtgacagcaggtctcaggggaagagaggacttctctccttagtaaagaacctgtcgaggtcggaaagacactccaggctcaaagccaaatttgaaagttaggctgacagcccaactagggcagattggaggagccaggtggagagaggatgtgggggagtcaggaaagaggtggaaggagaagcctggaagagtggctccgctcctggagtatggccagcggcacttcgtcaggacctcgaccttcacccactagtgggagggtgttcctcgcatgacttgtaggatcacctgggaaacacacaaatggaagaatttaaaaatatctgctaggacaccccgtgtcccccacaactcatcacagagcaaacccatcacagagcaaactccttggctacttcttgtcttgggccgtcttttcatctggcctgtttgcctgactggactttggggtctttgttcccagcatcaaaatttcctaccagcgactttccatcacagctcccttccagtcttctggaaattgtcagatgtgcctggatttgcagggcctgcacaagatatgctgtcgatctgggatttttggggatttttgcagttcacactccaatgtgcaacagcaaccaaacggagatggaggacgtgaacatgaactactggagatgctgatgaaacgtgtgtaaggaccgcaatggtatctgtgtcctgctcgtgaaattgaccagatacagcggcttccttttgcttccgaaggcccggattgacctgacaattgatatgctttgctctatactccaactcccattgaccatggggtgaaagcaccctttctcggtcagcctcactgcttccccgcagatggagggattttctgcaggagcatgggccctgggccttcctttcccactgtctcttgaaagcctcctccagatgtgctgcctggctcagctctttgggtgacttttgttctgtctcatgtgacccatcaagattcacacagggctgtgtcccgggcagggctggagtcgacattcagggaggagatcactgttctggaacagagcagtgattggtttaattgaaatctgatagatcatcatgtaaaaagctggcatgtaagcatgctcccggagcctgcagggccctgcgcggcctcttgcctggccatcacgtagaggcggtcctcttgcatggttgggggcctcacctgcaccacgggcccccaagccaaacagtgagattgtacggagaccatcctggtcaggtcttgcagtttgcaccaggtagccccaggctatcctgccgtgcaagagctgccttctcagcacagtggagttctacggctgcctcggctgcagaggtcagctctggagccttgctgagcacctccatggatgcattttgcaaagggccgagtaagaggcattaacgtggcctgtgcttagttcctgacagcaagcgggattaaacccggattaaaggatcagccctaaaccaaagcagaccagtaataggtctcatgataaaagcagccaaataataatagtaaaaatctattcttggacttattactttcctgggaaaagggctatttcttgtgaaatatgcagcgattggaactttccccgacagcccaccgtgagctcactcactgcccctgcctgtgctggggggtggtgggtggtgagaggtgcaagtgaagggtctggacagaggcagagggaggagagggggcagggggatggggaggaagaatggggggttcgctctgggatagcttcatgatccactgaacctttcaaacttgatgcttgacgttttgaaaaaaatgacagaaaatatgggctgggcactgtggctcacgcctgtaatcctagcactttgggaggctgaggtgggcagatcacctgaggtcaggagttcaagaccagcctggccaacatggttaaaccccgtctctactaaaaataagccaggtgtggtggcacatgcctgtaatcccagctgcttgggaggctgaggcagaaaaattgtttgaatctaggagacagagattgcagtcagccgagatgctgcctctaaactccaggctgggtgaccaagtggggctctgtctcgaaaaaaaaaaaaaaagtgtactagggggatgtcgttgaggggcttagccacatgctacagatctttttataccaagatgcattcaatgattagctaagttggacagtttgttactttaagcctccacaaccaaaggggcaagataattatctcccagagaacaagttgatcttctttgaaggataaggagttccccaagcagcaggaagagcttctgttcccaattccagcctttgaagtttaagcttcagaagaaaaccttagcatttaatacaggaaggcatgcacgtgtgtgtgcatgtgtttgtacccacacatgtggctcaagcttccctgtgacaatgggttgcctgcgggtaagcgtgggatgtgtggagaaggcaggagggtttagggcgtgggctcagtaccctgatgagagatttaaagcaggcaaagggattcggcaaagtgcagctcccatttcatcatttcttcagaccctgccttagttatttactgctgtggttttaaactctgctcttcgaaacccttggtttctgcagaagtccttcgagaggttcgtgggggcaaaggaaggtgaggggcaggagcccaggccacccggcctccttcctttccccacgtctgctttcaactgtttcatatgcatcatgcaaatcgcagctgtcatggctcaggtcctcatgtgtacaatgggcgccatggcagcgtccaggtcagagggtgaccagagtgacatgaattaagacacgagaggactccaaagagtggtcaggcctctcacgtcataagatctccataaatggtcactattattttgtgttattaggggtacgcttttcatttgtaagatgacttccatggggccccacgcctcatgaccccgtctcaccccctgcaaataccatcccatggagaggcaggacttgagcctatgaatttgaggggtacacggttcagtccaaaccttttggtgtttctgtgtatccatttctgcatgtgtaaaatgaggagaacagacagcttccgacctcatctccaaaggcgcacggaggaggtggaaaggccctcgccggagactgagcactgcagccagcgcaaggccggatttgctgcttccgcgcggggacgccctcggaaaggtggcaggtgcccacggcgaggaaggggcgggagtgaggggtgcgtggcccgagagaactcagtgaagaaggccattagggaggaaataagggaaacggggtgtgcgaagctctgagctttttctgcccggtttggctgaggacacgccacgggtgagcatctgcgcgaggggagcttggtgggtgaggaaggaagaagacacgatagagaactggaagcaagaagggaggaaaccaaaaggaacggggaggagaaagggcttctctggagctgcttgcttttcccagattctcctgccattcctggctccagggagtcctgaaggaacgatggttagggcggagaatcctgcagaggaaaggagagaaaggactagaggtcacacacggcttcttggaggggagcggggagcaggggctccgaggctgcgggtcgcaggctccagggcaggaagctctccatgggaaccgtagtatgaattccaccgaggtgcgtcccggcacagacccgaaggcagccacatttgtggaaataagatttgacgtgcatttcggatccgcagagaaggtggactctgttttgcagaatggaccagcggtggggggtggggtggggggcaggaaaagactttaaacgctggcagaactttgtattccactcattcgtgcatgcattcattcagccatcctttcgctatcattcatcaaactagcgcgcactgaggccactttgtgtcagcgcagcgcctggcctgaggacctcagggtggtgtcggcaaagttccgctgccaaggagttcacgggccgtgtttcctgccaggccgcagacactctctgcgtggagcccgaggaggttctgtgtgagatctcaccctgcgggaagaaagaggcggaggctcggggttggtccaatcacacccctgatggtgagagacgggcgggcggggcctgacgcccactcccagctggatgcctgtctcccaccccgcgtgtcctttcccagaccccaaagcttcctgcctggtctcagttcttcggagaagagggattagaagctggaacaggtatttctgctaatggggcgtggcagatcggcatttgcgggggctctgtcaccccgtaagatgtcccagcaggaagcgtggcgggtctccactgagagctccacggagcagctttggctccctgagaagtcgaggtgtgagcagtagcggccttccctttgcagagagaaggcttggggagagaagaccctggtgccatcttcataggaggtggaaaggaaactgtatgacaggagaatgaatcaggtttggggctcaaggtgccggccactgggaaaaacagctgccccgagttgcaaaactctgggtcctatatgtataaactatgccctgaggaaggaatctcaggcgtatcttaggagaaaatgttctagcttgggaaacaaacacaacaggaccgtgaatccaaatatttcaagtgggtttagaggactggagttctaaacgctgcttttactgtaagtgatcacgccccggaatgtgctgaagaaaggaaaatgagccagtatcggcgaggactatgggcaaggaaaacgagagtgtgcgatgtgtcaaagcaagacatctgtgtatagtaatataatcaagtaatagatagtcatagaatcaagctgatgtatttggcaggggccgcgggaggatgaggcaactcccatcagattagaaagatgttaacactgtaacaaaagtggggctcgaggaaggggaaaagcgcagctctctttttaagacgccagaaagtagtcagacatgctaagaacaaaacaaacacaaacgaaaaccagcaaagaaagctcttcgagaagagtaaggctactgatctttaggaatcaaatcattatttccacacatgtcatgaagaacacagacattaaagcacaaaggagaaacttaaatgaaagtaggagggagaagtcaaagctcaagtaaagagatttttaacctagagaggctgagttatcaaggaagaaagaaggccaagccagcttgttgcagaatgttccagaagataagataatgatagacttaaataaatagggactgatcaaggtgatagcgagttcttggtgaaattgcttccaaggattttatagaagtgtatttcatggaaatgtacagtaaccggatgactgtattaaaattttaaaactgctgggtgtggtggctcatgcatataattccaacactttgggaggccaaggcgggtggatcacatgaggccaggagttcgagaccagcctgaccaacatggtaaaaccctgtctctattaaaaatacaaaaattagcagggtgtggtggtgtgtgcctgtaatcccagctacctgggaggctgaggcaggagaatcacctgaacctgagaggttgcagtgagccaagattgcgccactgcactccagtctgactccgtctcaaataaaacaaaataaaataaaaatctaaaactgacttaggcagttaagtgtgtttccaaagaacgtaattggtgggaggcagagcgggcccgaattgccacctcttcccggcacggccagtgctcttcctcccactcccggccacctccgcaggcccctgcccgtgccaggactgggtgaagctgtgaatgtgcttctccacttgggggtgcgggacaatgctggggccctgggctgggtttctgccctaggaagcctcactgttgagtcaggggctgctggagctgagttttgtcttcagtggcttatgaaggaaagatgaagcta

SEQ ID NO: 103 - DNA, 11669 bp, Homo sapiens; identical to SEQ ID NO: 102

SEQ ID NO: 104 - DNA, 8709 bp, Homo sapiens
tgacctctgtggccagagtccccgtcagcaccgcttactgcaggccaagatgcctcccaccctccagaatccgaccgcggagggagcttccagtccaggagcctgcgggaatcctggcgggggctgagggctgcagcccccctggcctgggcattgggtgcctcttagggatcttgcctgggtgccctaaggggtcacccggtgtccgtcctggagggccgcagagtcagcgcaacctgccctggtgctcggtcctaaggtcagctctgcttctcccgagtggggagggcgtcacggtttgcctgcagtgggagcgttccgtgtcattcagacgagcaggtgggaaggtcggcaggagtgcagagaagagacgcgggaagcgggatgcagagagttcacctgtccgtctccgtccgtgtccgcggcccggatcatctcgtccacctcctcgtcactcagcttctcccccagccgggtcatgacgtgtcgcagctcggcggcgctgacgaagccgttgccgtccttgtcgaacacgcggaaggcctcgcggatctcctcctcgttgtccgtgtccttcatcttcctggccatcatgcccaggaactcggggaagtccacggtgccgttgccgtcccggtcgatctcactcatcatgtcccgcagctcggcctccgtggggttctggcccagggaccgcatgaccgtgcccagctcgcgggtggtgatgcagccgtccccatccttgtcaaacagggagaaggcctccttgaattctgtgacctgctcctcagtcagctggtcggccatgccaggggtgggggcgtgggtggcagaagaggccactgtggggtctccctcccagtgccgcagcccggctgctgtcccagctctggggtggcaggtggagatccgggcggccggcgggctgtctcgccctggcttgagacgctggagcttaagaagcagcagagtcctcccccatcattggcagacgcccctgccctgcggttgcccgggcctgtcctgtttagacaggagtccagggcctgcgaatcgagctgacgccagcacctctgtgcctgcttgcacctggacccagcagagccacgggggccccgaatcacacctgcagtcagggcgtggtggatatttgagtgcctactaggtgcagtgtcactctggaagctgggaacacagtgggaccggcaagccacccccagtcctcgtgaggttaactagcaagacagctagtttgcaggggctggagagacttcttcatgaaggaatacagggacagtcacaggagacaggagcaccaagggattcggacatgtggctgacacagtcttctggagagccccggatggcatcagggggaaacctggcctgagacagtgccctgatggacaaggacaggaatacggtcatacctcctgcccacttgaccaacgaccaggatgagaagccaacagatgatgaatatgaattaaagttggacaactagcaagtttaaaacttggactgggacctagatcttccgattcctacagctagcctccctttccatcttctctgtggtcatcactaatgcagtttttgaccgtcttgtccagaagctgcaaaacagacaacagaagccaggactggccctgccttagatggctttcagtgcaggaaagtatcaagacagtcttgttcgtagcgtatatctctctccaccttttctgctaagcacctcatgtatgcagctgccaatgtaacacctccatttgcgtgtttaatcaccatctcaagctaatgtaaccaagcagacttcttggccttcatccctgcctcctctagtcttctcatctctctctctctctctctctttttgagacagaatttggctctgttgcccaggctggagtgcagtggcaccatcttggctcactgcaacctctgcctcctgggctcaagccatcctcccaactcagcctcctgagtagctgggtcttcccatctctttaaaaaacaattcaattgttcagaacaaaaccctggagtcaaattccatttcctcatgagggcttccctgaatacccacttttaattaactctctgcctcctcccatcacttctgttttaccccctcttttagttccttcctatcttagtttcataagagccagggccgtttccgacttctttccccgtcaagcctccttagataggacaggtcctctgcctcaccgactttaatcagtatttgctaagtaaacagagcacaggaggatcctgttgtcatcaaagagcagctctgcctccaatggcgaaaggattgttggaacctcatccttccttcaagttctggttcaaaaaattccatgctatgcctcacatggccttgcccaggtgcctgtttgatttgcctgggttgtctgttctttcttccccactgtcctcatttgccatgtggctcggtggtggctggagacctccatgctggcccctgggagcagctgctaaggctcggcgcctcaggacaccttggcacctgtggatatcgaccaccaggcttctcttctgttcatgtctctgcaagaatgagaacctgcccccataccatttgtgctgtgtaggcctcaggaggcatggactcacgcatccagcttcctgcaagccctctggtacatcgcagtgttcacccccagctttctattacagccaccacccagggactctggtgcaggctccttagagagaggccaggaaactgccgaggtgataagtgacagcaggtctcaggggaagagaggacttctctccttagtaaagaacctgtcgaggtcggaaagacactccaggctcaaagccaaatttgaaagttaggctgacagcccaactagggcagattggaggagccaggtggagagaggatgtgggggagtcaggaaagaggtggaaggagaagcctggaagagtggctccgctcctggagtatggccagcggcacttcgtcaggacctcgaccttcacccactagtgggagggtgttcctcgcatgacttgtaggatcacctgggaaacacacaaatggaagaatttaaaaatatctgctaggacaccccgtgtcccccacaactcatcacagagcaaacccatcacagagcaaactccttggctacttcttgtcttgggccgtcttttcatctggcctgtttgcctgactggactttggggtctttgttcccagcatcaaaatttcctaccagcgactttccatcacagctcccttccagtcttctggaaattgtcagatgtgcctggatttgcagggcctgcacaagatatgctgtcgatctgggatttttggggatttttgcagttcacactccaatgtgcaacagcaaccaaacggagatggaggacgtgaacatgaactactggagatgctgatgaaacgtgtgtaaggaccgcaatggtatctgtgtcctgctcgtgaaattgaccagatacagcggcttccttttgcttccgaaggcccggattgacctgacaattgatatgctttgctctatactccaactcccattgaccatggggtgaaagcaccctttctcggtcagcctcactgcttccccgcagatggagggattttctgcaggagcatgggccctgggccttcctttcccactgtctcttgaaagcctcctccagatgtgctgcctggctcagctctttgggtgacttttgttctgtctcatgtgacccatcaagattcacacagggctgtgtcccgggcagggctggagtcgacattcagggaggagatcactgttctggaacagagcagtgattggtttaattgaaatctgatagatcatcatgtaaaaagctggcatgtaagcatgctcccggagcctgcagggccctgcgcggcctcttgcctggccatcacgtagaggcggtcctcttgcatggttgggggcctcacctgcaccacgggcccccaagccaaacagtgagattgtacggagaccatcctggtcaggtcttgcagtttgcaccaggtagccccaggctatcctgccgtgcaagagctgccttctcagcacagtggagttctacggctgcctcggctgcagaggtcagctctggagccttgctgagcacctccatggatgcattttgcaaagggccgagtaagaggcattaacgtggcctgtgcttagttcctgacagcaagcgggattaaacccggattaaaggatcagccctaaaccaaagcagaccagtaataggtctcatgataaaagcagccaaataataatagtaaaaatctattcttggacttattactttcctgggaaaagggctatttcttgtgaaatatgcagcgattggaactttccccgacagcccaccgtgagctcactcactgcccctgcctgtgctggggggtggtgggtggtgagaggtgcaagtgaagggtctggacagaggcagagggaggagagggggcagggggatggggaggaagaatggggggttcgctctgggatagcttcatgatccactgaacctttcaaacttgatgcttgacgttttgaaaaaaatgacagaaaatatgggctgggcactgtggctcacgcctgtaatcctagcactttgggaggctgaggtgggcagatcacctgaggtcaggagttcaagaccagcctggccaacatggttaaaccccgtctctactaaaaataagccaggtgtggtggcacatgcctgtaatcccagctgcttgggaggctgaggcagaaaaattgtttgaatctaggagacagagattgcagtcagccgagatgctgcctctaaactccaggctgggtgaccaagtggggctctgtctcgaaaaaaaaaaaaaaagtgtactagggggatgtcgttgaggggcttagccacatgctacagatctttttataccaagatgcattcaatgattagctaagttggacagtttgttactttaagcctccacaaccaaaggggcaagataattatctcccagagaacaagttgatcttctttgaaggataaggagttccccaagcagcaggaagagcttctgttcccaattccagcctttgaagtttaagcttcagaagaaaaccttagcatttaatacaggaaggcatgcacgtgtgtgtgcatgtgtttgtacccacacatgtggctcaagcttccctgtgacaatgggttgcctgcgggtaagcgtgggatgtgtggagaaggcaggagggtttagggcgtgggctcagtaccctgatgagagatttaaagcaggcaaagggattcggcaaagtgcagctcccatttcatcatttcttcagaccctgccttagttatttactgctgtggttttaaactctgctcttcgaaacccttggtttctgcagaagtccttcgagaggttcgtgggggcaaaggaaggtgaggggcaggagcccaggccacccggcctccttcctttccccacgtctgctttcaactgtttcatatgcatcatgcaaatcgcagctgtcatggctcaggtcctcatgtgtacaatgggcgccatggcagcgtccaggtcagagggtgaccagagtgacatgaattaagacacgagaggactccaaagagtggtcaggcctctcacgtcataagatctccataaatggtcactattattttgtgttattaggggtacgcttttcatttgtaagatgacttccatggggccccacgcctcatgaccccgtctcaccccctgcaaataccatcccatggagaggcaggacttgagcctatgaatttgaggggtacacggttcagtccaaaccttttggtgtttctgtgtatccatttctgcatgtgtaaaatgaggagaacagacagcttccgacctcatctccaaaggcgcacggaggaggtggaaaggccctcgccggagactgagcactgcagccagcgcaaggccggatttgctgcttccgcgcggggacgccctcggaaaggtggcaggtgcccacggcgaggaaggggcgggagtgaggggtgcgtggcccgagagaactcagtgaagaagacacgatagagaactggaagcaagaagggaggaaaccaaaaggaacggggaggagaaagggcttctctggagctgcttgcttttcccagattctcctgccattcctggctccagggagtcctgaaggaacgatggttagggcggagaatcctgcagaggaaaggagagaaaggactagaggtcacacacggcttcttggaggggagcggggagcaggggctccgaggctgcgggtcgcaggctccagggcaggaagctctccatgggaaccgtagtatgaattccaccgaggtgcgtcccggcacagacccgaaggcagccacatttgtggaaataagatttgacgtgcatttcggatccgcagagaaggtggactctgttttgcagaatggaccagcggtggggggtggggtggggggcaggaaaagactttaaacgctggcagaactttgtattccactcattcgtgcatgcattcattcagccatcctttcgctatcattcatcaaactagcgcgcactgaggccactttgtgtcagcgcagcgcctggcctgaggacctcagggtggtgtcggcaaagttccgctgccaaggagttcacgggccgtgtttcctgccaggccgcagacactctctgcgtggagcccgaggaggttctgtgtgagatctcaccctgcgggaagaaagaggcggaggctcggggttggtccaatcacacccctgatggtgagagacgggcgggcggggcctgacgcccactcccagctggatgcctgtctcccaccccgcgtgtcctttcccagaccccaaagcttcctgcctggtctcagttcttcggagaagagggattagaagctggaacaggtatttctgctaatggggcgtggcagatcggcatttgcgggggctctgtcaccccgtaagatgtcccagcaggaagcgtggcgggtctccactgagagctccacggagcagctttggctccctgagaagtcgaggtgtgagcagtagcggccttccctttgcagagagaaggcttggggagagaagaccctggtgccatcttcataggaggtggaaaggaaactgtatgacaggagaatgaatcaggtttggggctcaaggtgccggccactgggaaaaacagctgccccgagttgcaaaactctgggtcctatatgtataaactatgccctgaggaaggaatctcaggcgtatcttaggagaaaatgttctagcttgggaaacaaacacaacaggaccgtgaatccaaatatttcaagtgggtttagaggactggagttctaaacgctgcttttactgtaagtgatcacgccccggaatgtgctgaagaaaggaaaatgagccagtatcggcgaggactatgggcaaggaaaacgagagtgtgcgatgtgtcaaagcaagacatctgtgtatagtaatataatcaagtaatagatagtcatagaatcaagctgatgtatttggcaggggccgcgggaggatgaggcaactcccatcagattagaaagatgttaacactgtaacaaaagtggggctcgaggaaggggaaaagcgcagctctctttttaagacgccagaaagtagtcagacatgctaagaacaaaacaaacacaaacgaaaaccagcaaagaaagctcttcgagaagagtaaggctactgatctttaggaatcaaatcattatttccacacatgtcatgaagaacacagacattaaagcacaaaggagaaacttaaatgaaagtaggagggagaagtcaaagctcaagtaaagagatttttaacctagagaggctgagttatcaaggaagaaagaaggccaagccagcttgttgcagaatgttccagaagataagataatgatagacttaaataaatagggactgatcaaggtgatagcgagttcttggtgaaattgcttccaaggattttatagaagtgtatttcatggaaatgtacagtaaccggatgactgtattaaaattttaaaactgctgggtgtggtggctcatgcatataattccaacactttgggaggccaaggcgggtggatcacatgaggccaggagttcgagaccagcctgaccaacatggtaaaaccctgtctctattaaaaatacaaaaattagcagggtgtggtggtgtgtgcctgtaatcccagctacctgggaggctgaggcaggagaatcacctgaacctgagaggttgcagtgagccaagattgcgccactgcactccagtctgactccgtctcaaataaaacaaaataaaataaaaatctaaaactgacttaggcagttaagtgtgtttccaaagaacgtaattggtgggaggcagagcgggcccgaattgccacctcttcccggcacggccagtgctcttcctcccactcccggccacctccgcaggcccctgcccgtgccaggactgggtgaagctgtgaatgtgcttctccacttgggggtgcgggacaatgctggggccctgggctgggtttctgccctaggaagcctcactgttgagtcaggggctgctggagctgagttttgtcttcagtggcttatgaaggaaagatgaagcta

SEQ ID NO: 105 - DNA, 7280 bp, Homo sapiens
gcccagccccggagcccggagcacagggcagcggggaagggaaaaggatgggagggggatgccgaggagggagggccgaggtcggcctcgggacccacggggaaggaagggggaagggagcgaggctggagaggctgcggcgcgtggcctgaggcggagagccgggctgcgggggtccgggccaggccaggcgccggcctgacccgcctcgccggcaagagcaggccgggcttcctcctcccttggcgggcgggggagggaaagggggatcctggccgggggtaagggggaaaggtggtcctgattctccctgtgccaccgccacaaagctgatcctggcctcctgcggagaagcctgagcgccttcccgcagacctgacgcgaccccctcccaggtacctgggcctcggcctggtctagcgagtccccttcctcccaaggagcagccggcggagctcgggtggaggaaagcgaggaggcgaccaggaggatgccgccgccgccgccgcagggcccggggcttctgcagggcgcaaggcctccctcaccagggtaaggggctggcgatcaacctggacgcctgggaccttgggagcaagcatcccgcagccgagcaggcgacggcgcggccaccgcctagagaggagccggggcccggggcggcgtgcgggtcggcagcagccggcttggcctatccgaaaccccaggcctggaagcggctgctttaggcgtcaagttgagcggggtatgtgtgtcctcttgggaaaaaggtgagaaatggagccggactttctccactcggtaggggttaagctaccacacacacccccaaacacatgcccacgtgcaagtccctcccacccgccctcccaggggcgaagagaccctgtcccagtggaagtggggaaacccagtcgggtacagaaagcagaggccatggcgcagagcggaggcgcggctttctggggctcagccctagggctacagacccagggcgcggagatgctcgcggccgggccacccaccagagccaggcaaccggcgcttccaggcgagctccgcggggccgaggtgccgggagaagcggccccgggcgcccgcgcgctgcccgacctgggtaacaggcaaagcggagccccggggtcgaagtcctaaagttactaatcccgcggagggggagagagcgtgcctcgggccgcccggggcggtcatttgagcgtgtttacttaaagactttgcaagcagagcgcgcgcgaaatcgtcggatttccagcgaggcagcaaatatttgcaggcagaagaaagaagcggagccgagccgagccgccgagtccctccccccggagccccggagccccggcgcctgcctgggcggtcccggccgcgcagacagaaaagaagccgggaatctgcggggctggggggcggggagcgacaccaaaggccagaaactgcagcacggcccgaggccctggcgagctgggcctgggggaggagaagtcccttcccattccagctcgatcaatcttgctgggctgcgatcggtcaataaaaacggtgtgaagcggccgctgtcgctgtgagtctggggaggaagtggaggccaaaggtgtcgaggccggcgccagtaccccgcaccagccgggtccgcggccccgcggtctgcacgtcgcaggccgggggccagagctttgccggcagccgagagcggcccggcggggcctttaattgggtgtctccattttaatagaggccattgttggagcaattagagaaagacaataaccgcccagagacgtttaattcgattccctgcgcccgccgcagtacgcaccggggcgctctggaagagtggccgaggctgcgcggaagggagggtccgcttggggaggcgccggcttctttccttgcttgctttgccttcggtgtgggaattgtaaagggcgactggggcaagatgaaagcggggcgagggcgacctgagccaggccagggccggcctctctagcccacgccgggcgcccgcgggaccgccgcgcctttcgcggcgcgcgtccagctgtggccgccgcggaggtccccagcgcctgttcaaaggagagaagccggaggaccgggccgtgaaaactggcctccttcctccttagccccgggtccccatttctgtcacccgaaccatgtccatatttccttccctatggtgggaggaggggcaaaggagagatcccgggtattggagcgcgcacacctccgtctccaacccagccagcctcaccgccccctcctccgcctcggcccctggattaggttaccctggccgcgcaagggtttctactggataggactatagcacaggtaaagctgtataaacagctcgccggctgccgggcgggagggttatgccggggacacggctccaggcgccgccgctggccccggctgcgcgggccacaccgcggggagcccgctgcggcagggcgccccggaccgcgcaggttaaatacatattatctctgtctctgccactcgggcccccgttttctttcccttgcgagctgaaatgcggagagcggggagcaagacctaaacgggaagaaaaggcagtcgggcagtgggcaatactggttgaggatcccggcccagcaaggctggctctcttcaaacaaaacccagagagcagggaacttgggggaaagcagagaaagagggaccctaaaactcactggcaatgggaagatgatggaggcgggtgcgtccaaggggcaactctcctcgcggctcccacgcccacgcgccccgggccaggagtctaccttccccgtgaaatgagctatcgttttggggatggtatgtgatttgatttacccttttttcttttccttcctttagttcttttttctttttcttttttctttttttttctgtttgtttgtttgttttgcttattcatcgatcaccgtttaaaactcggaaggaaacccgcccaggccaggagagccgcgagccgtggggagagtcaaaaaagaggagatgcgctgggagattccccccgcccccgcactccgcccccagcccggccccggcctccacttcgagggatcctgaccctcccaccgccactaccaccttttccccggttgagaaaacccctgattgtagcgagataaaaattggagaccacctggtgaaaaaaaaaatccatgtttgtgcccgactcagaggtgcaaaggaggaggtttggcatgcgcacccttctcccggcctcccttggtcccggactgccccctacccgcagcccctccctccgggcagctcagctctaggctgccttccacctcgcggaccctaagcaatttgttatataaaacaaaacagcaaccagacgcatgtgcctgttcttcactaacgccagcagaccggcagcgacggatacccggtggacctcagccgggacgcctcgggcagcagcttcttgcccgctgccgcacccacctctgcaccccagctcgggtcagcccagcagccaaagcaaaagggggattcctcagtttgctcccttggaggctacaaagcctctctctggttattccaaccgttaagtaaaaaagaggtgatgggaaagatttggtctgcacacaaagatataccaggagaagaatgcacatttatgtgtaaaatggcttaggcaccaagaatgagacatcacttcagtgcagcctagaaatagttaaaaataaccgaatgctagaggacagaggtggttttgggatctgccccacactccttatcaggatccctaattccctgccacctcctatggttccaggacgcaaactgctttaacctccagaagaggggttttcagccacctggctcccacctacctgccggttccccaggcactctgtgtgacccagggcaactggacaacccaaaagaaaacccctaccaaacaatgctcagggcttcccactcccatcccttctctgcgcccctgactgtccccacctcgtttatcttctgcaagaaggcagggtgtaaatgtcaaataaagaaaaatgcagcttgccagatctccttgcttttggtggggacagaatagccccagtgctggggctggcagagatctcttgtgcagagtggaggatgggcccgtggattgcagccgctccgcattttctaagccctgcggcttcttgggccagggacttaaggctttacggggcagctggctgggagctgcaagcagggcctcctgcttgatcccaccgaaagactccataatcagaccccctatgcgacccgacacccaatggggtcttggtctgaactgacaccacgccccgactgggttcaaatgggtagaaaacaattccgttcttctgaatggcacaaacatgtcatggtaagcccctgacacacacacacacacacacacacacacacacacacacacacactgccagccatttgggcccccaagcatctcatttacagatgcctggatggactcaacctgcctggctagacccccagcccacccactgctactaccactaccttctcggcagcagccgctaggcagaggaggctttggaaatgctacttcaacatggatccctttaaagttcttaatctcccatctgcgaccccagcatcctggtgagcatggacaatagggaggagagaaggaccaggaaatatgggaacgaagccgagggagatgccgcactttcccccctgcccttgccagaatcaccggtgtcactttcctcaggcaccctgttggtgtccgagagaaagaaaaggcatgtaaagcagctgtcctgcccagattcactccacttccttgacattttaacaatatctgtcttcaggggggaactgcctctgagtgactttttggaggtctgttggtctgctgtcccgggagttaagtccaaatcttgtcctctctgccccttccgcttcggatgcccctgggcaccctctggggaggctgcggttttctcacccacctcagggtgctcctggaagcaaagaagcctccggacccctagcttcccgggggtatgccagatgcagacacatctgggttccaactttatcttacagagcagagctgtttctttaattatatgcagagacaatgagcctcaacacacacctttaaacagaggaaaataaacatgaaattgacactgaagccacctttagaagaaggctcctgggcacaggggttgttttccccaatcctctgccctccttgcagtgggaaacgtgtctccggccctttccaagcattcccacgggctctcattcttccgttgggtttttcttcacatccctacttctaccagctctttcctgcaaacgaggacatccacacactcacacaccgtacccgcccaaggtcaccacagaaacccagagatttccagtgaccaaaaagaacaataagaactgggttctagtttagtttctttcagagggagtctgccctttggagaggaggcctcctcctaattctctccacgtggagcgggcagagggagtgcggagttagagagggaagagagtgatattcactgacctgggcagctcgctcccgagggccagctgttttttattttttttcctgactcgcccggagatctgaaggcagaaatgacaggcagagttcgccactgtggccgccgctgccgtcctggccgctggaactgctcaccgcatctcaggcgggcttccagcgagaggaacaaaagccacctcaacgcaacaggctttactggctgcctcttacaggatggatttcagaatccaaggctgtacggggagtcccctcccaaccactgacagcaccagaatctcccggcttcaggaagtggaaggggcaggagtcattggctgcagcgaacgcaagattctcaaagaaatagtttcctaacagaatgactgataccattgtggaaagagacattattcaggacattatctgtttcattcttccgtcaaggacatttggaaccacaaatcagtcaggggataaagatcctcactgtgcctcactgtagacacctttggaagagaaacaccttgtcagccacagaaattaagctctgccagttccatctggctctgacggcagatcatcacaccagaagagcgtctcggtttcatgaggtgagggtctgtttctcaaataccatctccctcaataaaatcactagtcaggacaatccccgccccccccgcattacttctcttaataaagtattgatgctattcaaatgacagtgctgggctaaatgaaagccggtcagggttttgcttccaactggaacactgcaagccctctaaagggaaatacttctcattcctttgtgtcgaattctgctacagtagttcctcaaattgctgctgttgcgatttccttctccctcaaaagtcaaaacccatttttccctgatgtttgggtccctgaactttttcttctgatcaaatcatcctccccacttaaccctctcccctctcacccaatataggcttttcttttccggttttgcttgacttcattaaggaaagtaaattaatctctgtttgtctgtggtatttgtaagttgctcttttttcttcggtattactttctggagaatgactacgcccaactttctaactttttctttgtaatgtggatgttttattttctaatccacatttctctttgcagtttcttgaacttcctttggttggtgtcacagccagccacccagtagagactgagaccaccagttcatttcacacaggccactgaacagtcataagatggtgacaacttttggtctctagtgacctggactggatccgactcactgacctagaggtgaaaggctctgtattccattactaatccctcgagctctccagccccctgaaaatgattctttggttttattattgcaaagaccatttataaaatcatgaactggatttaggaaagcaaccatgaaatagcaagggacaacaaactgattgaaattccttaaatgtagcatgggctgaagtctctcagacagtaagattggggggaaagttatatataggcacctccattctgatttcagtagcgtgacctgctcacttaaacgtggcaacttcagatcatggaccacgcctcaaggaactaaatcctaaataaagaaaatggaaaagcaaactatgaaatagccaataatctttattttgcacttcccccacccctcacccctctccaaaaacca

SEQ ID NO: 106 - DNA, 9735 bp, Homo sapiens
cctcgggtcacctgcaagggagagaatgggagacctggatgagcccctgagttgctggagtggcacaacctcccctcgcgccgcccgcccgcccagcgcacccgagacccgcacgggagcgcggggacacggccgcggagcccgcagggctctcggggacgtccctgcagcccggctcgcgggagccggggctggctgagcaacttggagggcaagtcccagggctgactgttacgacttggagggcaagtccctccctcggggacaccggtcccgggaccgtcctctcagcccctagaaaacctccaaaagaggagagttgagtttttaaaattgatttaggtcctcccaagtggttgggggcaaaaaatcaaacttaaaaaaaaaaaaagtcaccagtaccaacctgggtagcgaagagcagagaggaggaggaggcggcggcgtacgacctgctcggtcagattgcgttgctcgctctgtctcgctctccctccgtctctctctcttcttctctctctctctccctctctcagtattttttttttttttttacagggaatgcattctttctgaaagtatcaagacggcgccaggcagctcagtgttcgcagacagctgtggcgcgacgcaacttaaggaggttctagtgtcatccgcgccgggggggaggagcctggcgctggcgagtaggggacaggatccccggcacaaggaaactgcaacccaaacccgctccaggacttctccccccgccccgcgcacccccgcccctcctcccgcccctccactgaccggaaaggggcgccgcagagggcggccgccggcggaggggcggcgggcagggtgggcgaggcccgcggggcttgggggcggacgggagggaacgcgcgctctggccctttaaatgtggccgcggctcctgccaattcattcgggtcgggtggacgattccgtcccggtgcagccagcctgccccattcatgaagttcatttcgatgggcagaattttctttttcagacttttaaaaaataggcacgcatggatcattattaggatctaatgcagggtgtttgggagagcgcatcgatgtggggaaacgtgcgcgttaaattgatcagaaaaacaaaatgtttcatgtcaaggtattttgagatttgcctctcgggccgacttcctaagagggtgagtcatcggataaaggggagatgcctttgactggagcgtccgcgtcaattttgttgtcattgtcacctctttcccgagccttctgcgctctcaagcccccagagtgaacacgcttcagctgttgcagctgccctttccagacctaatatttgtaatcaatgtgtgcttttgacttgagtggcaacagtgagggatgagaaggggggaggggaggaagagactggctctaactcattccccgagtacgctcagtgtagacggacagaaagaactcggtcttcactctagggacccaacttttcctttcgccccgcccggagccctacttactccggctcccggcgtttctcccacagtcaaggaaaccagccctcggtctgcaccgaccccaaccccggcctctggtcgggactccacggcgaccttccccggctcgcgggtctccaggccacgctctgcgcaatgggcaccccggggcggagggcacgcggctccgaggcgccccagcgagaggggcggggcgagcgggggcggggcctggagggaccaatcagcgggcgaggctgtggccgagccgcgattggtccgccccgcgggttccaacctgcaccgcccgctcggtcctttgagccactgcatcccctagcggcgcccgggtggctgcagccgctggcccgaaaatgctgctcgggcgagcaggggtcaggcgggaaaagaagactccaaatccactctctgctcgcccccagggcaatgctgccaggagagggagtgggttcccccgcaggctatcccaccgatggggctgagagcttaatttggggttttatttgaattggagacattgttccctcttcgctcctctaccccataaaattccctacaaatgcaaaaattcgagatagaagaagccgtccctgaaagtaagttctgaaggattcctttcatgcggtgaaggaacaacaacaatattcaacttcaccttggtgtgtgagggtcgtcgtgttttaaaacactatccctgtagaaagattagtgaaatgtattggaagaagtagtggaaacgtgaatcttcctggtctcgcgtttggatcttctttggagtcctcaccttcttaaatctgatgtttgtttgaaatcagggctgaatttccatatataggacagaaagaaagaaccccaattttttaaagaaagctccccccccccccgccacgtttctcctgagcccacttggtctcccgttattaggcggcccagttaagaggcatcgattttcctttcattctctgaccactcgtctctcctgggccagccaggctgcccgcatcttctcctgctcacagcgctctctaaaccttttaattatttagttgctgtctaacattcaccggaaacctctccataaacaaggagaaacgaatgcacacgcatttttgctaagaagcccgggattaagatttaaggatacaagctgaaagaaaaaatgaaaaatgcttctccgcgcgtcaatcgaggggtggatgcgccacgcagcgtgagcccagctcacagccacgcgtaagaccaaaagctgccatgggttctgcgcgcggagacctcagagccgaagagagaagtccccgcgtcagaaacgctgcggatgccaggtcttgaaaatgctgacttctgaggctaagaattatttcaaagacaaaaagaaaagactggagcagccggcggagctcgggtggaggaaagcgaggaggcgaccaggaggatgccgccgccgccgccgcagggcccggggcttctgcagggcgcaaggcctccctcaccagggtaaggggctggcgatcaacctggacgcctgggaccttgggagcaagcatcccgcagccgagcaggcgacggcgcggccaccgcctagagaggagccggggcccggggcggcgtgcgggtcggcagcagccggcttggcctatccgaaaccccaggcctggaagcggctgctttaggcgtcaagttgagcggggtatgtgtgtcctcttgggaaaaaggtgagaaatggagccggactttctccactcggtaggggttaagctaccacacacacccccaaacacatgcccacgtgcaagtccctcccacccgccctcccaggggcgaagagaccctgtcccagtggaagtggggaaacccagtcgggtacagaaagcagaggccatggcgcagagcggaggcgcggctttctggggctcagccctagggctacagacccagggcgcggagatgctcgcggccgggccacccaccagagccaggcaaccggcgcttccaggcgagctccgcggggccgaggtgccgggagaagcggccccgggcgcccgcgcgctgcccgacctgggtaacaggcaaagcggagccccggggtcgaagtcctaaagttactaatcccgcggagggggagagagcgtgcctcgggccgcccggggcggtcatttgagcgtgtttacttaaagactttgcaagcagagcgcgcgcgaaatcgtcggatttccagcgaggcagcaaatatttgcaggcagaagaaagaagcggagccgagccgagccgccgagtccctccccccggagccccggagccccggcgcctgcctgggcggtcccggccgcgcagacagaaaagaagccgggaatctgcggggctggggggcggggagcgacaccaaaggccagaaactgcagcacggcccgaggccctggcgagctgggcctgggggaggagaagtcccttcccattccagctcgatcaatcttgctgggctgcgatcggtcaataaaaacggtgtgaagcggccgctgtcgctgtgagtctggggaggaagtggaggccaaaggtgtcgaggccggcgccagtaccccgcaccagccgggtccgcggccccgcggtctgcacgtcgcaggccgggggccagagctttgccggcagccgagagcggcccggcggggcctttaattgggtgtctccattttaatagaggccattgttggagcaattagagaaagacaataaccgcccagagacgtttaattcgattccctgcgcccgccgcagtacgcaccggggcgctctggaagagtggccgaggctgcgcggaagggagggtccgcttggggaggcgccggcttctttccttgcttgctttgccttcggtgtgggaattgtaaagggcgactggggcaagatgaaagcggggcgagggcgacctgagccaggccagggccggcctctctagcccacgccgggcgcccgcgggaccgccgcgcctttcgcggcgcgcgtccagctgtggccgccgcggaggtccccagcgcctgttcaaaggagagaagccggaggaccgggccgtgaaaactggcctccttcctccttagccccgggtccccatttctgtcacccgaaccatgtccatatttccttccctatggtgggaggaggggcaaaggagagatcccgggtattggagcgcgcacacctccgtctccaacccagccagcctcaccgccccctcctccgcctcggcccctggattaggttaccctggccgcgcaagggtttctactggataggactatagcacaggtaaagctgtataaacagctcgccggctgccgggcgggagggttatgccggggacacggctccaggcgccgccgctggccccggctgcgcgggccacaccgcggggagcccgctgcggcagggcgccccggaccgcgcaggttaaatacatattatctctgtctctgccactcgggcccccgttttctttcccttgcgagctgaaatgcggagagcggggagcaagacctaaacgggaagaaaaggcagtcgggcagtgggcaatactggttgaggatcccggcccagcaaggctggctctcttcaaacaaaacccagagagcagggaacttgggggaaagcagagaaagagggaccctaaaactcactggcaatgggaagatgatggaggcgggtgcgtccaaggggcaactctcctcgcggctcccacgcccacgcgccccgggccaggagtctaccttccccgtgaaatgagctatcgttttggggatggtatgtgatttgatttacccttttttcttttccttcctttagttcttttttctttttcttttttctttttttttctgtttgtttgtttgttttgcttattcatcgatcaccgtttaaaactcggaaggaaacccgcccaggccaggagagccgcgagccgtggggagagtcaaaaaagaggagatgcgctgggagattccccccgcccccgcactccgcccccagcccggccccggcctccacttcgagggatcctgaccctcccaccgccactaccaccttttccccggttgagaaaacccctgattgtagcgagataaaaattggacccgacctctcctccgtcccagggggccgctcagccacaccgctatagcacccaggactccggcccctgcaccaaggaaaggctccagcctggcagaaattcacccatttcaaggcttggcccaccaggccttagcattgccgggtgaggtggggtgcacgcggtgttcagtctggccagtcggagtcacctgctccactcccccggcctggtcacccacatcctcacagccacccagctcctgagccccctggccaaccacagccccaacccccagcgctggcctcagccgagtctcctccgtctgcttcagtttggccttttaggaggagaaggagggctttatctggggactattgtgttttgactcatctagattagcctaggagctggagtgtgattgtagcgggacactctggcaggggatgtgttcacagcacggataggaaaagagggggagggggactccattcagatcttggagacagtagaggcgcgcttttaaaagcacaaaccgttcttgtcttcctttggacatgctagagaccacctggtgaaaaaaaaaatccatgtttgtgcccgactcagaggtgcaaaggaggaggtttggcatgcgcacccttctcccggcctcccttggtcccggactgccccctacccgcagcccctccctccgggcagctcagctctaggctgccttccacctcgcggaccctaagcaatttgttatataaaacaaaacagcaaccagacgcatgtgcctgttcttcactaacgccagcagaccggcagcgacggatacccggtggacctcagccgggacgcctcgggcagcagcttcttgcccgctgccgcacccacctctgcaccccagctcgggtcagcccagcagccaaagcaaaagggggattcctcagtttgctcccttggaggctacaaagcctctctctggttattccaaccgttaagtaaaaaagaggtgatgggaaagatttggtctgcacacaaagatataccaggagaagaatgcacatttatgtgtaaaatggcttaggcaccaagaatgagacatcacttcagtgcagcctagaaatagttaaaaataaccgaatgctagaggacagaggtggttttgggatctgccccacactccttatcaggatccctaattccctgccacctcctatggttccaggacgcaaactgctttaacctccagaagaggggttttcagccacctggctcccacctacctgccggttccccaggcactctgtgtgacccagggcaactggacaacccaaaagaaaacccctaccaaacaatgctcagggcttcccactcccatcccttctctgcgcccctgactgtccccacctcgtttatcttctgcaagaaggcagggtgtaaatgtcaaataaagaaaaatgcagcttgccagatctccttgcttttggtggggacagaatagccccagtgctggggctggcagagatctcttgtgcagagtggaggatgggcccgtggattgcagccgctccgcattttctaagccctgcggcttcttgggccagggacttaaggctttacggggcagctggctgggagctgcaagcagggcctcctgcttgatcccaccgaaagactccataatcagaccccctatgcgacccgacacccaatggggtcttggtctgaactgacaccacgccccgactgggttcaaatgggtagaaaacaattccgttcttctgaatggcacaaacatgtcatggtaagcccctgacacacacacacacacacacacacacacacacacacacacacactgccagccatttgggcccccaagcatctcatttacagatgcctggatggactcaacctgcctggctagacccccagcccacccactgctactaccactaccttctcggcagcagccgctaggcagaggaggctttggaaatgctacttcaacatggatccctttaaagttcttaatctcccatctgcgaccccagcatcctggtgagcatggacaatagggaggagagaaggaccaggaaatatgggaacgaagccgagggagatgccgcactttcccccctgcccttgccagaatcaccggtgtcactttcctcaggcaccctgttggtgtccgagagaaagaaaaggcatgtaaagcagctgtcctgcccagattcactccacttccttgacattttaacaatatctgtcttcaggggggaactgcctctgagtgactttttggaggtctgttggtctgctgtcccgggagttaagtccaaatcttgtcctctctgccccttccgcttcggatgcccctgggcaccctctggggaggctgcggttttctcacccacctcagggtgctcctggaagcaaagaagcctccggacccctagcttcccgggggtatgccagatgcagacacatctgggttccaactttatcttacagagcagagctgtttctttaattatatgcagagacaatgagcctcaacacacacctttaaacagaggaaaataaacatgaaattgacactgaagccacctttagaagaaggctcctgggcacaggggttgttttccccaatcctctgccctccttgcagtgggaaacgtgtctccggccctttccaagcattcccacgggctctcattcttccgttgggtttttcttcacatccctacttctaccagctctttcctgcaaacgaggacatccacacactcacacaccgtacccgcccaaggtcaccacagaaacccagagatttccagtgaccaaaaagaacaataagaactgggttctagtttagtttctttcagagggagtctgccctttggagaggaggcctcctcctaattctctccacgtggagcgggcagagggagtgcggagttagagagggaagagagtgatattcactgacctgggcagctcgctcccgagggccagctgttttttattttttttcctgactcgcccggagatctgaaggcagaaatgacaggcagagttcgccactgtggccgccgctgccgtcctggccgctggaactgctcaccgcatctcaggcgggcttccagcgagaggaacaaaagccacctcaacgcaacaggctttactggctgcctcttacaggatggatttcagaatccaaggctgtacggggagtcccctcccaaccactgacagcaccagaatctcccggcttcaggaagtggaaggggcaggagtcattggctgcagcgaacgcaagattctcaaagaaatagtttcctaacagaatgactgataccattgtggaaagagacattattcaggacattatctgtttcattcttccgtcaaggacatttggaaccacaaatcagtcaggggataaagatcctcactgtgcctcactgtagacacctttggaagagaaacaccttgtcagccacagaaattaagctctgccagttccatctggctctgacggcagatcatcacaccagaagagcgtctcggtttcatgagtttcttgaacttcctttggttggtgtcacagccagccacccagtagagactgagaccaccagttcatttcacacaggccactgaacagtcataagatggtgacaacttttggtctctagtgacctggactggatccgactcactgacctagaggtgaaaggctctgtattccattactaatccctcgagctctccagccccctgaaaatgattctttggttttattattgcaaagaccatttataaaatcatgaactggatttaggaaagcaaccatgaaatagcaagggacaacaaactgattgaaattccttaaatgtagcatgggctgaagtctctcagacagtaagattggggggaaagttatatataggcacctccattctgatttcagtagcgtgacctgctcacttaaacgtggcaacttcagatcatggaccacgcctcaaggaactaaatcctaaataaagaaaatggaaaagcaaactatgaaatagccaataatctttattttgcacttcccccacccctcacccctctccaaaaacca

SEQ ID NO: 107 - DNA, 6529 bp, Homo sapiens
tttggggctatttaatataacagatggaatatcagtaactccatagttatcagaaatgactccaatatacttagttaatacacgtattaaacaaaattactccagaaatccacactaagatcaaataacataactaataacataactttctacaacacagaaaatgtttttgtgacctaggatcaagatggtcagattgatgtataagagtttttaaaaataattctgaccttgccttacagtgctcataaactagacccttcaacggtctgacccatggacatgctactatatgacccacctaaagaaaatggccccagaaggaagtgtggtcagtgtcaaaggcctcacttttcataactttattctaacctgtttatttctcttccatgatccctttcacccttttgaagcgagaaagcctgagttagacacgtcatcatcattttaacattgacaataacattaaataagagtgaaggactgtatcagttctgaaactctacacacattttccatattatgttgtattttatttattgtgtgttaacatcgacattattaggtatacagatacagatgtcaatgtacacagataatctctaagtaaaagaaaaagacaacaaagttacttgggaggctgaagtgggaggattgcttgaggccaagatttcaagacaagccttggcaacatagtaagactctgtctctaaaaaatgaaataaaacaaaatagctgggtttggtggcagcacattcttgtagtcctagcctaattaggaggctgaggtgcacattattcagttcaaacttccctgttttaaatgattatgaatataagtttatccatttcttgagctgacatgtcccttcaagtgggaaaccatggtgagcgcctgattcccttctgtgtcatattttccaagctaagaaatgtgtgaggtctgttactaatgaagtcaccacagcacagagattgttaaaatcctcaaacatttgagctggtactcagttttcttggtatcctcatacctctcaaaactgtctaactctttgcataagaaatttaggtgtggttttttttcctatgtttatcttctgtttgtgggttgtgttttatttttcgtgtaaacttttacaattagatacagggaaaagaggttctgttattacttgatgaattatgtacctactgttaagcagttttcagaagatagtatccaaactttctacgatttcatacattctaccaaatggtagaatgattttaacccagttctttgtaatatgcctgctccacagtaagtgcccagtaatcatttactaattatcccttggaggtacctcctgaaatatttgtgtaataccggatttttaaatattgaactctcaaatgccaaaaataaaagagaatgtatttttaacacactcttttttggtgaatgtgtgtatttgtgttcagtctagactcatttgaggcaagaaaacaatgttgttgcctgatatttgctactgaaatttacttcattctgtttccctttgttttctatatgtctgtggcaaaacttgtttctagccatttattgcaatattcaatgtgcacagctttaagctctcagctttttaatagacttggaattgaatagaaaattatgagaatatgttttcacaccatattttcaaaacataagagctgcgttaagacatcaaattggattaaatattgtaatattattacttctaaatgatataattttatgttatgttgaactaggtgatagttcatagatagatagatagataaatgttagacacatagatatacacacacacatatatccctcaatagctcagtgaaaactttaaggagatatatcttaggcctgaaaattataacaataatgaaaaatatgccaaatgatacaaataaattggttaaaaagtattggttcagaggaatatgtagcatggaaataaagaacttgcaaatcaaccagaagaatcagaatcatctgctagagcttcggctttggtttggtttgctttctttttgagacggagtcttgcactgtcacccaggctggagtgcaatggcacgatctcagctcactgcaacctccgcctcccaggttcaagctattatcctgtctcggcctcccaagtagttgggattacagatgcccaccaccatgcccggctaattttttgtatttttagtagagacgaggtttcactgtgttggccaggctggtcttgaactcctgacctcgcgatccaccctccttggcctccgagagtgctgagattacaggcgggagccactgaacctggcctggtttggtttgctttaatgaatgactacttggcacacacctttcttcgggtaaatttgctttgattttctcctgaaacaactttgaatactagtccaggctctactaaattcacaaaaataaataagaacatgtaaggatataagcgcccaaatagattttgctttcttgaaagtaagaagccaatacacttagaaaacccctgatatacctaggaatgacttaattttaagttaatccttggaattggatggctcagctaaaattggattttttccaaattaataggaggctggctgagttgacatggctattttgatttttttattttataagttgaattctttcttttctcatcctcactctcctttactgggctttcaaataatattagcatttgcccatcaatgcagagtataccatagatccaattattttcattttattcatacatactccacttaaccccccctcaatacatcctcccactggagcaagcaaaaagttagtttattggcaacacagaggaacatgctctggaacaattctctcttttatatgttacagcataaggtcactggagctaaccgtcttcccaagaaggacatctttctgagggtatcaaggaagtgtgctcatcaggatttcatgcttcctgtcactcttcacatctttgttatcctgtactgctgaagcagatttttttaaagtacatggggagtagatttacacaacctttattcccagattgcaggagagtgagaagcaaaaaatagtgcccagaattggtggaattagaaccaaaaggtgtctcctgtgacataagcctttggagagacacaataatcatgtcatcttctgctctgtcattcacacaatgtatagaacaatgatttgaccaagtaagaagagacaaagagccaagagtttgtttggaggccggagtgagcttgacagaactagatgaaattggccactgggcactgggacccagaaaggcctcattgccacagagttgcaacagagtgtggggtcccattatcagaatcctttctatggtgcatccaattggctatgactctcctaagaacagcgctgcaggaaaatgcaagttcacaggataatgaatgcactgttgcttctctgctgctgacttttcccacgaataaaacttgtatttatttgtactgctggttcgggctgccataaaaagcaccacagacgatatggcttacaccacagaaactcatgttctcccaatcctggaagctgaaagtccaagatcaaagtgttgtctgggttggtttcttccaagacctctactgttggcttacagatgattgtattcagttcacatgatgttcttctatgagtgcctgtgtcgattttctgttcttataaagatatcagtcagattaaatgatggttcacccaaatgacttcatttcaccttaattacttctctaaaggctctatctccaaatacggtcacattgtgagtttctcagggttaggacttcaacatgtacatttgaggagtggaacacaattcaacccataccgtgtaccatggtagtcccaatgtccccattttccaacagcaaagtgtttatggaatatcatgttctacctgtgacctttctattctctcttatacaatattatgtcactttcatatcatagttaattttacatgtatttgttcctcatctccaaaacgggtctgcaaactcctggagagaaaaatctgcatttgaaactagcaggtgcacagcaactattaactaatataaaatgacatctgaaagaaacaaagcccacaatttttttcccatgcctgtcaatagagacttcagaaacatatagttattttgaagaaaataactttatattctttaaaaactagatagtaatttgaaatcatactttcaatgctacaacagacatttaaatagaggaaatatccacctcccattctccaatcaccacctccctcatttcccagcatgtttagagttctagccttcaccaaagactggtatacaagaaagcaaattgaaaatccatcattttctggtacggtaaggctcatttattcattcaataaggatttattgctttgctgtgatgtgccaggtatagggcttggtgctggtaataccttagtgaacaagacatagatatgcaatagaatagtaactgagttcagattttttacgtctcaaccacttcagtgcagattagcatatgaatgaactatacaacttattttccgtcacaattttggtctagtctttgatattcttcttctatcctatgaaatagcttttctttcataagcagaagaagagcagaatgaaatagagagctgtgctactcctcggccaatttctttataaaattacatttggaaatttctatttaattggtccctccaaaggctgtgagctgaaaaatttatgggctctgatatggtgacagacgaaaagtggtccaagtaatttttgaaaggtgcctaccaaaataaatgagtttttaccagtgatatctctataaggactcttggtacatgaggattcgggaatttggggatttatactctattatacttaggacatctcattatagaagtgtgtcatatgacacactctgggccaactacattttttcatgacattttctaactggaaatagaaattcgatcctcccagtgatccctacggaatgggatgcttgggagctgtctggtcatgtggagggaagtcctgaactcagcagtgatagagaatgaggtccacacagactctggattatactttgtgtacaaagccgcacacttgcacttcttgtcactacctccacagctgattccctggtccagtcttcacctctcacctgcctgctaaatgatcttgcttctccctttgcccccagattgtctcttctcaataaatcacctggaatgatctatttttaaagtctaagagaggtattgttactgtgcagctcaaagctgtccagtgctccccatttcatgcatagtaaaagctgaagtctttcccagggactacaaggatgtcccctatctgtcctcattacctctgtggctgccttttataatgatgtcccctatctgtcctcattacctctgtggctgccttttctaatgatctccctctgcacctcggcacttcagaatagtgcccttgctctttagaaatactccctgtgaattattccccagcagagagtgttctcccagatatgaatgtggctctcccttgcctaccttaagttttcactaaaatgtagcctttccagccatttctgacctgactactctatttaaaaatcaataaatttggcacatgtctcccttctttaccttatttttatctatatcacatttcattatattcttatgtacattttcaataaacttctatatttcttggtctgtctctaccctctagaatataacttcccacccccagtgcctaggccagtaccaggcaggaagctggtagcattaaataaatagttaggctagtaactttgaattaaactcatggagagatcaggtcaggcaaacctctgcattgtgttagggtaacatttggagaactaccaattaagctttgtggaagtgctcagctgaggatataccttgccactcatttgctggaattctggtataaattggtgggaggtcaaagagacatgtgtctcaaacagtctttaacttcaaaactgagtggaatgagtcctggatgaggtattttggatggaaaaccagacacaaactacatgcaatatattctttactaaattaactaaccttaaaaatatgttttataaatttctgaactagaaattcaatttgataccatcttccaccggcccacatttgttgttttaaataaatttggagtcctttgggcacattaaaagatggagaatgtcaggtctgcttggatatgttcaaggcatggccctgtttgccatagacatggggtttatgcaaacatggctattcctctaaggcttgcagtccactcagttttggaatcacagttgcagagatttcttaatttatttgtctgtgtcgatgcctcgcttagtgctttgagtgttggaaacttcctcaacaatttctgcagttctaccaatctttgctgtgggttgcacaaaacaaag

SEQ ID NO: 108 - DNA, 6529 bp, Homo sapiens; identical to SEQ ID NO: 107

SEQ ID NO: 109 - DNA, 26917 bp, Homo sapiens
gactcccagtactacgctgaataggaatggtgtaagtgagcatccttgttctagttcctagggaggactgctttcaactttcctccattcagtatgatgttggtggtaggtttgtcaaatacggctcttattattttgaagtatgttccttctatgcctagtttcctgatggtttttaatcatgaagggttactggatgcttttcttgcatattgaaataattatatgtttttgttttaaattatttgtgtggtgaatcacaattattgatttgcttatgtcgaaccatccttgcatccctgggatgaaacccatttgatcatggtgaattatcttttgatgtgctgttggatttgatttgctgctattttgtggaggatgttttcatgtatatttatcaggaatactatatagatctgtggttttgtttgtgtgtatgtgtcctttgtgggctttggtatcagagtgatcctggctttgtagaatgaattagtgagctatcgagatgtaaaagtaagcagcgatattaagaaaaatattttttattaaagactttttctgcacatgtaaaaatattaatgtctttaaaaacattccaaagtttttatagacagaaaataaagcaagggaagtgtttgtatcactttgaagataagtctgatattcagcaaaggatatgttctactaatccaaaaatttaaattgactttgacctgaatagcgccaaccagttacattaaatatagggatggagaaaacattacatgattattgtactctaagtgctattttgatattctcactattaacataaacctgaaaattgaatttagaattataactggataagagcaacttcaccatcacccctaatccatgaaagtctaaaaacctaaacaagcaaaaaaaattttaaaaaacaatgataatggtaagatgacatacttgaccagaataaatcaagttgtctcagttactccattgtgttacattcagcttttttgaatctagcgcataaattggggttgatttatgcttaatacaaccacatgatcattcacacattctccctctcttgagtttatagatttaagcatatagcttcacggtttttatctccgtgaaaaatccatccaaaatgatatatcagacttactatttcaaaaccgtagcaaacaagcaaacaaaaaacaactctcatggtgatacagaaaatttaaaacaaactatttgttatcagaaagatacctacaagagcattgaagtgtttctttctagattccatcttgatgcaaaatgcatcatgtagcctcgggcacaccacatttaaaatagagcaaccactgatacggtgatgagctgtgatatatgctgtttgggaagcaaaggaaagaccgtatctttactgggaaaatatagcaaccgaaagtagatccttttatttccactctatgggtaaaaatagtgaaaatggaaagttgagtaatgctgttagcttatggtaggtttagctgccagacaactattctgtattatgaaaagacaacccactcctaattcagataagaccagtgtttggcatctgtcaaagaaacgagtaaacgtacaagttctgagacttctatgtctctcccaaaattcaccaataggcccactcctagattatatatggaattttgaaaaacctataaatactctattctattacttatgttaacgtgagtgcatgagcatatttttcaactgaaaagctacctgggcatgatgaagttgaagcatgaataaggaactccaacaagaagccaagttacggcaaaatgggatagtaagtcctaatggatacataatcctatctagaaagaaaaattacatcaaagaagatgtgttcagaaatattgacctaatgcaccatagactgtagaataaatgaaataagactgcttaagctaactagaagataaaatgatgaacaacatttggatcattccaaaaagtgcattttcttttttcattttagaaatcaaaggtgagtcctattacgtgggcagtacattattattttatatcaataatccctatgattaaactagagatcagaaatttaagcattagctatcacgcatgtatttttctcacttataaagtatcctttttttttgcaattgattcatacaaaaaggaattacttttaaggattgttcttgatgaatgctactgaaattgtaaaagtagtcttttgttatttttgagctataatgtattacccatgagctctgaagctctgtcgttttgtcttattgattatttgctgttctttctaactaaggacattgcttctgtacttccttcacaaactcaaaagagcatttggtgacattataaaatatatccagctattggatttttataatagttaatcttcaaggaaagcatgggaactaaaatgtcaatcagcaagaaattttaaaaacatttcaaaagacttgttcttttttttaaacttcatcatgatacaaaaggccataatcctctgagaatccatttttctgccacaataaaagaaacaacaatgatgataaacttattttttaacccaagttaaaactgactatagagaattgcaatatgaagacgataaatattcattacacaattgagtgaaaactagccataaattcactggcatcataaacttggacaaggtcaaagttatcattttgtagactggatagttttagcactgatgtgtcctgatgatagtttttattttttaaaaaatttttatgttacttattttttgaaactaattaactaatttcaatagtttttggggaacaggtggtttttggttacatggataggttctttaggggtaattactgaggttttggggcacccatcatctgagcagtgtacactgtacccatgtgtagtcttttactcctcaccccctctgtcacacaggagtgcagtggtgtgatctcagcccactgcagcctcaacctctcagactcaagtgattctccacctgagccttccgagtagctgggactataagcatgcaccaccaagcctgcataagtttgttcattttttgtagagacgaagtcttactatgttgcccaggctggtcttgaactcctggattcaagcactcctcccgccttggcctcccaaaaagctgagattataggcatgagccactgcacccagcctgatgactgtttaacttcactttccatactttcttctctgtagctagcttggttcttgccacttttggcagtcacaaattttcacatcagtatcttcatctttgagtattgcaatgtcattcatagcaccacacaaactagaccaattctctccatattctacggtagtttctatttttcctttcagttttttaattcaagttatgtcacctacatgctattatattgttctgcctggttagtaaccgaatgcttcagaatttccattttgctcagtgggctttctctctgtgtcatgaaagagttagggtttcctttgatatgcaggcttagaaataatttatctactctttatcccaacaaaaacatttggtcttttattaaatgcaataataatatttaactaatttaatgactatttgttttgatcccttaataatttagtctgcatcaatatttggctggagtttaagttgccaggaggtaaaggctattttggtttaattgcttttataaaagcttcatgtaatgccatatcctgttaggtgtttcataaagatgtttcatgattgcatgcacttaacatcagataccggttaggtgctttaaaatagtagctaaatacttttacgtatgcaaatattgaggggttggaaaaacaccatctttattctcagagtctaccaattaagatttattgatcataaaatatttatacagtcgtaggttaagatgctatcttaatagtcataaagtctggttagtaacatggaaactgtttatgatctaataaaagtagccactcttcattgagtacatactgtacagcaggaactttatataaatcacctcaaagtttctcaaccaaacctcgagtgaaaatttcatgaagaaccatctaaaaatgctgatgcagaagggtagctaatcaagatcacgccgttatatttgaattactagaaagggaccatgagtggttaagtgtaaaatacatctctcaagtaacacacaagtccctgtaatctcatctcaccttctgggaacaatgtataacaaattaaagctggttcatgaaatgtcatacaatctggcagcaagattctaattgatgaagaaatggctattttaatgattctttaacaaccatagaaaatttccaattactgggaaccgtgacaaaaactaccttaaggggacaaaataatttctaacagttttttcaaccaactcagaggccccagtggatgttttcagacctgttctctcttgttttattagtttggttgaatggatgggcagctgatttctactgtgaatgtttaaaaaattatgtacaaaattagaaaacaaaacttgcagtttccagatttgcctacgatcgcatttcccataaactcagcaattgatgttactcttgaaatgaattttgacgtgtgaatttgggttcaactggtgcctctgccctccgttttggcctctgcatgccaattcccattgcagcatgtatcacattgtacttttggaacagaaatttatgtttgatcttccccggtaggccatggggcaccgtgtgtgttcaatacatagtttgatattgaatagattatgactttcctttttattaaaattatggatgttgtaatatatgttgatcttgtaatatctctatgtccttcccacaaatgtgtacacacacatgcatagacacaattttattgtatctatctgtctatctatctatctatctatctatcatcttcattctgaatattccagacatttcagggtgtatctgtaacctacctatgagtctggttttatgtctaatctatataaaataaaggaattaattctatttcaggccttgtatttacaatttaattcctccagaataatgacagtaataaagtcaaggttttggtaaaataagaattgctattaagtaagttttgaaggttcctagaaagaaagaataaagcacttggaaagaagaattcaatagaaaaataaaaaagaattataattcagataaaatttgacaaatgtcattggtttgtcctatattctgattctggtgaagttaaaaccgtattatgaatctatttcccatatcatgtttccttccaaaatagattactgaaaatagaagcaagcataatgaacctgaaaattctggtttacaggaaaaaaacccataataattaatatgtttcagaatttattttctcagcatctacatttgtttctcatcacatgtacactagcataaatgaagattaagaaataagtctttccagattatttttactcaagaatttgtttcagtgctaggcaaggatgatcaattttagtttgcatatgaagactcaaagggagatgattaaaagcacgtaactctttgactcatccctagaaggtctttgatgaggcccagcaatctggaaaattatgatataatattacacaatgattatttaacaatattttagaagtaactgccatttgggggtcacagaacaatactaatctcaattatgttacccatcaacaaattgaatataattaaattattttcaaaatatatgggttgagattattttccaattaaaattgccaggtgaggaacagcacttttccattcgctgctgaatgtgatgaaatactggatagtcatagagggtctaccagatgtccctttgggagagtgttgtggggaaatgggctgtttgtgtgcacccaaactagccctttaagaagctgtgtgctggaggccattagaaaataatttgtgctgttcttataaatatgaagaactttggaaatacctctgtgacatcggatgcagtttgtgtttgggaagtatcactgataagaaataatactaaaaattaacaaccccattgaaaagtgggcaaaggacatgaacagacacttttcaaaagaaaaaattcatgcagccaacaaatatatgacaaacagctcaacatcactgatcattaaagaaatgcaaatcaaaaccacaatgagataccatctcactccagtcagaaccaccattactaaaaagttaagaaacagggtccggcacggtggctcatgcctgtaatcctagcactttgggaggccaaggcaggtggatcacctgaggtcaggagttcgagaccagccctgccaacatggcgaaaccccatctctagtaaaaatacaaaaattagctgggcatggtggtgggcacctataatcccagctacttgagaggctaaagcaggagaattgcctgaacccagggggcagaggttgcagtgagccaagatcatgccacttcactccaatctggatgaaagagtgaaactctgtctcagaaaaaaaaaaaaaatgttaagaaacaacagatgctggcgaggttgtggataaataagaacacttttacactgttggtgggaatataaattagtatatacccaaaggaatataaatcattctattacaaagacacatgcatgtgttgttcattgttcacaatagcaaagacatggaatcaacccaaatgcccatcaatggtagactggataaagaaaatatggtacatatacaccatggaatactatacagccataaaaaggaatgagatcatgttctttacagggacatagatgaagctggaagtcattatcctcagcaaactaccgcaggaacagaaagccaaacaccgcatgttctcacataaaaatgggagctgaagagtaagaacacatagacacagggagggtaacaacacatactgccgtctgttgggggttgggtgcggggagggagagcattaggaaaaatggctaatgcatgctgggcatgatacctaggtgatggcttgataggtgcagcaaaccaccatggcacacatttacctatggaaagaacctgcacatcctgcagaacttaagataaaaattaaaaaattaaaaaaattaagatatcccccagaacttaagacaaaaattaaaattacaaaaagaaatagtacttatgttaatgtaagaaaacacatcgcagcttaaaaataaattaaaaaaagaaagacatgttacatttcacattggtaaggagttcaatataggtaaaggagataatttgacaaaaagatgatgtataagcaggcatttgcctcctctctcacaaaagaggaaagaagtgacaaaaaagaaaaaaagagaaaaggaaaattggtaaaacctctgttaaccttgagactgtaagaagaatccacatactacagattttaaacaatttctgatatcatttctataaggtcagatttttttctttatttattttgatacacactgactagctgttgcatgcgtgtagaataaattcattctcataccacagatttttgaggactttctgttgtactctgtatagattaagtcatatcacttacttcaataaatatttattgagtatttattatgggcaagcagaaatccagcatgctcagaaagtggctattgttagaggaaataaatggagatacctttgcaaaactctgttaatatcctgttacagtaaaaagaaggctgctgtgaggttggaggccagaaagcagaggcacctcttcatctggtgcttgttttcctggcacagatgacttattttgggattgctttgtctggcaggaagcttaagaaaagacaaaccaaaacaaaatgttgccacagggactttgagacttcaatatggtaggttcaccacgatttgaggaacatttttgagagttagagaattggagaagcttcaaaatcccagtgtgactgagaaatcctcaatcttttcaggcagcacctctagaaaaaaaacacaagtacacacacagacgcacgcacacatgcaaacacacacactctcacacacacatacatgcacatgcacaaacacacacacatgcatgcacacaaacccacacatggtagcatttacatttacatttatactagttatttatgagtgggttctttttatccatatgctatacagatacgtgttatctatatatttttctgaatgatttcacacacacacacacacaggattctttattttctaaaaccaatatcagagtatgcgtaattttctgcattctactttctctcactaaactacattgtgcaaatccttctagttcaactaatataattatgatttatttgactgtacatgaccacatgatatttctgggtaccataatgtattcctcttgatgagtaattctcttttcatttgtttatttcctcattgcactattcctatcatggctgcaaaaaaacaccctgcacgtgtataattgaatgcttgtagtttttttattttaaggagagaggtttcatgggtgggatttgtaggtcaaatattgcaatgattttttaaggctgctgtaacagggaaccacagaaaacagacatttaccttcttatagctctggaggctggaagcgtaaactcagcatgtcaccagggccatgcttcctctgagacactggttggagccttccttgcctccttctaccttgtcatggtggccaccaaatgttggcattccttggattgcagttgcaacacttcaatctcagcctccgtcatcacatggcattctcccatgtctgcctctgaccctgctcccttagtaggactccagtcacattggattagaggcccacactacttaagtatgacccatcttaattacatctgcaaacaacagatgtccaattcacaggtacttggtattaggatgtcaacatatcattttgggagacacaattaaacccacaacaaatacatatgttaatttaaaaaatttaatacatgtggccagattttcttctaagtgactatagcgtttacatttacactagttatttatgagtgggcactttttatctataggctatgcagatatgtgatatctatatacttttctaaacaatgtgatgtagaatattagttacagtaattttcatttatttaattagttgtgagttttctttttttgtatatttggatttgctcttttatgaactaatgctaatgcttatatccttattgtcttgtttaggtcaatttataagtatttttataatatatgtcataacccccttcgtcatctttgttttgtaaatcatttttccaaaaatatttctccactggctttgtgtacggtaccttttgcaatatattcataactttttaaaaaaattatatcaattttctattagttttgtatttatcccatatgttttaatctctgttccttctttcctgctgtcttttgggttaatcaaatattttttgttttctttttattttgttgactctttaatctatggtttctttgcatttttaaaaaaaattattttactttaagttcttaaatacatgtgttgaacgtgcagatttgttacataagtattcatgtgtcatggtggtttgctgcacctatcaacccgtcacctaggttttaagccaacccgtcacctaggttttaagccttgcatgaattaggtatttggtcatttacatcagataagtgaggatatgcttaaaatacaaaaaaaaaaaaaaattacaagtccgtatgaaaaaggcaacccactttttaaaaaagggcaaataggccgggcatggtggctcatgcccgtaatcccagcactttggaaggccgaggtgggggatcactagaggtcaggagttcgagaccagcctggccaacatggtgaaacaccgtctctactaaaactacacacacacacacacacacacacacacacacacacacacagctgggagtggtggtgcatgcctgtagccttcacctactcaggaggctgaggcaggagaattgcttgaagccaggaggtggagattgtagtgagctgacattatgccactgcactccagcctgggcgacagagtaagaactcataaaaaaaaaaaaggcaaatagtgtaaacaggtatagtaaaaatattttaaaaagaagaagaagaaaatatttcaaattaattaaaattaaaaccaaaacaagatacgttctttcctctgaaatgagtgttgattaaaataatgaactgctgttaagggtttaaggaatcattctcatatactactggtgatagctgtaaaaccaattttattaaacactacttttaggatgcaatttcaaaatatttttatatttataaattttatctagaaattccactttaaagagtttaattaaaggaactaaccaaggatattactgcactttttactgcaataattaaatattaaacaaaagaaatcacaaaaacatcaaaataaaggagaatggctaaataaactatatcacaatcatgaatgaaatactagtcaatatttataatgttgtatagaaatatagttgtcatcatatcttgatgcctgagatctagtgctaaataaaaattagattataaattagtatctataacatttataacacaatatacatgtacatagaaaaggatattcaatgatataaatatattttcccttctccaaattgatctataactccagtgcaatcccagtaaaaatcccaacagatgtttttttttccccatgcgctttgacaatgtgattctaaaatttagacggaaaagcaaaaaatacaaaattaccttaggaaagaattgccccactatacattgaggctagttctaaagctctattaagagagtgtgctttcaagaaaggggtaaaaaggccgggagcagttgctcatgcctctaatccctgcgctttgggaggccgaggtggatggatcacctgaggtcaggagtttgagaccagcctggccaacatgatgaaaccctgtccctactaaaaatagaaaaaattagctgggcgtggtggcacgttcctgtaatcccagctactcaggaggttggggcaggataatcacttgaacccgggaggcggaggttgcagtgagctgagatcgtgccactgcactctagcctgggtgacaagaacaaaactctgtctcaaaaaaataaataaataaataaataaataaataaaaagaaagggataaaaaaattaggttgttgaaataatattgtacacacacaaagagagagaacagcaggagtgggagagggggaaatattagatatatgtcaaaaataacattatagattaatacagaagaaattactcaatatatggtgtgaaaaataattttctatgtagggaaaaatgtgttctctacttcatactgtaaaatatatgtatgcattctgagtaggcagtattttaaaaatgtattacaaaaatagtaactataaaggcaatattgataactttcactccatacagtttaaaatcttctgttcatcaaaacgcatcacatagaaaaagagagacaaaactagagaagatatttttatcatgtaatattagcaaataactagaaaatataggacataacagaaattagtatgaaataaataaacgagctagtggaaaaatcacaaacacttaagtagatatttctaggaaaaaggtgaaagtgacctgaagtatagatgtgtaatctcttaataatacgcaaaatgcaaataaggtgacagtgagatactgttttaccccagctagaatggcccaaaccagagtttaacaagtattggtaaagatatggattaacgggaacatttgtaaaatgtttttaatagcagaaaactgcaaacaaactaaacacatcatcatgggatgggaaataaattgtgaaacattcaaaaatagaattctgtatagatatcaatattgaaataaagctgcaggcatcgacatgcatgacactggagccatagtgttgggtgaagaagcaagccacaaataacactaaaaattcatatcatctctcctactaaggcaatcataacaaaatgccatagactaggtggtttaaatgacagaaatgtattttcttaccattctggaggctaaatccaagatttactgaactgagtacaggctacctcagttcctggtgagggctctctgcatggttggcagatagccaccttcttactgtgtcctcacatggcagaaaaagagagagagatagagagagagagatattgagggagagagatccttatcttcttataaagccagagtcctatcaaattaaggtcgcaaccttaagatcttatttaattttaattacatcctaaagaccctatgtccagatacaatcacatttcgggttaggactgaagcatgaaattttggggacacagttctttccacagcatcatcttcatgaaatttaaatacaaacaaaagcaaactaatatattatatagacgctcatacatatttaatgaaactacaaagaaagtagtgcaacaagcaaaataaaattccaaattcctccatgatgcagggaatggcaccaggaagaggaatacatcttgactcaatggtattaaagaaattctatttcttaatggggccattggtgattatttggctattataatctatagtttattatttattgtaaaaatcaggaaaaatctttgtagactattcccacttggggtaaataaattatgtatttctaaaaaaatgcatttctaattctgtgcatggagagtgtttattatgatgcatattcaattgataaacttagttttctcctgttggtaaaattagaagtaatttttgttctttctagtgacttattttttatatttttcctaaaatatatttcatatgttaaacaaatagataaaccaagtacaggtgaaaatgagcacacatctaaagaccaagcctcaagcatattgagactgggtagcattaatagagagtgcccagggctcgggggataggggaccgtggtttacttagccaagtgtctttcctaactattaaaatttaaaaattgtattgctaaagaactcagttgttatatgggaaacttagggatttttggctgcaggtatttcttcactttgaggcatgactccctcttcagtacctgtcagattaaaagaactagcttccttggttgggttttatttactgtcattattaatgatccaaaggatggagtaaacataaagccagttaagccgggagggcttgctaacacctgggaaaacaaaagaacacaaaaatttcagtactgttgctttatttctaagtaacagctcaatctagaatcagtcatttaaattatgttactctcaactttctctttttaggacataaaacattttttttaaccaatattattttgcttttaaaagattatagaacaaaaaggtctcttgatttatagctttcctctaaggaaagggtctcaaagtatcttgtaaatacatgtagagggtgatgttgtattgcttagtaggagaaattttttcaacctcaattaaatgcattttttttctactgacattgcctgaaggctgcttctaactcaacagcttgtgaggaaacctcagagacacagacatcagccagaacagaaaaagacctctgggtttacaagagaaataattttgtccccatgaagaattaaggtcttctgcagaactttccagaaatgagcagtcttagatggcaatgctgatttgcatggaaacagggaatcctgaatatacaatacatgagaagagaactactgggtgtttagatggtgtgacacatggtatgcaggtatgcatgtttatagcaaatggctgtgtgactcatagccaaggtacaacttgtcaggaccaggaacatcatatggaagagagcagataaaacaatgaagaaatttgctactgcagactagattctgagcacaagaaaacagtagcttgacctgtggaaatgaccatgatcttgaaaatatctctttggcattaggagtaaagaacaaggattaaaacaaacatacatgaacccatatggctacacagggaagccagttttcaagagtgtgtgtaccccaaaacaatcacaagaaatcaaaaattttttaaaaagcaaaaattgacaagtaggatctaattaaactctgcacagcaaaagaaactatcaacagtgtaaacagacaatctacagaatgggagaaaatattttcaaactatgtatctggcaaatgtctaatatccagggtgtgtaaagaacttaaatgcatttacaagagaaaaacaagcaactcgattaaaaagtgggcaaaggacatgaacagacatgattcaaaagaagacatacatgaagccaacaagcatatgtaaaaaagctcaatatcattgtttattagagaaatgcaaatcaaaaccacaatgagataccatctcacaccagtcagaatggctactattaaaaagtcaagaaacaacagatgctggcaaggttgtggagaaaaggaacaattatacactgttagtgggaatataaattagttcaatcattgtggaaagcagtacggcaaatccttaaagagctaaaagcagaactaccgtttgacccagccatcccattactgggtataatacccagagaaatagaaatcgttctgccagaaagacacatgcaagcaaatgctcattgcagaactatttacaatagcaaaggcatggaatcaacctaaatgcccattaatgatagactggataaagaaaatgtggtacatatacaccatggaatactatgcagccataaaaaagaacaagatcatgtcttttgcaaaaacatggatggagctggaggctattatccttagcaaactaatgcaggaacagaaaactaaatacctcgtgttctcacttataagtggaagctaaatgttgagaacttaagaacacaaagaaggaaaaaatagacactggggtctacttgatgggggaaggtgggaggaggcagaggagcagaaaagataaccattgagtactgggcttaataacctgggtaataaaataatctgtacaacaaacctccatgacacttgtttacctatgtaacaagccttcacatgtaccctcaaacttaaataaaataaaatagacctatatttaaaaatatttttattgtctaatttaaaatgtactttaaggctgttatttttttctatcatccatatgtatcagttactacaataaagtaattgagatttagaaaaaaagaatgcatgtacatgagatagaataaggatgcataccctatgatgaatacaaaagagggaaaaacctgtaaaaattgaatcaggaaggccaatacccccaaataaaccaaaactcaaaaaatgtgaaaatggaaggagcgggatccccaagtcacctttggcggaaaggctccaatagagtcacctgactataaatatttgccttggaatttgcatgagaattaagtattctttacgtttggccactgagctttgcagcttgttgtaatagccattagcctaccctgtactaagactagattgaaatcccaaataataaaaatgccttcctttaaaaaaaatttaatgtattataaaacttgcaaatatatttgcaggataacctttaacaatcttttaagaaattaagggcaatgtaaaaagtaccagaaatatagaaattgactagtgcaaagttttataagacaaaaaaggacaaattggtaagctttatgtcaatttcaggcaaacaatgtacaatgaattattgaagagataatttgtgggtacattaaagaaaactcctcattatcaggagtcagctttgattccttaagataaagacatattgtcgtctcctgttttcctctctgaaaattgtttgtaggcagtagttcagggattggaatatagaacttcttgtagatggcataagcaagtgcataaaatggaagtattcaaaggaatgtcttctagtatgtatcattaatgcttaacaattcaacttcacatgtaacacatttcttaaaactattgggcttttaagaaaacatgcaataaaaatgattcaaatatgcatagcatttgtgcaatgatttatagtttacaaagccccatatgtacattttctctcctgatttttgtaataaagactgggtaagaaaattgacattcagagaaaaaaggataacttattgggaccacacagtaagctgcagctgggataaacctaagccttctgattctaaacagttttctggccactactttattgtgccacttgtctgaagtcaatagtacacatgtgctatttgctgtctcatagttatttcaattctaggtaatgacccccccccccccacacacacacacacattgggccagattactattgcacaatatcagaagaaaatactttctaatgggatgctctactaatggatcccatttaacacaggagctagaagggcttgttctattccatctggaacttgtggacttcaggcatttattgaaggatgcaaaagtgcccttgttgtgtgattgggtttcttccaggagctaaatgcttaccgtagcgtgcataatgagaatgagccattgccagaggttctcccatcagaaagaattctgatcttagagtcccttatcagctctaatctggctctacaactggctatcatagagaaggaagtgtgtcttatggaaatgtttgttaaataatgtgggaaggaatgcctttttgaattcagggaattatggcatcaagcctctaccactgatatcagcatattctgattttaaaatagaatatttaaaaatcataaaagcagtttgttccagtttgatgtttaaaaaacaattagtaggattgtgagttaaggtgagagtagtaggaagtaagatcagagaaggaaggagagaaacaaatcacgtagggctgtataggtttttatggtgagagtgatgagaagccatggaagtgttctaaacagaggaataaggtgatgtgatatacttttaataagatttcattggctgctctactgacaacaaactgcagaggaaaatgcgggagcagagagattagttaggagactattgattacaactatccaggttaagaaatgatgatagtttgaaccactctgttggtcatggaggtggggaaaagcgactggatttagcatgtattttgaaaaatagagctgccatggtttgccaaacagttggatctggggatgagagaatcatcaacaatgactacaaaatgtttgtccagagtgaatagaaacaaagagttaccagacacagtgtttgagacatttattagacatctaagggatgatatcagtaagcagtgggattttcgttctgtagtttaggttacaggtctaggctggaattttagttttaaggatcactattacctggaaggtacttaaaacagtgagtctagagaggatatgtagacacaaactacacatggaaaatagaagaggccaaaggactgatccttggaatatgttcaagtttaaagttagggagatgaagaaacaacatcaaaggagcctgacaagggatgattagaatagtaaccaagtaacaaatttaagagtgactcttccaaactgggaaatttcaaaacaaaataagcctgaagaattgttaaaagaatctagtcagtcaaaactgaataaagagtattttcagaaacgcttgatagctcatctataatggaaaaacaaacccccatgtccaactgttctcacagtgggtcacacaaaaagtgtaacgggagtggagaagaaccagaaatgagaagaagacaagtcctaaaggtaggtaagtgtacaattaggtaattgtgtcctgtttcataggaaacaagaaaccatgcatgggacaagaatctaatgaaggataggtacgtacaatacaattgtttcctacaaaaataatttttaataaaatctctctgtagatcttattcaagttatgaacctttcatcttcaaacagtaaagatatacacacattcacaagctgttttatttacaaatctatgacatctgcaaaacttttaaacaaaggactccacattaataacacctagattatgattgtctcatcagctccactgcttcaagagaggaactacatcagagaattaagggagctccttgcattgggttctaagcagttcagtcccagctgtctggttgtagcatgagattcttactggtagagcttagtatccatctgctaataaagagacaaacaagaatcgtccccggatgcctgtgccaactgaacatttcaccaaaaacaattaaatcaaatttttcttgcgaattgttaaagtagcttgaggcagtgtcacttacatggcctcaaataatgtctccagtgttgcagaaacaactattttctctctgcactagatgaagaagggctgggtttattttttccccttctcttccctgagcaaatccccataacaaataaagttacacttcaagaccggattactcagactattggctttgcatgccaatgtttaagtaaaaatgatacttctgagaattcaaataatgtttaagtatttccaggctacagttctacttgcatttgtcttggcaccagctcaccatgaatgtgtcaggttttcaaaaagatgactgtttagtcatagttggatgtcttcatccaatgtctcacatgtgctgaatatgtttctattgccttcttgcctactgtcatttggtaaagagttcactgcgccattagctatacagttttttgataggagcctgcaatctcttctagaaatggtcttattttgtttaagagagaaaaatttaaaaagagaatgaatgagagagacaaaaagagaaagcttaaaaattcaataaaatacaaaagatgttacaaaatttatgataatgtaaataatcgatcatttatcaactaactctcccaaaagcttcagccctggccttgttttcatttcaagtgtgttcattttacaagtgtcagaaaataacattttgtaaatgacacagtaaattacattatcttaaagattacacccttaatttttttaaactctcaaaaaccattccttcttttctcccctccaccccagttctatgtcttctaaggtacattatcagatgaacagaaaagttcacatttcttgtagatacctgtttgtactttttgatgattacctacctgaataaatatattatagtccatacatctatcatctaagaaaatataagaggagacactggtaacacataaactatcttaacattatttgaagctcaaaaatttcttttttcataaaagaaactatttcaggccttgtggtcaaaacagtgtgggagatattttagggtactcaagggtgtctttaaatttcatcattcatttcatgatttgggagataatagtgctaagattctctgtggtggcgggtatggattcaacggtgcatgattgctgtctcttacttgacaagatttccagctataaaatatgtgagtaaatgatgttggatattatacaatggatattaaaaaattggaagggaactctgatttgagatgtgattatttttcagcctttaaaaatatataactaacattttttttcctttgttttttcctcccaggttcaagtgattctcctgcctcagcctcctgaatagctgggactaaaggcatgcaccaccatgtccagctagtttttgtacttcttttagtagagtcggggtttcaccatattggccaggctggtctcaaactcctgacctcatgatccaccctcctcagcatcccaaagtgctgggattacagatgtgagtcaccgtgcccggcctactgacatatttttaataaatatttcttaataatcatatataatgctctaaaatatttcactaggggttaggaagttatttttatgtgaataaaattcctcctggataaatatatgtcttcttattttgccctccgttgatactggggacaactatctactgtggttttgaaatacaggtttatgagttttagggatatattattttgtttttatatgcacaggggatgccaagatatttaaaattcctggaagaaagcaatattatagatagagaaagcagatcagtgactgcctaggtgtattagtatgttttcatgctgctgataaaggcatacctgagactgggcaatttactaaagaaagaggtttattggactcacagttccacatggctggggaagccttataatcatggtggaagacaggtaggagcaagttacatcttatatggatgtcagcactcaaagagagcatttgtgtagggaaacttcctttttaaaaaccatcagatctcatgagactcattcattatcacgagaacagagcaggaaagacccacccccgtaattcaatcacctaccactaggctcctcctatgacacatgggaattgtgggagttataattcaagatgagatttgggtggggacacagccaaaccatatcaccagggccatgggtaggagcagaaaatgactgcaaagtgtcatgtgaaacttgataaggttatagaagtgctctcagactgcattgtgctgatgcttaaacagctgtataaacttagtaaacaatcattactctatatagttacagtgggtggattttacggtatatattccttaatcaagcggtacatgtatatatatagatatatacttacatatatgtatttatgtgttttatatataaaagctgtgtatgtatgtgtgtatatatatataaaaaaatatacatacatgtgttaagcataaactctatgattgagctgtcatataattaccacactattggcgtactatatggtgtacactgcaatctgcttcatggtgaacctgcttatccttctgagcacttttattaatctatagggagtgcatgttttgggaaatacatacagttctgtgataggttaggtatagcttaccttaaagtattgtaaaaccttagatgaattctatacatttcaaaaaataatgtggctttttttcagtagaatttagctaccttcacataaccctacaagttaacaaaatatatagctttttgatggtgtataagtgcatttcttgggacaatatattaaactgtccataatggatttatgtattgggaaaagtttaaaattgttttaaggctacttgtttatggccaaagaacaattcatctttttcttttgttaaatttaaaacgagaactttttcaacaaaggtttatggctctctgtcttctaggcacatgccaggatggcacaccctggcttctacattcttggatagggtcaggtgactaagaacagagtcatgcctgtcacctgtctgctggaggatttaatctcttgtaagacttgataaaactttcttttccagaggctagatatataggaggttgtggctgctccagcagcttggattcagagtgagaaggcataaaggagaatccccagctgacttgtgcagtggttaattgaaattattcaggcaagagatgatggtgtcttggaccaggggatgaggaaggctacaaaatgtgtctacctgtattctgtgaggagaacgtgttccctggttttagatactgtgaagatggatcaggagagagtttatctagactgttggggaaaggtgttgcgattccttcagctacacaggattgaaaggagacatttctgaaggggaaaaaggaaatgaaagaaaagatgtttcagattgaggatatgctgtgtggtgaacttgttcttcactctgtagggttcacaaatgactcttcactgccctcttggatgaaataaactggttcccatagaaatggaccgtctctgatttcacagtctagagcacacaaataactcaactttctggaagcaagggtgatggctcgtgagagctcaaggacaaggaggagtctgtagaagcacacctggactcggggaaatcattgacctctcatcctgaattaagtagcgcttgaaaagactctctttgaatcagaaaaataatgcgagctcctatcaaactaccttacacagccaactgagtgatcataggcttgggtggaaaaaatgtaattcgtagaaccttttaagagctaagattccttaatcaacatggataccgtcttgttgaatgacaccgaactgtgctgcgcaggattcggttgcatggtggctggagctgcctctctgggacccaaatctcagacctgctgcaaagtgactatatgatctgcaacttgctaacccttctaggcttttgttttattatttacataatgaagtgaggggaatatgttccttgtaaatttgttaagaggattaaattagttcatgtcaaatgatttagaacactgtctgccacatattaaggactcaacaaatactacctattattaacaatgtgccctaaatctgtaaatcactcaataatacatggcattaggctaaatatggaaggtagaaggaaataaattgtccagaagctaaaaatatgaaagactcttcatatatttaaaatattttctttaattcttttgtttttttcttttttgagacagagtctcgctccgtcacccaggctggagtgcagtggcatgttctcggctcgctgcagcctctgcttcctggattcaagtgattctccttcctcagcctcccaagtagctggaattacaggcatgtgccaacatgccgagctaatttttttattttttgtagagatggggtttcaccatgttgcccaggctggtttcaaactcctgacctcaagtgagccacccaccttggccttccaaagtgctgagattacaggcttgagtcactgtgcccagcctgaaatatcttcttcacatcttttcatatgcatatttgtttttacaagtacataaatatacatttttgatataacttggaatcttgcattttctaactcaatgtctaactaagccgcagaacaggatgttgaatccagcacattgcaatacttgcctatcaacagaggacatgcataaggtcactggagctaaccgtcttcccaagaaggacatctttctgagggtatcaaggaagtgtgctcatcaggatttcatgcttcctgtcactcttcacatctttgttatcctgtactgctgaagcagatttttttaaagtacatggggagtagatttacacaacctttattcccagattgcaggagagtgagaagcaaaaaatagtgcccagaattggtggaattagaaccaaaaggtgtctcctgtgacataagcctttggagagacacaataatcatgtcatcttctgctctgtcattcacacaatgtatagaacaatgatttgaccaagtaagaagagacaaagagccaagagtttgtttggaggccggagtgagcttgacagaactagatgaaattggccactgggcactgggacccagaaaggcctcattgccacagagttgcaacagagtgtggggtcccattatcagaatcctttctatggtgcatccaattggctatgactctcctaagaacagcgctgcaggaaaatgcaagttcacaggataatgaatgcactgttgcttctctgctgctgacttttcccacgaataaaacttgtatttatttgtactgctggttcgggctgccataaaaagcaccacagacgatatggcttacaccacagaaactcatgttctcccaatcctggaagctgaaagtccaagatcaaagtgttgtctgggttggtttcttccaagacctctactgttggcttacagatgattgtattcagttcacatgatgttcttctatgagtgcctgtgtcgattttctgttcttataaagatatcagtcagattaaatgatggttcacccaaatgacttcatttcaccttaattacttctctaaaggctctatctccaaatacggtcacattgtgagtttctcagggttaggacttcaacatgtacatttgaggagtggaacacaattcaacccataccgtgtaccatggtagtcccaatgtccccattttccaacagcaaagtgtttatggaatatcatgttctacctgtgacctttctattctctcttatacaatattatgtcactttcatatcatagttaattttacatgtatttgttcctcatctccaaaacgggtctgcaaactcctggagagaaaaatctgcatttgaaactagcaggtgcacagcaactattaactaatataaaatgacatctgaaagaaacaaagcccacaatttttttcccatgcctgtcaatagagacttcagaaacatatagttattttgaagaaaataactttatattctttaaaaactagatagtaatttgaaatcatactttcaatgctacaacagacatttaaatagaggaaatatccacctcccattctccaatcaccacctccctcatttcccagcatgtttagagttctagccttcaccaaagactggtatacaagaaagcaaattgaaaatccatcattttctggtacggtaaggctcatttattcattcaataaggatttattgctttgctgtgatgtgccaggtatagggcttggtgctggtaataccttagtgaacaagacatagatatgcaatagaatagtaactgagttcagattttttacgtctcaaccacttcagtgcagattagcatatgaatgaactatacaacttattttccgtcacaattttggtctagtctttgatattcttcttctatcctatgaaatagcttttctttcataagcagaagaagagcagaatgaaatagagagctgtgctactcctcggccaatttctttataaaattacatttggaaatttctatttaattggtccctccaaaggctgtgagctgaaaaatttatgggctctgatatggtgacagacgaaaagtggtccaagtaatttttgaaaggtgcctaccaaaataaatgagtttttaccagtgatatctctataaggactcttggtacatgaggattcgggaatttggggatttatactctattatacttaggacatctcattatagaagtgtgtcatatgacacactctgggccaactacattttttcatgacattttctaactggaaatagaaattcgatcctcccagtgatccctacggaatgggatgcttgggagctgtctggtcatgtggagggaagtcctgaactcagcagtgatagagaatgaggtccacacagactctggattatactttgtgtacaaagccgcacacttgcacttcttgtcactacctccacagctgattccctggtccagtcttcacctctcacctgcctgctaaatgatcttgcttctccctttgcccccagattgtctcttctcaataaatcacctggaatgatctatttttaaagtctaagagaggtattgttactgtgcagctcaaagctgtccagtgctccccatttcatgcatagtaaaagctgaagtctttcccagggactacaaggatgtcccctatctgtcctcattacctctgtggctgccttttataatgatgtcccctatctgtcctcattacctctgtggctgccttttctaatgatctccctctgcacctcggcacttcagaatagtgcccttgctctttagaaatactccctgtgaattattccccagcagagagtgttctcccagatatgaatgtggctctcccttgcctaccttaagttttcactaaaatgtagcctttccagccatttctgacctgactactctatttaaaaatcaataaatttggcacatgtctcccttctttaccttatttttatctatatcacatttcattatattcttatgtacattttcaataaacttctatatttcttggtctgtctctaccctctagaatataacttcccacccccagtgcctaggccagtaccaggcaggaagctggtagcattaaataaatagttaggctagtaactttgaattaaactcatggagagatcaggtcaggcaaacctctgcattgtgttagggtaacatttggagaactaccaattaagctttgtggaagtgctcagctgaggatataccttgccactcatttgctggaattctggtataaattggtgggaggtcaaagagacatgtgtctcaaacagtctttaacttcaaaactgagtggaatgagtcctggatgaggtattttggatggaaaaccagacacaaactacatgcaatatattctttactaaattaactaaccttaaaaatatgttttataaatttctgaactagaaattcaatttgataccatcttccaccggcccacatttgttgttttaaataaatttggagtcctttgggcacattaaaagatggagaatgtcaggtctgcttggatatgttcaaggcatggccctgtttgccatagacatggggtttatgcaaacatggctattcctctaaggcttgcagtccactcagttttggaatcacagttgcagagatttcttaatttatttgtctgtgtcgatgcctcgcttagtgctttgagtgttggaaacttcctcaacaatttctgcagttctaccaatctttgctgtgggttgcacaaaacaaag

SEQ ID NO: 110 - DNA, 26917 bp, Homo sapiens; identical to SEQ ID NO: 109

SEQ ID NO: 111 - DNA, 1676 bp, Homo sapiens
ccggccttttggtagtcttctccatttgcctcttcagtggctgaatttaatcaccaagggatgaggaaggctacaaaatgtgtctacctgtattctgtgaggagaacgtgttccctggttttagatactgtgaagatggatcaggagagagtttatctagactgttggggaaaggtgttgcgattccttcagctacacaggattgaaaggagacatttctgaaggggaaaaaggaaatgaaagaaaagatgtttcagattgaggatatgctgtgtggtgaacttgttcttcactctgtagggttcacaaatgactcttcactgccctcttggatgaaataaactggttcccatagaaatggaccgtctctgatttcacagtctagagcacacaaataactcaactttctggaagcaagggtgatggctcgtgagagctcaaggacaaggaggagtctgtagaagcacacctggactcggggaaatcattgacctctcatcctgaattaagtagcgcttgaaaagactctctttgaatcagaaaaataatgcgagctcctatcaaactaccttacacagccaactgagtgatcataggcttgggtggaaaaaatgtaattcgtagaaccttttaagagctaagattccttaatcaacatggataccgtcttgttgaatgacaccgaactgtgctgcgcaggattcggttgcatggtggctggagctgcctctctgggacccaaatctcagacctgctgcaaagtgactatatgatctgcaacttgctaacccttctaggcttttgttttattatttacataatgaagtgaggggaatatgttccttgtaaatttgttaagaggattaaattagttcatgtcaaatgatttagaacactgtctgccacatattaaggactcaacaaatactacctattattaacaatgtgccctaaatctgtaaatcactcaataatacatggcattaggctaaatatggaaggtagaaggaaataaattgtccagaagctaaaaatatgaaagactcttcatatatttaaaatattttctttaattcttttgtttttttcttttttgagacagagtctcgctccgtcacccaggctggagtgcagtggcatgttctcggctcgctgcagcctctgcttcctggattcaagtgattctccttcctcagcctcccaagtagctggaattacaggcatgtgccaacatgccgagctaatttttttattttttgtagagatggggtttcaccatgttgcccaggctggtttcaaactcctgacctcaagtgagccacccaccttggccttccaaagtgctgagattacaggcttgagtcactgtgcccagcctgaaatatcttcttcacatcttttcatatgcatatttgtttttacaagtacataaatatacatttttgatataacttggaatcttgcattttctaactcaatgtaagtatttttcttctcttttacctatataaatataaatatatatatatatacttagatgatatatttacatacttattttacttaataagtatttttctattatcaatagttaaaattccactatggtttatgccatttattaaatgtcactttcccttctcaaaaaagtctcatactgtttaaaaacattaaat

SEQ ID NO: 112 - DNA, 1676 bp, Homo sapiens; identical to SEQ ID NO: 111

SEQ ID NO: 113 - DNA, 8975 bp, Homo sapiens
ggtttcttgccttttcttaaaggggataggaaatgctattgagttttctatattaattttatggccttctgtttattgaatcacaatactgtctgaaattactttttagttattcctcttatattttccaggtatagtatatttctgaagatagtcatagtgtttatttatcctgctcaatatttgtaactctttttcttatcaaatacttttaactgaaaatgccaatggggtctcttcttttgttactttctgtaggtgtacatgatgccggccttttggtagtcttctccatttgcctcttcagtggctgaatttaatcaccaagaaacaagaaaccatgcatgggacaagaatctaatgaaggataggtacgtacaatacaattgtttcctacaaaaataatttttaataaaatctctctgtagatcttattcaagttatgaacctttcatcttcaaacagtaaagatatacacacattcacaagctgttttatttacaaatctatgacatctgcaaaacttttaaacaaaggactccacattaataacacctagattatgattgtctcatcagctccactgcttcaagagaggaactacatcagagaattaagggagctccttgcattgggttctaagcagttcagtcccagctgtctggttgtagcatgagattcttactggtagagcttagtatccatctgctaataaagagacaaacaagaatcgtccccggatgcctgtgccaactgaacatttcaccaaaaacaattaaatcaaatttttcttgcgaattgttaaagtagcttgaggcagtgtcacttacatggcctcaaataatgtctccagtgttgcagaaacaactattttctctctgcactagatgaagaagggctgggtttattttttccccttctcttccctgagcaaatccccataacaaataaagttacacttcaagaccggattactcagactattggctttgcatgccaatgtttaagtaaaaatgatacttctgagaattcaaataatgtttaagtatttccaggctacagttctacttgcatttgtcttggcaccagctcaccatgaatgtgtcaggttttcaaaaagatgactgtttagtcatagttggatgtcttcatccaatgtctcacatgtgctgaatatgtttctattgccttcttgcctactgtcatttggtaaagagttcactgcgccattagctatacagttttttgataggagcctgcaatctcttctagaaatggtcttattttgtttaagagagaaaaatttaaaaagagaatgaatgagagagacaaaaagagaaagcttaaaaattcaataaaatacaaaagatgttacaaaatttatgataatgtaaataatcgatcatttatcaactaactctcccaaaagcttcagccctggccttgttttcatttcaagtgtgttcattttacaagtgtcagaaaataacattttgtaaatgacacagtaaattacattatcttaaagattacacccttaatttttttaaactctcaaaaaccattccttcttttctcccctccaccccagttctatgtcttctaaggtacattatcagatgaacagaaaagttcacatttcttgtagatacctgtttgtactttttgatgattacctacctgaataaatatattatagtccatacatctatcatctaagaaaatataagaggagacactggtaacacataaactatcttaacattatttgaagctcaaaaatttcttttttcataaaagaaactatttcaggccttgtggtcaaaacagtgtgggagatattttagggtactcaagggtgtctttaaatttcatcattcatttcatgatttgggagataatagtgctaagattctctgtggtggcgggtatggattcaacggtgcatgattgctgtctcttacttgacaagatttccagctataaaatatgtgagtaaatgatgttggatattatacaatggatattaaaaaattggaagggaactctgatttgagatgtgattatttttcagcctttaaaaatatataactaacattttttttcctttgttttttcctcccaggttcaagtgattctcctgcctcagcctcctgaatagctgggactaaaggcatgcaccaccatgtccagctagtttttgtacttcttttagtagagtcggggtttcaccatattggccaggctggtctcaaactcctgacctcatgatccaccctcctcagcatcccaaagtgctgggattacagatgtgagtcaccgtgcccggcctactgacatatttttaataaatatttcttaataatcatatataatgctctaaaatatttcactaggggttaggaagttatttttatgtgaataaaattcctcctggataaatatatgtcttcttattttgccctccgttgatactggggacaactatctactgtggttttgaaatacaggtttatgagttttagggatatattattttgtttttatatgcacaggggatgccaagatatttaaaattcctggaagaaagcaatattatagatagagaaagcagatcagtgactgcctaggtgtattagtatgttttcatgctgctgataaaggcatacctgagactgggcaatttactaaagaaagaggtttattggactcacagttccacatggctggggaagccttataatcatggtggaagacaggtaggagcaagttacatcttatatggatgtcagcactcaaagagagcatttgtgtagggaaacttcctttttaaaaaccatcagatctcatgagactcattcattatcacgagaacagagcaggaaagacccacccccgtaattcaatcacctaccactaggctcctcctatgacacatgggaattgtgggagttataattcaagatgagatttgggtggggacacagccaaaccatatcaccagggccatgggtaggagcagaaaatgactgcaaagtgtcatgtgaaacttgataaggttatagaagtgctctcagactgcattgtgctgatgcttaaacagctgtataaacttagtaaacaatcattactctatatagttacagtgggtggattttacggtatatattccttaatcaagcggtacatgtatatatatagatatatacttacatatatgtatttatgtgttttatatataaaagctgtgtatgtatgtgtgtatatatatataaaaaaatatacatacatgtgttaagcataaactctatgattgagctgtcatataattaccacactattggcgtactatatggtgtacactgcaatctgcttcatggtgaacctgcttatccttctgagcacttttattaatctatagggagtgcatgttttgggaaatacatacagttctgtgataggttaggtatagcttaccttaaagtattgtaaaaccttagatgaattctatacatttcaaaaaataatgtggctttttttcagtagaatttagctaccttcacataaccctacaagttaacaaaatatatagctttttgatggtgtataagtgcatttcttgggacaatatattaaactgtccataatggatttatgtattgggaaaagtttaaaattgttttaaggctacttgtttatggccaaagaacaattcatctttttcttttgttaaatttaaaacgagaactttttcaacaaaggtttatggctctctgtcttctaggcacatgccaggatggcacaccctggcttctacattcttggatagggtcaggtgactaagaacagagtcatgcctgtcacctgtctgctggaggatttaatctcttgtaagacttgataaaactttcttttccagaggctagatatataggaggttgtggctgctccagcagcttggattcagagtgagaaggcataaaggagaatccccagctgacttgtgcagtggttaattgaaattattcaggcaagagatgatggtgtcttggaccaggggatgaggaaggctacaaaatgtgtctacctgtattctgtgaggagaacgtgttccctggttttagatactgtgaagatggatcaggagagagtttatctagactgttggggaaaggtgttgcgattccttcagctacacaggattgaaaggagacatttctgaaggggaaaaaggaaatgaaagaaaagatgtttcagattgaggatatgctgtgtggtgaacttgttcttcactctgtagggttcacaaatgactcttcactgccctcttggatgaaataaactggttcccatagaaatggaccgtctctgatttcacagtctagagcacacaaataactcaactttctggaagcaagggtgatggctcgtgagagctcaaggacaaggaggagtctgtagaagcacacctggactcggggaaatcattgacctctcatcctgaattaagtagcgcttgaaaagactctctttgaatcagaaaaataatgcgagctcctatcaaactaccttacacagccaactgagtgatcataggcttgggtggaaaaaatgtaattcgtagaaccttttaagagctaagattccttaatcaacatggataccgtcttgttgaatgacaccgaactgtgctgcgcaggattcggttgcatggtggctggagctgcctctctgggacccaaatctcagacctgctgcaaagtgactatatgatctgcaacttgctaacccttctaggcttttgttttattatttacataatgaagtgaggggaatatgttccttgtaaatttgttaagaggattaaattagttcatgtcaaatgatttagaacactgtctgccacatattaaggactcaacaaatactacctattattaacaatgtgccctaaatctgtaaatcactcaataatacatggcattaggctaaatatggaaggtagaaggaaataaattgtccagaagctaaaaatatgaaagactcttcatatatttaaaatattttctttaattcttttgtttttttcttttttgagacagagtctcgctccgtcacccaggctggagtgcagtggcatgttctcggctcgctgcagcctctgcttcctggattcaagtgattctccttcctcagcctcccaagtagctggaattacaggcatgtgccaacatgccgagctaatttttttattttttgtagagatggggtttcaccatgttgcccaggctggtttcaaactcctgacctcaagtgagccacccaccttggccttccaaagtgctgagattacaggcttgagtcactgtgcccagcctgaaatatcttcttcacatcttttcatatgcatatttgtttttacaagtacataaatatacatttttgatataacttggaatcttgcattttctaactcaatattcataaacaaattcatgtaagttctacaaaccaaacaaaagctcaaacaaaaaaagagaataccactgtcagaattttattccagattggattactatatattcatttgtgaagaaaatatagtaactatattgagtgctgccacccagaaacaacatatgtatattattatttttatttttagatgtagtcttgctctgttgcctaggctggagtgcagtggcagtatctcagttcactgcaacctccacctctcaggttcaagtgattctgctgcttcagcctcccaagtagctaagattacaggcttgtgccaccacacctggctaatttttgtatttttagtagagatggggttttgccatgttggccaggctggtctcaaactcctgacctcaagtgatccacccaccttggccttccaaagtgctgggattacaggcgtgacccaccacacctggcaatatgtatcttaatttcttaaaatctgttttcatgaatccctgtaaatatttcagtagtgttttctatttatttatatctccttatttttatacaaataagaaaaaataataaagataagatggggaggggtttgtttttgtttatcttctgtgatcttttaaaaatttataatttctagctgggtatttttgatgtatggtgctgctgtttttagaaattcatctcatcctcaatttattctctgaactcattagttaatcttaagaacacctgtcagttttttaaaaatatgtttttaataggctttatcttttagagtgttttaggatcacagcaaaatgagtcgaaggtacagagagttcccatagactcctgccccctcccacagacagactaccctagaatattgtaaaaggatctatcagtcattttcctcacctctcttatagatgtctctcttcaacagtgagattttttccgtaactctctgtagcaggactgggcttgtttgcactcaaatccatgactcattgtttctctgcctttccgtgtgttacaggtgggctgatccccctgcagccagtttcccataagcaactgacttccaactgggaatgtctcgggggataatgggggtggggatatggaagtatagagaaaacataagaaaatactgggtgtatacacctttctctctctgagtatgatgacaatgtgatagtcagtgtggcatctgtgactccagcttgtgcctggcatgtacaccctagctccagcttcccctgggagactgtgcatctcctggctccactaacaccaccttcttctgaccttccagcctagagatgatgactctgccagcctagatgggctctgggttgtctccctattcctgtttgctttgtagatttcccattatgctgtcaccaactccccagcctaagccctctctattttaaattctcaagtggattatgttcctgattagtccctgactgatataccactctcctcatgatctctgattagttttcctgttaggttgttgcagtaaaaaaaaaaaaaaaaaaaaaaaaaaaaaaaagttttcagaccaaccaccacctacaaataatttactatgaccacctaaaaagattttcacaggagccctaccatgtgcaatggtgaagaaagttgtgggtaccttggtggaaggggtcacagataagtcttttcattgtaacatcatcttttttctccaagagtgccactgtatggaggtgacacagagagacgtagaaggacagatctcagacaatttcataaaataatttcatattttttacagaactgaaaggatggcacttaaaaataggagtaatcatttattcactggtaaatttccttctgccaatgctctattgattgtctttacaagacaatataagatgcaaagcatcactcattggagcatttccctaatgttgaactgaagacctggtctactaaacttgttatcaaagtttattgagattcgatgcatcactgatatgccatcctagatatgcagagtaagagtggctatgtttctgggtgtacaaatcattctatcgattaaatgccacattacacaccagacgatcagctccataaagcaaaggctgtgtctgtgctgttagctgctgtacaccagcccttcaaggaccgcctaatgtggaggagattctgaaatatttgttgaacaaaaatgaatgaatacaagagttggcttgaagaacctactttgaaaattacctcatgatggatgctggggatgtggaaggagggggggggggggacatttacctgcttcccagtgtggaagctgtctttcttcaccttctcacatttaaaaggagtggctgggccatgcacagtggctcacatctatagtcccagagctttggaagaccaaggcaggaggaacacttgagcctaggagttggaggttgcatgcagtgagctgtgatcccgccaatgcactccagcctgggctacagagcaaaactctatctcaaaaaataggccactttaactctgcactgtgactcctcaccaactccgcacacccacagtaacgtaattatgaattgtgcatttgcaatggaagtttcagaagggattccattttgtaagttaaaaaacaaaacaaattaaatagtaactaaagcacttgaacctcctcccaaaagagtggtttcttatttaatggctggcacaaagcaaagtatttgttgaatggaaaatgatacaaatgctctcagagtaggaaaaaataacccattttttctctctttttcttaagaaacttcagagccagttgaagtattcatgaacagaatgactgattttctatatgtgggtaacacctttcagtaggctaaaactcaaatttgagttttatgaaaatacaactattctttgttgatttatgtgcattaaagcttaggaatatctatagcagttcaattatttacatcttggttctttgggtttttgtttttttgtttaaaagaaagacttagactttgggttttccagcatagaagttccaacctcatttgagctggcaacagacacactggtgccccaatgcacagttttttaatgactttctctgttctgtcttcattgtcccattttccgtcatctccttggtgaccagtagagacttactgttgctttccttaggtctaactaagccgcagaacaggatgttgaatccagcacattgcaatacttgcctatcaacagaggacatgcataaggtcactggagctaaccgtcttcccaagaaggacatctttctgagggtatcaaggaagtgtgctcatcaggatttcatgcttcctgtcactcttcacatctttgttatcctgtactgctgaagcaggtacagtttttcatccaggagctcgtcaacagtttattctttttaatcaaacaatgaaagaagaaaagatatttagacatgaagtccttgcccatgcctatgtcctgaatggtaa

SEQ ID NO: 114 - DNA, 8975 bp, Homo sapiens; identical to SEQ ID NO: 113

SEQ ID NO: 115 - DNA, 32732 bp, Homo sapiens
ctgagccacactatgcccggccttgatagccttttctatcaagcttctggggtttgccttttttcttataaaaaaaaaaacttccagttgagggctccaaaaagtgaattcgaatagtaatatttaaaatttatatctatatgaggaaatataaaggctgttgaaagattctgtattgcaaatatttctgctatattgttggtgcttgaaattataccataaaatatacctcttttgactaaaaggacttgttttaagaccaaatgtaaatatgcctgctatagaaaaaatatcttctatgcaatggcaatttttactgtaaagaaatgtatccatccctccttctgtatcttgacaatgtgataaatatatacatatgcttttaaagtaactgtgtatgtgtttatgtatatatgtgtctatacgggtatatacatctaatgtgtacatatgtgtatatacatctagtatgtatacatatatacacaatatacacatgaatacatatatacacgtatatacacatacatatatacacgtatatacacatacatatatacacgtatatacagatatgtatatacgtgtatatgtgtgttaatttgttctgttttgttttcttccagctttggagaatgaagttcaatatatgaattatccatagagaccagtaggcctattgcaaatccctgcggtggagtgctaggagccagaggtgctgaattctcctgcagttctataaatgaactaagccacacttactgactctgttactgaaaaccagttgcctaaacattttgtgtctgtttcattatttgtaaagtgagaaatgtacttactgaacagggtcatcacaggagacaaagatgattgtgaaagagccttgtaaagggtacatctgaaccccaaattatcaataagtgctcattggctgtgcctcacaagagctcagagatcactgagtctagttcaatgcacttaaattacgacatggaaatggaggcaccaagaggtgagtatcctatccagagtcacacagctctacagagatatggaagcaatatcataaaattcaatcatgtcatatttcatttccatgaaaataaactaaaaaaaaacttggaagatgagaactttggataatttgagtctgaagtacttcatactactttaagttacctcctattgggggcattataaatgggtaagcagagaacatcatggaaagacatggagcttagtatatgcaaatgttgagttactcagtgtaatgtgtgaaaaaggagtttcataagtttcggtcagggaagaaggcagggtcaaaatttctgcttgagagtttgggagcttggggagactttaaacagggagcaacacagcacattagattcctttggttacactaaggacaatggttttgaaggggaccaggatgaagaaaaggaaggtagaacgaccattcctcaatgatgaggaatccattgctgtaatctatgcgagaggttatacagacctgcgtggcatcattcattgtctgaatggagaagatgagatgaactatttagaaagtaaacatttagaaagtaaacattagcatttatgggactaatttgatgtaggtgataagggtataggacaccaggaagattttcagatttctagatgggagggggatttatagaagtgcgttaaagtggaatatgggaggaaaaagagacttagaaaaacaggtgtgaagttttgaaatgaagtttgtgatattctagtacaatacccaagtgaagctgcttgccacttggaagttgcatatgagtctggaacagggcaagaagtctcaaatggaaagaaaaatctggaaatcactaatatatccatgggttgttgaaaccaggagagagggtgggaatgccctttgagaatacaggatgatggactctgaaagcactggtacttgttagactcttgttcttcttcaagtaagtgtgggagacactgcaaggagaggttagtgggacaaactggtgcagccttttaaggggatttgttatactcacaaaagaagcccagtgtgagggatacttttttttttttaaaaaaatgaagggttgggaacctgatcccaggtttaataaatctgggaaagtggccaaggtccctgaattttaaagactttaaagagtctccgagaatgtgtcccaggtcactgaattttaaagaagccctccaggtgagaaccaatgctctgagagttgcaaaccagggttttgtttgtcagtgcaacattttagctggctctaggtacagagccttcagatgtgggtataaggggagattttcaaaaagttccacatactgagtgatctttttctaaaactgagaggcctcccagactcatcacaagccagaaaagtagccgttgctatttgttttccatcaaatgctgagagctgccactctcattcttagctcatttgaagcaacagggatttcctcttgagagcaggagacagaattcattacgacaaagcatggttttagagtaaagtgtgaagtgtgtagccatgtctataaaagggataaagagccaggacaccatgattttgctgtggggttagcattgcttactcgcttagtgatctgggccaatcactgaatctctctgagccttaatttcctcatctgtagaaggggaaaatagtacttatctcattattttgtggtgtagactaaatgagatcagatatcggaggtgcttatcctctggaaagcacctaataataagattagctacaattaatacgtgtgttaagaaatgtgggacccacaggctctgaatctcccggtgagtagttggaggagatggccaaaggctctgaaatcctttcaggtccacggattcctaggggagggtatgatctgggcaaagatgattacattattttctttcttacacttattttcctagaagatatttctctaggaagatgagagcctttgtaattttcaacccttagaaatcaattattcctgagttatttttgcatttatgaaaagtgccaaattaatttcgactgaattttcttttctgtgatcaatgaggaggtcagctggtagacatgacgagattctaacaacaccgggtattgcccctcggagttttaattgccttaattctctgtaattcatttctgagaactagcatcttttcatacagtcttaaaaatctcagcttcttaatatatgcatgaatggcaatacgctaatatgcaattcaagtagcagggtttacattttataattctgcatggaaaaaaggcttgaaatctggaagccctggtcccaaatgttcttcattcccacaacacacaaagagacaaaacctcagaacagaggtggaatcatgatatccttctctcattcattatttacaatatatctgcctcagtacctagatttccttgcacaccttaggaagtcatggggagatagatttgaactagagtctagaggtaagtgatgccatattccattacctgagtcactatctccccaataccttcccctccctcttttttcccccaaaagagcacatctttggaaattgagaatattcagtgaacaggactcataaatcaaatcattatcattaataatcaaagtgagacattgtgagaaatagcaaattaatcacaactggcaggtgaagctacttccagcctctgctttctgcatactaaagggagcagaattttccccagtgggtttttatttttcttaagtttattttcttagtgaacactgcactctttggttgactgggaattatgtccaaacccaggtttccctactactaatatgactaattctgtttaataaaatttgattttcagaaccatttttgttccataaataagatatattatgatttggtgtactttattagtataccattgcatatttgaaattgaagacatttttctagaggaggaaaataactaatggtatcacaaatttggattagatgtaattatttattttccgtgtcttgggtcatacttatgtgacagcctgtcatcttagtttaaatgcctttttggtaaaaatgggagacaagcctaaatataatattttctactgttatgatagttttcaaagcatgattaataataattcatgaattttgagaacgtcttatttctccagaaaagaaataaatacttcttttccatcatgtttaccttctcagcctccctgtgaagtaagaactactttcttaaatcgagagacagtgagtcaaaaacagttaaatttttaccatttcacacagcaattctgggtttaaatttaaaatagactcgaatttcctgacccagcattagacaatgttgtcaaaattttcacttcttagtgacttttgaaatgacatgcaaatttttaaaaacagaggaaaataagtactaatatctggattgtatttttatttctataatgtattaaaatgtgctaagtgattaaaaatacatgagctatttcagaaggtacagaaatgtttcgaactccatatttaaaggaaaggcaaacaaaatgtgggggattagaaggaaacaaaaataaaatgcaaagtgtatttaatattgagaaacaaagtgtttcagtaaggcctatgtgcttacgagagtctgtgcttttgctcagcataacttcactaagaaatgggagaagaggggactgaggctgtcactgtcctttacccagaatcatttttcccttctctgactgttaccaattacccaaagctcaattcaataatcctcatcagtactctaggagtttaactagaaagcaacattaaggtttaaatattgcagttttgtgaatgtaggattgtgaaaatctttctagcagattcccggattattcaggagtgtcagggtctatttctttcatattacttatatatgggtttttctttcctttgaaagcatctctgtttggtaaaaagcaaaattaaagtgaccgtatgttgcatattgtattgaagatggacgaggaaagtggtttaaaaatagataaatgcattttctttcttttaacattacacatactggttactctttcctgtctattttctagacattttttcagtttatgtttgcaagatgatttgtcattctccttgaatttctttctctactaatcttctgcagggacagttagtcacctgacgtgatgagatggttcctgggtctgatgagtttttcgctggtggacgtagccctgctcttgaacacacggatgtccttcaagcctgaagggatgaaatcccatctccctaatgagggagacaataggtttctcagaaaatgggatagtttcttttctttttttttcttttctttgttttctttctttcttttcttttcttttttttttttttttttgagatagagtcactctctgtcactcaggctggagtgcgtggcacaatctaggctccctgcagcctcggcctcccaggttccagcgattctcctgcctcagcctcctgagtagctgggattacaggcacgcacaccatagttttctatttgaatgatttgttatgttggttatctgtgacaaagtcatttgccccttttgggagggaatacataactataataattcaattctgaacttgaagaaaacagaaagcaaagtggcataaaattgccctttttgttgtaatttttttttaaatatttgagacaacgtatttgaaggcacgatgttcccctttcttctgagttggggatattccgtaagtgagtgatgaataatacactatgttccataacgtctctgtgtttaattgtccagagcaccatgtgtatactcacttgaacctggagaattgttcatgtgattggaaacccaaagaaaaccacttcctggctgttgatacaggggccaaaaagttgtaatacctaaagatcacataagtaggtttcttgattgttgtatatttattttgtatcattcctgacttgtaaataaggaaataagtcattaagaaattactaaattaggttgcaaaccatgggcaggaaagaagtcaaacagaatgcctgacacagtcaatcagctaagtctaattttccttccccatttctttttctttttttcctctcctgttgcttttcttcttctttccctttcaggcatctcctccagttttattttctgtaactcacagagtgctgcagaataatgttagggctttgcagtttattccttgcgatttaactgcataaatataaaaagtgcctgagcaataatgcacgttgggttattcaataacacaaggaatgtaaagcgatttcatatctccttgaatcaggaacattaattaatcatatgatgagaatgcaacgttttatttaccagggcaagaggctgccaagatctttctgagtttaataattgcacactctgtggagggaggaaaaattaatttagttattaaattggagggtgctttttttctatcatggtgatgctggaaagtagccaggccataatgttaatgttacgagagttgagatgtggatgactttcactaaaagctttctccacctttactaaaataaaaaaagaaaaaagaatagtgttgggaatggtgcacaaaatttgtttttcgtgagtgtagataataaaacaaagtttctatcttgcccttcaagaacaaatggattgcaatggactaggtgcatgcaaaaatagccccctcccaaggtgcgaatgttgccggaaggaagtgccttgtgccataggccaagtgaagtagttccatggaagcagagcaagtcatcatcaaagtgtaaggttgcaggagaatgaaggtgtcagcgaggaggcagtgtgacaaagggaaacagggtggctatgcaggattgttggaagtgtttgctgctatgagacacaaatcaaagaggcttccttgagatctctttgccacttaactggaagactctcattaagagtctgaagtcccctctctccccctccccctccctctccctctcccctctttccacggtctccctctcatgccgagctgaagctggactatgctgctgccatctcggctcactgcaacctccctgcctgattctcctgcctcagcctgccgagcgcctgcgattgcaggtgcacgccgccacgcctgactggttttcgtatttttttggtggagacggggtttcgctgtgatggccgggctggtctccagctcctaaccacgagtgatccgccagcctcggcctcccgaggtgccgggattgcagacggagtctccttaactcagtgctcaatggtacccaggctggagtgcagtggcgtgatctcggctcgctacaacctccacctcccagccgcctgccttggcctcccaaagtgccgagattgcagcctctgcccggccgctaccccgtctgggaagtgaggagcgtctctgcctggccgcccatcgtctgggatgtgaggagcccctctgcctggctgcccagtctggaaagtgagaagcgtctctgcccggccgccatcccacctaggaagtgaggagcgcctcttcccggccgccatcccacctaggaagtgaggagcgcctcttcccggccgccatcccatctaggaagtgaggagcgtctctgcccggccgcccatcgtctgagatgtggggagcacctctgccccgccgccctgtctgggatgtgaggagtgcctcggcccggccgcgaccctgtctgggagaaagaaggtgattaattctgcctaagttcgacacgatcccatgagacgaccctgccatccagagaagcacaatcttcagccttcaagacactttggactttgactattgagtttctaaatttaaaaactaaattgagtgtccttagaaccaatttatcttgaggaggatatcattttttgaggagttaaaagggcaattattgtttctaggtcatttgttaaaaattggcacacaatatattttaatgctatttaggtgcatatctatcatggattattaactttgatcatgtttgttgtctttgctccctagaggtacataagctctgaaggaaatatcaaatcccatccaacattttcactgaagagatcataactttcaatccaaattctataattcaattgcaatattaaatttgaatacatgaaatttatgcaatcattatacatatcgtttctaatagttggactgatagtttgacatagggctaataatgctcccctgttgtaacaagaatttccgggtgcttatatattatgagactactctgcaggcttcatttgttctattcctctttttccacgtggcaacagaggctgaaacatatagaggaaaagaagtacatcggcaaataaaatatgcttataggagagaaaaaacaaatgtctcctatgggatcttgatgaggtaatgtatgttaagttattcagaaaaaagcaaataatatgcaaatgtgaaaagttattacacgtcatgccaactcttagctcccagcccaagcttccaactggagcaagttccccaggctcttaatttccatgagggaaactcagcaaatttaaataatattaatgatatattaatgtagtaatgtgataacaaggcacttagtaataatgaaatggatatatgctattaagaaacttgatttcatatacacttgtcaatatttacattacaggatcaattcaattcaacagatatttattgagttgcatcagacactgtgcttgacgttgtgacttaactataaaagtaggtggtccctgtatttgtggagattacagtctgttgaaggtagacagataatgaaggttgtaattaggtaataacgacgtgatgtgataacatggttttctcatttaacagattcactcatgaatcacaacataattattgagccctaacaaaaatgccagttctcctaacaggctctatagagatatagcattgaatgtaaaagtcagggtctctgtaaaagtcagggtctctgatctcggagaactagatgttcaagggagtcacagcagtgcaatatatgttagagtttcaggaagccatttacaaatattaggcaagtaaatgttatgttccaatttttattttatgtgcctccctctctaaaagaaaatataagagacacagagtaagaacctaagttatcaccttgattcagtaacaagagattgtattagagttccctagagaaaaagaaacaataatataaagatgtacatatacgtctatatacctgttataagaattggctcatacaacaaaggaggccgagaagtcctatgatttaccatctgcaagctatagaaccaagaaagctagtggtattttttagtaggagtccaaaggcctcagaaccaggagcactgatgtccaacgacaggagaaggaagacaaaaatggcgggaagaagaaacaaatgcaaaatatagaaaacaggtacaagcatgatataaatccaactgtattaataattactttaaatgtgaatggtctaaatatgccaattacaagacagagattgccagagtggaaaaaaataaaaatctactggatttaaatgaaaagactcagttgaacataaagggaagaagaatgatgtatcattggctagatacaaatagatgtatctagtcaaaagcaagctggagggccgggtgcagtggctcagccctgttatcccagcactttgcagggcagaggcgggcggatcacaaggtcagagattgagaccatcctggttaacatggtgaaatcctgtctctactaaaaatacaagaaattagctgggcgtggtgccacacacctgtaatcccagctacttgggaggctgaggtaggagaatcgcttgaacccagaagatggaggttgcagtgagcagaaattgtgccactgcactccagcctggatgacacagcaagattccgtctcaaaaaagaaaaaaaaatcaagctggaatagcaatattaatttcagaaaacacacatctcagaacaaagaagatgagcagggataaagagggagattaaacaataataaaagactaaataaaaaacaaaaataaaaaataaaataataataaaagaatacaatggaactaaactagaaattaataacagaaaaattgttggaaatctctaaatatacagaaaatttaaaacatgcttatatataacccaagtatcaaagaagtagtatcaagagaaattgaaaaataattttgaactaaagaaaaatgaaaacagaacttatgaaaatttttgggatgcagcaacagtagtgcttagagggaaatttatggcttcaaatatttacataagaaaagaagaaagatttaaaaaaaatcaatcattttagcctccacccaagagaactagagaaagaagagcaatttaggcttaatgcaagcaggggaaaagatataacaaaattagagctgaaatcaatgaaattggaaccataaatttcacaaatgtaatagaaaaataatctcagaaaccagaaattgttttttgagaaggtttgtcaaaaaaccttgatgaatctctagctgggctaaccaagaaaatagattaatttttctcataaacatggatgcacaagttctcaatgaaatattaacaaattgaatccagcaatatgtaaaaggaattataaactatgaccaagtggcatttatttcagttatacaagattggtttcacacttgaaaatcaaccaatataatctactgtatcaacatgctaaagaagaaaaattatatgattatatcaattactgctgaaaaagcttttgacgaaatccacattcatgataaaactttcagcaaaatacaaatagagtaaaattttctcagcttgaaaaaggaatctacagtaacctacagttaacattatacttaatggagagatacattttctctaagatagagaaaaaggcaatattgtcctctctaactgctcctaaacaacattgtactggaagtctaagttaatacagtaagacaagaaaaaacaattaaaaatgtataaaatggaaaggaagaaacaattatttttattcagatgacataattatctatatacaaaagaatcccaaataatctacaaaatattcctagaactaatgagcaaagtggcaggataaaagattaacatacatagccaaccaattttctatatatcagcaatgagtgattgaaatgaaaaaatttaaaatacaccacttatgacagcagcaaaaatggaatattttgttataaatctgagaatatatgtacagaatgtacatataggaaactataaaacactgatgaaggaagtaaagcatatatatagaaatgttccatattcatgaatcagaacagtcattattgttaagatgtcaattcttcccagtttaatttatacattcaatacaattccaataaaaatcctagcaaactattttttgatatcaactaacaagttgactctcattttatattgaaaggcagaagaccaagaatagccaatgtaatcttaaaaaataaaaataaagttggaggactcacactacccaatttaaaatttaaagactcactatgaaggtacattaataaaggcaatgtggtgttagtgaaaggatggacacatggatcaacaggacaagacaaagaactgataaatagaccaacacatgcatagccaagtgatatttgacaaaggagtgaaagcaatctgtcactagagaaaggataatattttcagcaaatggagctggaacaattaaatgcccatatataaataaaaaatccggacagaaactacattttccaaaaatttgaatcaaaatgggtcataaacttaagtgtaaaatgcaaaactataacattcccagaagaaaacaggagaaaatctgtgtgatctggagtttggcaatttatttttagatacaatacaaaaagcacacctcatgaaaacaattgatacatttgactttattaaagttaaaatcttctgcattgcaaaaaaactaagagaatgaaaatccaagtcataaactgggaaaaaaatgtttgcaaaatttatatctgataaagaacttgtatccaaaatatacaaagaactctttaaatccaacaataagaagacaacccaatttaaaaataagcaaagatcttaataaacatctcaccagataagatatgcagatggaaaataaacatgaaatgatgctcaacatcattagccattagataattgcatattatcacaacaatgagacaccattgcattcctattatggtggccagccctgtcatccttttccagttgaaaataccaattgctggcaggaatgcagagcaacaagaagtttattttgttgctggtagaaatgcaagagtacagccacataggaagagagtttggcagtttttaacaaagctaaacattgccataaatacaactctgtaatcccgctcctaggtatttacccaactgacgtgaaaactgatgtccacaacatgcatgcgaaagtttataacactgtctttcataattgccaaaaattggaagcaaccaagatgtcctttaatatgtgaatagataaacaaactgaagtacaactacacaatagagtactatcattgataagaggtaatgagctacgaagacatgcagaaacatgagtgaatagtaaatgcatattgctaagtagaagaagccagtcttaaaaagctgtatgattccctttatagaatattctggaaaaggggaaactataaagacaataaatacatcaatggttgttggagctttggaggaggtgagttaaataggtggtgagcagaagatattttagggtgggaaactatttttttggtagtgtcataaacaatatatgacagtatgtatttgtcaaaactcacaaaactttataacaaaaagagttagccttaatgtttgccaattaaaaaattatctaagtgactggtggatctcaggataaaatgcggaatgttgcaaaagactccaagtgtattagaaatgtataaaacaaccataccgcatggagagggagaaggtgggatctacataatgttgcaaatatgtggagtctggaatactaatggcaaaaggaactgtgcagaagaactgcactctggttggtaaaggtttttcacaatgggttatggatccacaattctgaaagcagcatacgtgcatagtgcttttgaacaattaggtacttaaatggtgagtggtgaaagtcaactttctcactgctggagtgggaggctacaagtaaggaagggaagagactacaatgatccatgtggtgataaattaaagttgtgggcattagtttgaatatatgtttagcttaatatagatacagaaggttacatacagaaaaatttacatgagttacatgtatatacataggttagcaaacacacatacatttccttgctgtctcagcttagaccctcagagggcctaggagccatgattccccagtaccccagtagtaacaagcatacctagtgcctagatcttggtttcaaattatattctcaaataaaagaaactagagctcagtgaagaaatgacttgagtctaggattggaacatgatatacacaagatgaacctagaacatcttgtagtgacagataagaaaatgctcacaaaaaaagaaaagaaaaagagaaagaaccaccatattgaagacgtttcaaaaggacactagagctaattgaaggaatccccaatggtcaaagctggaacaatttgaataacaaaataaactagtgatggatatgacccagagtataaaatgaaaatccattaatctatactgatataagtaattaattgacaaataaatcggagagaatacaaaaatctgtgcagaagagtttctgtggatgatttgccctagataactctgtattccttaagtgtgggctgcacacagtgacttcttccaaagagtgaagtgggaaagggaaaaagaagaggagttttaagtagagaaacctgatgacactacttcagccatgtaatcatctttcacaactacagtgacaggtcatgttcataatatattcccttgaggtgatttgatgagagtggcattttccctctgtggtcttcttcccaaaatcataacttgaatttaattttgaaaaaaaagatcagatgaatctcaattaagggactttgtttttaaaatacattaaaaaatttttttttaattttttacttgtcccaagaaaaaaaattgagaaactttctacaaaacacttggccaatacttctcaaattgtctaggtcatcaaaaataagaaaagcttgagaaactgtaatacccagaggggcttatggagaaataatgaccaaatattataaggtatctcagatgggatcacgaaagagaaaacgagaacattagataaaaactaagaaactgaaatcaactatggctttttattaaaggtatgctattgatatactaggtcattaaaggtgataaatacattacattattgtaagataatgataacagaaacttggtgtgtggtatataggaactctgtactatataagttttctgtaaatgtaaaattaccttaaaataaaaaagtgtattcaatatttaaaaagaaaattagaattttctctttggtaaatacacaccttacaaatctttacaccagataatggttttggttttgactctctaccttcataaaaaaagttctcaattgtaatattgagaagaattaatgtattaatgcattagacccgaggaatagattaggatcttttttttttttttttggtaccacaattggtaatgatcatattacgtctaacaaaatacatgattacattagtccattcagtattcttttcttatatatatatatatatgctgggtgttggacttggtggttgtcctgcaagggttcacagtcttgttgaagatatacatattaatccaacaatttaccttcaatttattgtggacttaaggtaatgggctgggtgtggtggctcacacccgtaatcccagcacctgggaggccaaggcgggtggatcgtgaggtcaggagatggagaccatcttgactaacacggtcaaaccccatctctactaaaaatacaaaaaattagctggacttggtggcacgtgcctgtagtcccagctactcaggaggctgaggcaaaagaatcacttgaacccgggaggtggaggttgcagtgagccaagatagcgccacagaaaaaaaaaaaaaaaaagataatgaaacccactggtaccttcaaagactttatatgaaaaataaaccctaataagtaattattgcacatggtgattggtgttagggcaaaaccatgataggagataaacttgtgttgggtcaaagaaggtctccccaagtagataattgattgagggaaactttcaaggactagccaactgtagccattttcttcctgtaggcaggaagatgtaatagtgttgcagggcaggtgagcctcaaaattggggcttatcccgagagggcttttggttttgttcaagaaagaattaaagagtgagctatgttggcagaacaaaacagctttattaagacaggagtattacatctctgtgactgtttctgcagaacagggctaccccacaggcagtgtgtccagagtagcagctcaggggcagttccgcagtaatatttatacctacttttaatcatatgcaaattaagggactgattatacagaaatttctagacaatgggtggcaactttttggtaattgacttggaagggggcggcaacttctgagtgttgccatggcaatggtaaacagtcctggcactggcaagcaagtcttatggagaggtacgttcgcctcttccctgtttcaactagtcttcaatctggtccagagttgaatccaacctctggagttgagtcctgcctcctatttcaatagcagatacaaaagcatagcgagaaagcagagagaacaggacatgtttggaaactatgccatgatgcttagagaatgaatgaaggagagggtactgagaaggaagggagaaggacacaactagagatgcaggatgcagccagggtcaggtcctgctaattcctgagtaccatggcagttatcaatccttgtccacagtaattaataataaaaattcaaggcattgatgtaatttggcatcaaagagctaattattggctctcatcattatgtattagagtcatagctgatcagaagttccagggagaagcataaagtcatcaaaagcagtcagctgaatctggcaaaatgaaagtgattgttgcaatatttttggattcagttcagagtttaaatcttttacatctgtgcctccaaccgattcattttagaattggttctgagaataaattgactggcttgtagaatttccatagttcaaggacttgttgctaaagtggaaacaagtcaagtttgaagaatgacctattgcatctggtgtgttgatgacttcctctaactgcaaataatgtagggaaaaaaagagcaactgaacgtttcctgtctgcagaaaagtatctggaagtaacgcattcatcatttcctttggatttcaatagatttgcatttgcactatctttgttgcacatagactgaaacacctgatatttttgcgttcaaccacacattattatttgttggtgggttatttattgtcattttatagactagaaaagtaaatactagaattaaattctaaagccctggatttagaatgtaagaccaacaaagaattgtgcctaccacacattcctaaggtcatttctctattgctttttcactttcaatgcaagttcagagcagcgtttttttataaaggcattaattgctatatgagggttcaaattcaatgttgtgctaccctaacttaatgcttatttgattcagtttatttcaatttgtttgctgttttccacactctgctggcagagccatttagaagctaagatttgttgttgccgttgttgttgttgagacggaatctcattctgtcgtccaggctggagtgaagtggggcaatcttggcttactgcaaccttcgcctttgggattcaagtgattcacttgcctcagcctcccaagtagctgggattacatgtgtgcaccagggcgcccagctaatttctgtatttttagtatagaaggggttttaccatattggccaggctggtctcgaactcctgacctctggtgatccacccgcctaggcctcccaaagtgctgccgtgagccactgtgcctggactggaggctaagttttataggagaaattcaccttgactcttagtaactgtttccactggcagtacatttcttaaggttcttttcttctgagatctgccctttttgtccctgataaatgacccttaaatagggagagactccactggagctgtcggttgaactctgctccatctgcagggtgcacccaggcactaatcacacactactttatccctggagtgtcacagtatcagcaactctgtattcatctgtgaataaaaatagtttttctttatgtttcagaggataaacattgaggcagctttgggatagagtcattacatacatctttttactcaataggtgtatattttgtgcctaccaagcaagtgcaggaaactaaatgcaagagtcttttccttgagatacttccttccttctcctataacctcaacacagaaagttaaaaagtccactgggtgggaattaaagagatatttagctgctgaaagtgcttttggcatctacaaatcattctggttttgtggtgtctgttgcctatcctgtttacgtgaacattgatgaaagaacaaaactaagtcagtctttcttcatctttcttctcgaattctttagagtaggcaaccattatctgctaaaatagctttttagtcatactcatgtctgtgtagtgaaaatatttcccccctaaatgaaatagagttccctcctaaatttgcgtagagtcacaaccagctcttatttcttgctcatgtctaggttactgggcagctgtcttttcatcaataattcaggactcaggcattggtgagctgaaggagaaaaatcatggagatttagaaaagtctttgtggggctagaagcacttctgctcatattctactagttggaagtgggtcagaactcatttgtctagccacaagagctacgggagaggctgtacaatgtagtccagtttgtgcctaagaaaaagagcaacaggaattgatctctgctgtgcctcttgcttttctatcagcagttgggtgggagtgaagtgaacatcaggttccaggaatctcctgagcacccactgcacctcagcacttctgactgcctgtggtgttgcctcctgtgggggcagcaagattacacctcacaaagggtttatgctttcctggaaatattcactttcattgaagtgaacccactatcttctatgggctaaaaagctagatggaggcacagacagtgcatccaagcccaactgatagaaccttccactcttctattcatggcacagaatagccatgcgttgtttatcattgtctgcataactccagatgaggagaatgaaggaaggagagcagtgtggaagtattcactctacatgagacattttctcggtgctacacatacatcatttcatttaactctcacaaccatgttggacttaagcactatccttgctttttaaacgacacaactgcaactgatccttagcagatttaaataagtcactcaaggttatgcaggtagtgaatagaaaaggcaagattttaatctagatttttctgattttttaagctgtttctttaatcgctttgtcaccatcttatcatactgcctcttcactgagattccatgagtgacaacatttgacatctgtccttcacatagtagacacttgacgtatctctatggagaaatgtctgatgtgggtgacttctttgagtatacattgctcttggtcaaatttgagaactattttactaattgtgtttaacacgggggagccatcctatacacaccagtattctttctcttttggtcattgtcttctttcacagtcattatttctaaaatctgctcagaaattttcattttttttttcaagtaatggtttgggctgacttattctcattcattagtcatttcttcatttatttaacaattatactttttaagaacctactgtgggtaagcattctgcttggtgctgggaataagagagaagatataaagataattgtgacttgattattcatccatgagggaatctctggagttttgatttggagaaaagatcatcaaatacttaaagcagaaagttatatgcccttataatgcaaccacagtcacaaaagtgttggttttgcatcttgtgaatattgcaagataatgaattgcctaggaatgcatattttttaaacttttattgtaagttcaggggtacatgcgtaggttacataggtaaacttaatgtcatgggggtttgtcgtacaggttattttgtcacccacgtgttaaggctagtatccattaatatttttcttgatccttttcctcctcccaccctccacgccccaccattttccccagcatgtgttgttcccctgtatgcgtccatgtgttctcatcatttagttcccatgtataagtgagaacatggtatttggttttctgaaattttgggcattggcgtgaaagtctgatttattttatgcttaaggcgttaagtgttttcactgctttttcttcacctcctcacttttatttttggatttactctttgttcacattaaaccactatatttacatctcagacatttgaaatcttaacaacacaaattcagtaatatcagaggacattttggtattgccaatcacttcttcagaagatctctttacctatgaactccagccaagatttcctgtcatcagaactctcaacacatttctctctgtatacgctgcatctaaagaggctgcactgcaaagctgactaaacaaaagtttatggcactcgttccaactttaccactgactagttgtgtgaacttcggacggttgacctctttcggcctcaatttccgaggcaattaataaaatcagaaattccattcatcgttctggattgttccacttaggaattttgactagtttttttctgtgttttataaaaatttaaacacatagcaataaacatggaaactcacccaaacctaagatgttacgcatattgactatttttaatgggagaattctacagcaaaatcttcatgatgcagagaattaggaaaccacatcaaatacgtgttttggtgaagtcttcagatgcattattcaacctctttggctcaattttcatcatgtgaaataaagagagtaaactggaggttatctgaatcttcagaattcagtgctttgagatattatatcaacttaggttgttgaaattgatgtgacagtttaacaactcctatccaaatgggtcacgtgtttctatttaaaaagatataaaccttcttccataaaaatcttttttttgagaacacatgaacatagggaggggaggaacacacactggggcctgtcaggggtgggaatcgggggaggagagcctcaggataaatagctaacgcatgctgggcttcacacctaggtgatgtgttggtaggtgcggcaaaccaccatgacacatgtttacctacgtaacaaacctacacgtcctgcacatgtaacccagaacttaaagttaaatcaaattaaaatttaacagtagaaacaaagtctttttttaaaaattgagaaaatcagttgagaatttagcaggaatatggaatgaaatgtaaatgtttttgctgttttctcaattaattctcatgattttcctgaattatatctagatagataacaaaagcatacagatatcagtatatttaagtaactttaactatgaaaattcaaagtgaacaaacataattatggaaataattttctcacttaaaagagcattttcttggagttagttgttacccatgttttttcttattttgtcagagaattttgggaagtagcaaaatgtaaaactacaactgaaacatgactatcattgtctaaaaatcagggtaagtcccatccagtgtgttgtagatatttttttcattgattttaatctaaacacattaattctcttttaaaattaagcattttcccacaaactcaaaggtcaccagagaatttgttcaagacttaaaaaaaagttctatttgtgttttagattcaggcagaacatgtataggtttgttacctgggtatattgtgtgatgctgaggtttggagtatgattgatcctatcatcaaggtagaccataatattcaacaggtagttttatagccctttccttttccctccctccccctctgttagtcctcagtggccattgttcccatctctacatctgtgtgtacccaatgtttagctcccacgtataagtgagaatattggtatttggttttctgttcctgcattaatttgcttaggataatggcctctggctgcatccatgttactgcaaaacatgatttcactcttttgtagggttgtgtcatattccatggtgtatatataccacaccacattttctttattcagtccaccactgagagtcacctaggttgattccatgactttgctattgtgactagtgcggcaatgaacatatgcatgaatgtatctttttggtagaatgatttatatttctttgggtacacaccccgtaatgagatggctaggtcaaacggtagctctgattttagttctttgagaaatctccaaactgcttttcacagtgggctgagctaatttacatttctaacaacagtgtataagtgttcccttttctccgcagcctcgccagtatctgttatttttttactttttaccaacagccattctgactgatgtgacatgatgtctcactgtggtttcgatttgcatttctctgatgatcagtgatgtgagcttctttatttacgtttgttggctgcttgtatgtctttttttgggaagtatctgtgacttcttttgcattaataatctgtataggttaagtaagagcaatcttcaatagttaactgaatatcatattaatgatctgcttcattttgagtaaactagtgcttctattccagaaagtggtataaaaaaaacctggtgaatataatataatataataaatataatactttctgtatataatgtgcccgactgaaaaatttatgattatattttccaagtaaattactagatttgcacagctaggtttaaaagagaaaaaggtcagcaaaaaaggtggggtgggttatggtaatttccatacaccacaccccaaactggcaaaggtatatcacaattaatcatcttatgacgttagaagagtgtctgtttccacccgagttacacattggcagagatatgcatgcattgaattctgctacactttaaacaaaggatacaaattgctaaggaaaggacagtctcagccagcaatatcaattctcagaaccagaagagaaagtgtacatgatgccggccttttggtagtcttctccatttgcctcttcagtggctgaatttaatcaccaagctgcttctaactcaacagcttgtgaggaaacctcagagacacagacatcagccagaacagaaaaagacctctgggtttacaagagaaataattttgtccccatgaagaattaaggtcttctgcagaactttccagaaatgagcagtcttagatggcaatgctgatttgcatggaaacagggaatcctgaatatacaatacatgagaagagaactactgggtgtttagatggtgtgacacatggtatgcaggtatgcatgtttatagcaaatggctgtgtgactcatagccaaggtacaacttgtcaggaccaggaacatcatatggaagagagcagataaaacaatgaagaaatttgctactgcagactagattctgagcacaagaaaacagtagcttgacctgtggaaatgaccatgatcttgaaaatatctctttggcattaggagtaaagaacaaggattaaaacaaacatacatgaacccatatggctacacagggaagccagttttcaagagtgtgtgtaccccaaaacaatcacaagaaatcaaaaattttttaaaaagcaaaaattgacaagtaggatctaattaaactctgcacagcaaaagaaactatcaacagtgtaaacagacaatctacagaatgggagaaaatattttcaaactatgtatctggcaaatgtctaatatccagggtgtgtaaagaacttaaatgcatttacaagagaaaaacaagcaactcgattaaaaagtgggcaaaggacatgaacagacatgattcaaaagaagacatacatgaagccaacaagcatatgtaaaaaagctcaatatcattgtttattagagaaatgcaaatcaaaaccacaatgagataccatctcacaccagtcagaatggctactattaaaaagtcaagaaacaacagatgctggcaaggttgtggagaaaaggaacaattatacactgttagtgggaatataaattagttcaatcattgtggaaagcagtacggcaaatccttaaagagctaaaagcagaactaccgtttgacccagccatcccattactgggtataatacccagagaaatagaaatcgttctgccagaaagacacatgcaagcaaatgctcattgcagaactatttacaatagcaaaggcatggaatcaacctaaatgcccattaatgatagactggataaagaaaatgtggtacatatacaccatggaatactatgcagccataaaaaagaacaagatcatgtcttttgcaaaaacatggatggagctggaggctattatccttagcaaactaatgcaggaacagaaaactaaatacctcgtgttctcacttataagtggaagctaaatgttgagaacttaagaacacaaagaaggaaaaaatagacactggggtctacttgatgggggaaggtgggaggaggcagaggagcagaaaagataaccattgagtactgggcttaataacctgggtaataaaataatctgtacaacaaacctccatgacacttgtttacctatgtaacaagccttcacatgtaccctcaaacttaaataaaataaaatagacctatatttaaaaatatttttattgtctaatttaaaatgtactttaaggctgttatttttttctatcatccatatgtatcagttactacaataaagtaattgagatttagaaaaaaagaatgcatgtacatgagatagaataaggatgcataccctatgatgaatacaaaagagggaaaaacctgtaaaaattgaatcaggaaggccaatacccccaaataaaccaaaactcaaaaaatgtgaaaatggaaggagcgggatccccaagtcacctttggcggaaaggctccaatagagtcacctgactataaatatttgccttggaatttgcatgagaattaagtattctttacgtttggccactgagctttgcagcttgttgtaatagccattagcctaccctgtactaagactagattgaaatcccaaataataaaaatgccttcctttaaaaaaaatttaatgtattataaaacttgcaaatatatttgcaggataacctttaacaatcttttaagaaattaagggcaatgtaaaaagtaccagaaatatagaaattgactagtgcaaagttttataagacaaaaaaggacaaattggtaagctttatgtcaatttcaggcaaacaatgtacaatgaattattgaagagataatttgtgggtacattaaagaaaactcctcattatcaggagtcagctttgattccttaagataaagacatattgtcgtctcctgttttcctctctgaaaattgtttgtaggcagtagttcagggattggaatatagaacttcttgtagatggcataagcaagtgcataaaatggaagtattcaaaggaatgtcttctagtatgtatcattaatgcttaacaattcaacttcacatgtaacacatttcttaaaactattgggcttttaagaaaacatgcaataaaaatgattcaaatatgcatagcatttgtgcaatgatttatagtttacaaagccccatatgtacattttctctcctgatttttgtaataaagactgggtaagaaaattgacattcagagaaaaaaggataacttattgggaccacacagtaagctgcagctgggataaacctaagccttctgattctaaacagttttctggccactactttattgtgccacttgtctgaagtcaatagtacacatgtgctatttgctgtctcatagttatttcaattctaggtaatgacccccccccccccacacacacacacacattgggccagattactattgcacaatatcagaagaaaatactttctaatgggatgctctactaatggatcccatttaacacaggagctagaagggcttgttctattccatctggaacttgtggacttcaggcatttattgaaggatgcaaaagtgcccttgttgtgtgattgggtttcttccaggagctaaatgcttaccgtagcgtgcataatgagaatgagccattgccagaggttctcccatcagaaagaattctgatcttagagtcccttatcagctctaatctggctctacaactggctatcatagagaaggaagtgtgtcttatggaaatgtttgttaaataatgtgggaaggaatgcctttttgaattcagggaattatggcatcaagcctctaccactgatatcagcatattctgattttaaaatagaatatttaaaaatcataaaagcagtttgttccagtttgatgtttaaaaaacaattagtaggattgtgagttaaggtgagagtagtaggaagtaagatcagagaaggaaggagagaaacaaatcacgtagggctgtataggtttttatggtgagagtgatgagaagccatggaagtgttctaaacagaggaataaggtgatgtgatatacttttaataagatttcattggctgctctactgacaacaaactgcagaggaaaatgcgggagcagagagattagttaggagactattgattacaactatccaggttaagaaatgatgatagtttgaaccactctgttggtcatggaggtggggaaaagcgactggatttagcatgtattttgaaaaatagagctgccatggtttgccaaacagttggatctggggatgagagaatcatcaacaatgactacaaaatgtttgtccagagtgaatagaaacaaagagttaccagacacagtgtttgagacatttattagacatctaagggatgatatcagtaagcagtgggattttcgttctgtagtttaggttacaggtctaggctggaattttagttttaaggatcactattacctggaaggtacttaaaacagtgagtctagagaggatatgtagacacaaactacacatggaaaatagaagaggccaaaggactgatccttggaatatgttcaagtttaaagttagggagatgaagaaacaacatcaaaggagcctgacaagggatgattagaatagtaaccaagtaacaaatttaagagtgactcttccaaactgggaaatttcaaaacaaaataagcctgaagaattgttaaaagaatctagtcagtcaaaactgaataaagagtattttcagaaacgcttgatagctcatctataatggaaaaacaaacccccatgtccaactgttctcacagtgggtcacacaaaaagtgtaacgggagtggagaagaaccagaaatgagaagaagacaagtcctaaaggtaggtaagtgtacaattaggtaattgtgtcctgtttcataggaaacaagaaaccatgcatgggacaagaatctaatgaaggataggtacgtacaatacaattgtttcctacaaaaataatttttaataaaatctctctgtagatcttattcaagttatgaacctttcatcttcaaacagtaaagatatacacacattcacaagctgttttatttacaaatctatgacatctgcaaaacttttaaacaaaggactccacattaataacacctagattatgattgtctcatcagctccactgcttcaagagaggaactacatcagagaattaagggagctccttgcattgggttctaagcagttcagtcccagctgtctggttgtagcatgagattcttactggtagagcttagtatccatctgctaataaagagacaaacaagaatcgtccccggatgcctgtgccaactgaacatttcaccaaaaacaattaaatcaaatttttcttgcgaattgttaaagtagcttgaggcagtgtcacttacatggcctcaaataatgtctccagtgttgcagaaacaactattttctctctgcactagatgaagaagggctgggtttattttttccccttctcttccctgagcaaatccccataacaaataaagttacacttcaagaccggattactcagactattggctttgcatgccaatgtttaagtaaaaatgatacttctgagaattcaaataatgtttaagtatttccaggctacagttctacttgcatttgtcttggcaccagctcaccatgaatgtgtcaggttttcaaaaagatgactgtttagtcatagttggatgtcttcatccaatgtctcacatgtgctgaatatgtttctattgccttcttgcctactgtcatttggtaaagagttcactgcgccattagctatacagttttttgataggagcctgcaatctcttctagaaatggtcttattttgtttaagagagaaaaatttaaaaagagaatgaatgagagagacaaaaagagaaagcttaaaaattcaataaaatacaaaagatgttacaaaatttatgataatgtaaataatcgatcatttatcaactaactctcccaaaagcttcagccctggccttgttttcatttcaagtgtgttcattttacaagtgtcagaaaataacattttgtaaatgacacagtaaattacattatcttaaagattacacccttaatttttttaaactctcaaaaaccattccttcttttctcccctccaccccagttctatgtcttctaaggtacattatcagatgaacagaaaagttcacatttcttgtagatacctgtttgtactttttgatgattacctacctgaataaatatattatagtccatacatctatcatctaagaaaatataagaggagacactggtaacacataaactatcttaacattatttgaagctcaaaaatttcttttttcataaaagaaactatttcaggccttgtggtcaaaacagtgtgggagatattttagggtactcaagggtgtctttaaatttcatcattcatttcatgatttgggagataatagtgctaagattctctgtggtggcgggtatggattcaacggtgcatgattgctgtctcttacttgacaagatttccagctataaaatatgtgagtaaatgatgttggatattatacaatggatattaaaaaattggaagggaactctgatttgagatgtgattatttttcagcctttaaaaatatataactaacattttttttcctttgttttttcctcccaggttcaagtgattctcctgcctcagcctcctgaatagctgggactaaaggcatgcaccaccatgtccagctagtttttgtacttcttttagtagagtcggggtttcaccatattggccaggctggtctcaaactcctgacctcatgatccaccctcctcagcatcccaaagtgctgggattacagatgtgagtcaccgtgcccggcctactgacatatttttaataaatatttcttaataatcatatataatgctctaaaatatttcactaggggttaggaagttatttttatgtgaataaaattcctcctggataaatatatgtcttcttattttgccctccgttgatactggggacaactatctactgtggttttgaaatacaggtttatgagttttagggatatattattttgtttttatatgcacaggggatgccaagatatttaaaattcctggaagaaagcaatattatagatagagaaagcagatcagtgactgcctaggtgtattagtatgttttcatgctgctgataaaggcatacctgagactgggcaatttactaaagaaagaggtttattggactcacagttccacatggctggggaagccttataatcatggtggaagacaggtaggagcaagttacatcttatatggatgtcagcactcaaagagagcatttgtgtagggaaacttcctttttaaaaaccatcagatctcatgagactcattcattatcacgagaacagagcaggaaagacccacccccgtaattcaatcacctaccactaggctcctcctatgacacatgggaattgtgggagttataattcaagatgagatttgggtggggacacagccaaaccatatcaccagggccatgggtaggagcagaaaatgactgcaaagtgtcatgtgaaacttgataaggttatagaagtgctctcagactgcattgtgctgatgcttaaacagctgtataaacttagtaaacaatcattactctatatagttacagtgggtggattttacggtatatattccttaatcaagcggtacatgtatatatatagatatatacttacatatatgtatttatgtgttttatatataaaagctgtgtatgtatgtgtgtatatatatataaaaaaatatacatacatgtgttaagcataaactctatgattgagctgtcatataattaccacactattggcgtactatatggtgtacactgcaatctgcttcatggtgaacctgcttatccttctgagcacttttattaatctatagggagtgcatgttttgggaaatacatacagttctgtgataggttaggtatagcttaccttaaagtattgtaaaaccttagatgaattctatacatttcaaaaaataatgtggctttttttcagtagaatttagctaccttcacataaccctacaagttaacaaaatatatagctttttgatggtgtataagtgcatttcttgggacaatatattaaactgtccataatggatttatgtattgggaaaagtttaaaattgttttaaggctacttgtttatggccaaagaacaattcatctttttcttttgttaaatttaaaacgagaactttttcaacaaaggtttatggctctctgtcttctaggcacatgccaggatggcacaccctggcttctacattcttggatagggtcaggtgactaagaacagagtcatgcctgtcacctgtctgctggaggatttaatctcttgtaagacttgataaaactttcttttccagaggctagatatataggaggttgtggctgctccagcagcttggattcagagtgagaaggcataaaggagaatccccagctgacttgtgcagtggttaattgaaattattcaggcaagagatgatggtgtcttggaccaggggatgaggaaggctacaaaatgtgtctacctgtattctgtgaggagaacgtgttccctggttttagatactgtgaagatggatcaggagagagtttatctagactgttggggaaaggtgttgcgattccttcagctacacaggattgaaaggagacatttctgaaggggaaaaaggaaatgaaagaaaagatgtttcagattgaggatatgctgtgtggtgaacttgttcttcactctgtagggttcacaaatgactcttcactgccctcttggatgaaataaactggttcccatagaaatggaccgtctctgatttcacagtctagagcacacaaataactcaactttctggaagcaagggtgatggctcgtgagagctcaaggacaaggaggagtctgtagaagcacacctggactcggggaaatcattgacctctcatcctgaattaagtagcgcttgaaaagactctctttgaatcagaaaaataatgcgagctcctatcaaactaccttacacagccaactgagtgatcataggcttgggtggaaaaaatgtaattcgtagaaccttttaagagctaagattccttaatcaacatggataccgtcttgttgaatgacaccgaactgtgctgcgcaggattcggttgcatggtggctggagctgcctctctgggacccaaatctcagacctgctgcaaagtgactatatgatctgcaacttgctaacccttctaggcttttgttttattatttacataatgaagtgaggggaatatgttccttgtaaatttgttaagaggattaaattagttcatgtcaaatgatttagaacactgtctgccacatattaaggactcaacaaatactacctattattaacaatgtgccctaaatctgtaaatcactcaataatacatggcattaggctaaatatggaaggtagaaggaaataaattgtccagaagctaaaaatatgaaagactcttcatatatttaaaatattttctttaattcttttgtttttttcttttttgagacagagtctcgctccgtcacccaggctggagtgcagtggcatgttctcggctcgctgcagcctctgcttcctggattcaagtgattctccttcctcagcctcccaagtagctggaattacaggcatgtgccaacatgccgagctaatttttttattttttgtagagatggggtttcaccatgttgcccaggctggtttcaaactcctgacctcaagtgagccacccaccttggccttccaaagtgctgagattacaggcttgagtcactgtgcccagcctgaaatatcttcttcacatcttttcatatgcatatttgtttttacaagtacataaatatacatttttgatataacttggaatcttgcattttctaactcaatgtctaactaagccgcagaacaggatgttgaatccagcacattgcaatacttgcctatcaacagaggacatgtgctcataaactagacccttcaacggtctgacccatggacatgctactatatgacccacctaaagaaaatggccccagaaggaagtgtgcataaggtcactggagctaaccgtcttcccaagaaggacatctttctgagggtatcaaggaagtgtgctcatcaggatttcatgcttcctgtcactcttcacatctttgttatcctgtactgctgaagcaggtacagtttttcatccaggagctcgtcaacagtttattctttttaatcaaacaatgaaagaagaaaagatatttagacatgaagtccttgcccatgcctatgtcctgaatggtaa

SEQ ID NO: 116 - DNA, 32732 bp, Homo sapiens; identical to SEQ ID NO: 115

SEQ ID NO: 117 - DNA, 1709 bp, Homo sapiens
tgtgtagccttttacccaatttcctttaatggtaactgttatgcaaaactatagtataatatcacaatcagcatattggtgttgctacaatcaagacagaacattccatcactgcaggatcatccctcctgctgcccttttaaagccacacccacctccctcctccctggcaaccactattccatcctttgcgtctataaatgttccctttcaagaatcctggctggacgcggtggctcatgcctatagtctcagcactttggggggccaaggtgggtagatcacctcagatcaggagttccagaccagcctgggcaacatggtgaaaccctgtctctatgaaaaatacaaaaattagctgggcatggttgcacgcacctgtagtcccagctactctggaggctgagatgggaggattgcttgaccctgggaggcagaggttgcagtgagccgagagcgtgccactgcgctccagcctgggtaacagagtgacagcctgtctcaacaaaaaaaaaaaaaaaaaaaaagaaaagaaaaagaatgttatataaatggaattatacatgtcacatttggggactggctttttctgctcagcataattccctggaaattcatctagcagacctagatagttttgttgttgtagtaacatgaagtggatctattcctctggtcataccattccaaatctaaatttttatgcagggaatagaggtacactgttttgggggatatttatcttaagggatctcaaacaattttttgaattgttaacatgagactgtcttctttcaaagagcctgtgtaccatccagaaagactgagtagggggccaatattatattccagactctatttttactcagatagaactgaacatatggggtacagtagtggtacagtttatcactagatacattttagtttgcctttttgtcttaaatgtcttaaatgtaaaaatttaaagaaaaatagatattcctatgggggctttttaaatttctttaaactgctatggacagacttgtaatttttttttttttttttgagacggagtcttgttttgtcgcccaggctggagtgcagtggtgtgatcttggctcactgcaacctccatctcctgggtaaaagcaattctcctgcctcagcctcccaagtagctggaattacaggtgtgcaccaccaatggctggctaatttttgtatttttagtagagatggggttttgcaatgttggtcaggctggtctcgaacttctgacctcagtaatccacctacctcggcctcccaaagtgctgagattagaggcgtgagccaccacgctcagccttgccattgattcttaataacctgtttttatttcaccagtaacattaacttattgtaacagaacagatgagccaaaagaacaaacagctgttcaaatctgtacacatattaccagggctagactttctaaaaagtcaaaaaacaacagatgtggagaaaagggaatgcttatacactattggtgggaatgtaaattagtacaacctctatgaaaaacagcacggaaatttctcatggaactaaaaatagaactaccattctacccagcaatcccactactgggtatcttcttaaaggaaaataaatcattctatccaaaagatacctgcacttgtatatctattgcagcacaaattgagttaactatgtagtttcag

SEQ ID NO: 118 - DNA, 1709 bp, Homo sapiens; identical to SEQ ID NO: 117

SEQ ID NO: 119 - DNA, 3656 bp, Homo sapiens
taaagattaaatgtgacactgcttagagcccagtggcacagggcctaacaaatggtcaccattagttcacgcatccaagtctgagttccctacctgctctcctcgccttccagcagcttcctgtaggtggcaatctcaatgtcaagggccatcttaacattgagcaggtcttggtattcacgaaggtgacgagccatttcctccttcatattctgaatctcatcctgcaggcggccaatagtgtcttggtagttagcagcttcaacggcaaagttctcttccatttcacgcatctggcgttccagggactcattctgcagggggtgagaaagatgtctggtgttatttctcagaaaaacccagctgttcccagaaccatttacagaccttctgcaataatttccattagcggcaaatggcgaccactctaattttaggtggagaatgcgagtaccaagtccttcatattagaagcaatgatataggcaagctaaaaccttcaagagttccatgaagtcccttttgagtctgtcttgataactcattttctttgcattatgatatacatttttactcactcaacattttgttcaggtatcatcatgagcctagtcagcagaatgggtcattattttccctcttttactgcagggttggtactcacggttcctttaagggcatccacttcacaggtgagggactgcacctgtctccggtactcagtggactcctgctttgcctggcgcagggcgtcattgttccggttggcagccacactttcatattgctgacgtacgtcacgcagggcagccgtgaggtcaggcttggaaacatccacatcgatttggacatgctgttcctgaatctgagcctgcagctcctggatttcctgcaaaaagaacagacagacggtcagctctgccaaccgtgggggctgccttaccctcattcattccccgaaagtcactccactaacctcttcgtggagtttcttcaaaaaggcaatctcttcttgcaaagattccactttgcgttcaaggtcaagacgtgccagagacgcattgtcaacatcctattttgaacagagaaaagacaggacatggaggatgtaaaagtgtatggcttatctcatttatttgtcttagattaaccatctgaacctagtctccttactatagaaaagccgttgacacattttatgaccctggaataggtttataaatcattcagtgctataatatgctgtgctttctcctgctcactaatatattttaattgtgactgcttgtgttttactcaaggtggtgatcagacaattttaaaataaataaatgtccacacacatggtaaactgcactcaatcatgactgaatccacattttaccagtgatattttaaaattactttttaaggctggtcatggtggcttatgcctgtaatcccagcactttgggaggctgagacgggtggatcacttgaggtcaggagttcgagaccagcctagccaacatggcgaaaccccgtctctaccaaaaatacaaaaattagctgggtgtggtggcacatgcctgtagtcccagctacttgggaggttgaggcaggagaatttcttcaacccaggaggcagaggttgcagtgagccaacatagtgccactgcactccagcctgggcaacagagtgacactctgtctcaaaaaataaagtaattcatttaatttaattactttttaaatctagaaaatctatgccacaacatttttaagatttgttttgtaatttcatggaataacatgatgatagaggtggacaaattttcacaacttcatgtacacttgagtacatggagaacagaaacttgtgcttcaagagttttagcttttcttctccactcaaatcttttgaaacttatccttaggctccaaagcaaatatgtagtcatctggcatccattgtacaaggctagatttatattcaataacccaattcaggatatgcatgccaaagattcagttcaggaaaaaatggaaaagaaatgtaactctgaactgtatttgcttggctttctctggtggatttttcttctaaaactcctttgactcatcctgtaaaggcatgtctttttcacttgccactgtatcagttcagttagcctgtttcagaatgactggtcaagcttgcaaagaatgaaactacataaaggatttttgctgattcagccgtccttctatatttccatttaaaaagctcagcattccaaatcagaatatgtaatcttgcaactaagattttatttcctctcaaaaggatgcgtgaggattgcttatcttgtcagcaattatatttggagttcatagccttacggtcttaaactgttgagacttttctatcaccttagtggaaaaatgaatgaagagtgggtgacaaaaagatcagacttgatgaaaacattgatttttacttgttaagccctgaaaaatacataaaagatattttactaacctccaaagaaagatcaatgtggtattctatcacattgaagagaatgaggaattttgcttaatctcgaaacagaggatcttttgtattgatgttgttttatgttaactcactacactgcagaaaacatgacaggtatgataatcaaaaatgctcaaggactaaaatgaaccacacacattgctgtggttaaattaatttggtaaatgtatttcagtttcaaaatgttatactacactattcatctgagagtgctttgcagttaatcccagtaaatattccagggaatacaactataaactataatggggatcttctggcttttggattccaattttaagttaaaaattctgtaagtccatctaattttggtgaaaaaaaaaaaaaacacgcacaaaaaccctttagttaaaattcagtttttcagccttgggtttattactgttattattttttatggcaagagtgctaaagaacacaagaacccaatcaagaaaggacttttaaaatgtgaggtatgcttgtagctttaaaaactttttacattacctacttctcaagtctgggccagatattagataacggatgttagcaaatacttgtgtccaattagaaccgtgcttacatcattacatattcagtaagaatgtagcctgttgcaaagcttccctgggaatacaaagactcctattatttctgtccagagccaccacatttgccagaatgtctgtatctacattccatagtgaagcccatagaaaccattaataccccttagccaaggggacagatggctccttttcacccttattagatcacaaaatagttgtgcatagtgatacttccatcgaactttaatgacacaatagaatttgcaaagaagaaaagaaacttgctggctccattccagttggaaactaagttttcttatcttccaacacgttttccattttaaactgcagggcataattgcgctttttgtggccttgtaaaaattaagcaacttgactttggcaaaccacaatctaaaattgtaaccgttcgaaaccagaaggtcaatgtgttgcaaaactgtgcaacatttgggaaacaaagtaaaaagttaaaagatttttctttatgtcccaaggaactgcttagaaatcattcaaggatcgct

SEQ ID NO: 120 - DNA, 3656 bp, Homo sapiens; identical to SEQ ID NO: 119

SEQ ID NO: 121 - DNA, 3656 bp, Homo sapiens; identical to SEQ ID NO: 119

SEQ ID NO: 122 - DNA, 3656 bp, Homo sapiens; identical to SEQ ID NO: 119

SEQ ID NO: 123 - DNA, 3656 bp, Homo sapiens; identical to SEQ ID NO: 119

SEQ ID NO: 124 - DNA, 3656 bp, Homo sapiens; identical to SEQ ID NO: 119

SEQ ID NO: 125 - DNA, 3656 bp, Homo sapiens; identical to SEQ ID NO: 119

SEQ ID NO: 126 - DNA, 4480 bp, Homo sapiens
taaagattaaatgtgacactgcttagagcccagtggcacagggcctaacaaatggtcaccattagttcacgcatccaagtctgagttccctacctgctctcctcgccttccagcagcttcctgtaggtggcaatctcaatgtcaagggccatcttaacattgagcaggtcttggtattcacgaaggtgacgagccatttcctccttcatattctgaatctcatcctgcaggcggccaatagtgtcttggtagttagcagcttcaacggcaaagttctcttccatttcacgcatctggcgttccagggactcattctgcagggggtgagaaagatgtctggtgttatttctcagaaaaacccagctgttcccagaaccatttacagaccttctgcaataatttccattagcggcaaatggcgaccactctaattttaggtggagaatgcgagtaccaagtccttcatattagaagcaatgatataggcaagctaaaaccttcaagagttccatgaagtcccttttgagtctgtcttgataactcattttctttgcattatgatatacatttttactcactcaacattttgttcaggtatcatcatgagcctagtcagcagaatgggtcattattttccctcttttactgcagggttggtactcacggttcctttaagggcatccacttcacaggtgagggactgcacctgtctccggtactcagtggactcctgctttgcctggcgcagggcgtcattgttccggttggcagcctcagagaggtcagcaaactgttgggaagaaaacagaaatgtagattgctcacattcaagtcttttgactctcttagaaaaaaaaaatcatatttctcactgaatgtcttccagtataggtttaaatttctgttttgaaagccagggaaagagcagtggagtactgacattagtattttcagagttcactctacagtgctcatttcaacacagtggaggtcaaaggtatggcattggggtttacttggaggcaaggttagggggaagagagtctgctattctgaaggaggtgatgtggccaggcgtggtggcgcatgcctgtaatcccaacattttgggaggctgaggagggtggatcacctgaggtcaggagtttgagagaagcctggtcaacatggtgaaaccccatctctactaaaaatacaaaaattagccgggcatggtggtgcttgcctgtggttccagctcttagggggctgaggcaggagaatcacttgaacctgggaggcggaggttgcagtgtgccaagatgttgccactgcactccagcctgggcagtagagcaagactctgtctcataaataaataagaaaataaataaataaataaaggaggtgatgtgagtggtggggaggctgtggtggcaaacacaatatgagcaagaagtcaaagccagctttgcattggagctagaggatatttaggaatcacacacaggtatggggttttgagaacacaatgcttttctttggttgaagccgcactgatttgtttcctaccttggatttgtaccattcttctgcctcctgcaggttcttggcagccacactttcatattgctgacgtacgtcacgcagggcagccgtgaggtcaggcttggaaacatccacatcgatttggacatgctgttcctgaatctgagcctgcagctcctggatttcctgcaaaaagaacagacagacggtcagctctgccaaccgtgggggctgccttaccctcattcattccccgaaagtcactccactaacctcttcgtggagtttcttcaaaaaggcaatctcttcttgcaaagattccactttgcgttcaaggtcaagacgtgccagagacgcattgtcaacatcctattttgaacagagaaaagacaggacatggaggatgtaaaagtgtatggcttatctcatttatttgtcttagattaaccatctgaacctagtctccttactatagaaaagccgttgacacattttatgaccctggaataggtttataaatcattcagtgctataatatgctgtgctttctcctgctcactaatatattttaattgtgactgcttgtgttttactcaaggtggtgatcagacaattttaaaataaataaatgtccacacacatggtaaactgcactcaatcatgactgaatccacattttaccagtgatattttaaaattactttttaaggctggtcatggtggcttatgcctgtaatcccagcactttgggaggctgagacgggtggatcacttgaggtcaggagttcgagaccagcctagccaacatggcgaaaccccgtctctaccaaaaatacaaaaattagctgggtgtggtggcacatgcctgtagtcccagctacttgggaggttgaggcaggagaatttcttcaacccaggaggcagaggttgcagtgagccaacatagtgccactgcactccagcctgggcaacagagtgacactctgtctcaaaaaataaagtaattcatttaatttaattactttttaaatctagaaaatctatgccacaacatttttaagatttgttttgtaatttcatggaataacatgatgatagaggtggacaaattttcacaacttcatgtacacttgagtacatggagaacagaaacttgtgcttcaagagttttagcttttcttctccactcaaatcttttgaaacttatccttaggctccaaagcaaatatgtagtcatctggcatccattgtacaaggctagatttatattcaataacccaattcaggatatgcatgccaaagattcagttcaggaaaaaatggaaaagaaatgtaactctgaactgtatttgcttggctttctctggtggatttttcttctaaaactcctttgactcatcctgtaaaggcatgtctttttcacttgccactgtatcagttcagttagcctgtttcagaatgactggtcaagcttgcaaagaatgaaactacataaaggatttttgctgattcagccgtccttctatatttccatttaaaaagctcagcattccaaatcagaatatgtaatcttgcaactaagattttatttcctctcaaaaggatgcgtgaggattgcttatcttgtcagcaattatatttggagttcatagccttacggtcttaaactgttgagacttttctatcaccttagtggaaaaatgaatgaagagtgggtgacaaaaagatcagacttgatgaaaacattgatttttacttgttaagccctgaaaaatacataaaagatattttactaacctccaaagaaagatcaatgtggtattctatcacattgaagagaatgaggaattttgcttaatctcgaaacagaggatcttttgtattgatgttgttttatgttaactcactacactgcagaaaacatgacaggtatgataatcaaaaatgctcaaggactaaaatgaaccacacacattgctgtggttaaattaatttggtaaatgtatttcagtttcaaaatgttatactacactattcatctgagagtgctttgcagttaatcccagtaaatattccagggaatacaactataaactataatggggatcttctggcttttggattccaattttaagttaaaaattctgtaagtccatctaattttggtgaaaaaaaaaaaaaacacgcacaaaaaccctttagttaaaattcagtttttcagccttgggtttattactgttattattttttatggcaagagtgctaaagaacacaagaacccaatcaagaaaggacttttaaaatgtgaggtatgcttgtagctttaaaaactttttacattacctacttctcaagtctgggccagatattagataacggatgttagcaaatacttgtgtccaattagaaccgtgcttacatcattacatattcagtaagaatgtagcctgttgcaaagcttccctgggaatacaaagactcctattatttctgtccagagccaccacatttgccagaatgtctgtatctacattccatagtgaagcccatagaaaccattaataccccttagccaaggggacagatggctccttttcacccttattagatcacaaaatagttgtgcatagtgatacttccatcgaactttaatgacacaatagaatttgcaaagaagaaaagaaacttgctggctccattccagttggaaactaagttttcttatcttccaacacgttttccattttaaactgcagggcataattgcgctttttgtggccttgtaaaaattaagcaacttgactttggcaaaccacaatctaaaattgtaaccgttcgaaaccagaaggtcaatgtgttgcaaaactgtgcaacatttgggaaacaaagtaaaaagttaaaagatttttctttatgtcccaaggaactgcttagaaatcattcaaggatcgct

SEQ ID NO: 127 - DNA, 4480 bp, Homo sapiens; identical to SEQ ID NO: 126

SEQ ID NO: 128 - DNA, 4480 bp, Homo sapiens; identical to SEQ ID NO: 126

SEQ ID NO: 129 - DNA, 4480 bp, Homo sapiens; identical to SEQ ID NO: 126

SEQ ID NO: 130 - DNA, 4480 bp, Homo sapiens; identical to SEQ ID NO: 126

SEQ ID NO: 131 - DNA, 4480 bp, Homo sapiens; identical to SEQ ID NO: 126

SEQ ID NO: 132 - DNA, 1250 bp, Homo sapiens
tgtggagcaacaggcagttttaatgaatgcctgaaggcagaccttcaggccatttcaggccgaggcctaaaatggcatcagccccaaatgaggacgggcaggggttttacagtctcccgtaaacaggaagtgtttcagtctgtgtatctactgctacgtgatacccggtaggcctctctctgggtcttcagaacagctctctccccgcttctgctatcttgctgacgcacgctgatgacgtaagccgccttgcgccttgggactgggcctgagaagggaggagttattcaggcctccgccagcttctaggccctggggatggtctttcacctccctctttctgatctctttttcatgctcctccttgctccaaagaaaagccggatggcaaaagagcccagaacctattggaactgacaaaatcaagtcacggcgcctacaaagatgaggggcagattctggctgccttttaatttcgtccttcacctgatatctgtgccagagaatgtcttccaggagttctgctacagagaagagagtaacccccatccatcatggccaaagcacccagtcaggctccgctctggatccagcccgacaaatgcaacccttgaatagggtttgtgcaagcaaactggatgacgaccgaagaaaccctgtcgcttctgagaagacacccaatccaagaatgctggagtgcagtggcgcaatcacagctcaatgcagccttgaactcctggactcaagcaattcttctgcctcaacctgccaagtagttgggactacacatgtgccatcacactcagcttttgtctgtgatccatgtggaaaccattcttctgtgtatagtgtaaggctggagtgcaatggcgcgagctcagctgactgcaacctccacctcccaggtacaagcgattctcctgtctcagcctcccaagtagctcggatgacaggcatgcaccaccatgcctggctaattgttttgtatttagtagagacagggtttcaccatgttaggctgctcgcgaactcctgacctccagtgatccacctgccacagcctcccaaagtgctgggattacaggcgtgcaccactgcacccggcccctggatctaaacttatctttttgcttatagagatcccattgtgccagcaccatttgttgaaaactatcctcgctccaccatctggaagtcccaccctctaaatttgttaattaatttaattaagtttcatttgaaagaatctg

SEQ ID NO: 133 - DNA, 1250 bp, Homo sapiens; identical to SEQ ID NO: 132

SEQ ID NO: 134 - DNA, 10110 bp, Homo sapiens
tgtggagcaacaggcagttttaatgaatgcctgaaggcagaccttcaggccatttcaggccgaggcctaaaatggcatcagccccaaatgaggacgggcaggggttttacagtctcccgtaaacaggaagtgtttcagtctgtgtatctactgctacgtgatacccggtaggcctctctctgggtcttcagaacagctctctccccgcttctgctatcttgctgacgcacgctgatgacgtaagccgccttgcgccttgggactgggcctgagaagggaggagttattcaggcctccgccagcttctaggccctggggatggtctttcacctccctctttctgatctctttttcatgctcctccttgctccaaagaaaagccggatggcaaaagagcccagaacctattggaactgacaaaatcaagtcacggcgcctacaaagatgaggggcagattctggctgccttttaatttcgtccttcacctgatatctgtgccagagaatgataaaaatcataataaaggaaataatggaagaggagacttatgttactggggacatctaacataattattttcctgattcagtggcatggttcagtcttccaggagttctgctacagagaagagagtaacccccatccatcatggccaaagcacccagtcaggctccgctctggatccagcccgacaaatgcaacccttgaatagggtttgtgcaagcaaactggatgacgaccgaagaaaccctgtcgcttctgagaagacacccaatccaagaatgtgagttctggaaatgtcattaaatgtcagttatatacatgcttacgtgtccatattagctatgcaatcaccatcagcaagttctttttctcaaccaaaaaaagaagtaaatttctctgctaattaaatatttcctcaggccagccacagcatccagctgaaataagaattttaatgggaaaataccttatctgtattcagtgttgactccatgctaatttgagtgtttgagatggctattaggtgctgtaacattaaataatttacaaatacttaaatatttgaaccataactacagttttaaaataagtttactcatctaagagtgaagattctcttacaatctgcaagtctatagctcaacttttacatattcatgttttatattcattttcaggaaagcatcaggttcaatacctaggaactcctgtagagggtgttgtggaatcttctttaaaagaacaaaacaaggcaaaacaaagtttaatagggtagagcagccaggtgtggtgggtcatgcctgtaatctcagcaatttgggaggccaaggcaggatctcagcaatttgggaggcgaaggcaggcagatcacttgagcctaggagttcaagaccagcttgggcaacatagcaagaccctgcctataccaaaaaaaaaaagtgaacctaggagtatgaggctgcagtaagctgtggttgtaccagtgcactttgggaggccaaggtaggcgggtcttctgagatcgagagtttgagaccagcctgaccaacatggagaaaccccgtctctactaaaagtacaaaattagccggcatggtggtgcatgcctgtaatcccagctactcgggaggctgaggcgggagaattgcttgaactcaggaggcagaggttgtggtgagccaagatcgcgccattgcactccagcctggacaacaagagcgaaactccatcacaaacaaacaaacaataaacaaaaaccatagagtgatttctggccaacagagcaagaaagaagtgaaccaatgaaaaccggtccaagtctgggagtcaatatggaaaagctgcctaattaatgtggaagccccagggaaatgatataccatgaaaacctaacactacaaaaactagttgtcagacacatgtgagcagtgaacagaatcctaatatgctggtttaacattcaaaactggagagtgtttgtgtatcttctaaagactgtttggggtttatttgtggagttcagctgagtgtcatcagaacaaagattagtgcaaaaaatctttcagaaatcatgcccaaacatttgcatgcaccttaaataagaaatgaaatagcaagaagagtatgtcacaataaagtataaatagcaagtgatatgtctcatcgtactgagacagttttataaatgaggcaaaggccttgtcaaaaaataatgatgattttcaaaattctgaaacgcaaaggaggaaaactacttcattcagttaacaggaagcacacaagaatctccccatcaaccaagattttttttttctataacccacgctttgtaagacaataatagcaaaaactataaactagaatttgttgaaagaacaacttctagaatttgccctttatgtgctgttttaccattgtcatgtctgtctctggtatgacttcctcatctattagtagcctcctaataaatttgaacaaatgaatgaatgaataagagacaactaagcatgaggtattgcaagatggtaactcatccagggaaaattaaaacctggagtggatcagatggaaaaacaaaataagacactagaaaaaaatcaccaggagggtttcaaaccaaaagatcccctggttaaccttcagctaattataagatttaattaactagaaaaactcaatccttgtttattctatttaattgagattttaccatatttaaaatgatgttactcaagtgttctcattaatatttaatgaaagtgtgagagaattggctaaccaaatttactgtgcttaggtaaactgtaattaggaagggttagcagagcatcccaagggacctatcaatcacaaaatgaagcgatacaattacagatgaatttcaacaaggaaacacacaaaacagtgatcctcaaaaaagatggaataaaattacttgaatgtggtagtcggttctgagaaatgcaatcaatcacatgtcatttcagacaactcagaaggaataaccctacccaacagacttgaactctttgtgtgtgtgtgtgtgtgtgtgtctgtgtgtgtgatagaatttcactcttgtcgcccaggctggagtgcagtgcgatctcggctcactgcaacctctgcctcccaggttcaagcaattcttctgcctcaccctccctagtagctgagattataggtgcccaccaccacacccggctaattttgtatttttagtagagaaggggtttcaccatgttggccaggctggtctcgaactcctgacctcaggtgatcttcccacctgggcctcccaaagtgctgggattacaggcatgagccactgcacctggcccagacttgaactcttgattgcatgaaagtgtattaatcttctatctgcttattcccaatttcccagctgataaaatgccccactgttatttcacttaaatttggaataacctgcatctagttaagttggagctactttgtcttgttgcagattttcttttgctttgctgtcttcattctaacttggcagagcccaggtgctttgtctctatttgcctgcaagacctcttttccaagacatgtcaggtttctctctaaagtaccttccacctggaggatatctgttcttgttctttaattcctggccctatttcctattcatctgaaaaactaggctttgtgagcaggatcatgcatggcaatgagttctaatgagtttttaatgtttcacacttcatgatgaacatatatttgcatttcagaaaatgcttttaaggaatgtttttttttttctgccctcactcctaactcagttgcctttaagcaaaaccaaagagagccatggccagcctgttcaaatggctgcaatcatttaagcccctctcgctgcaccctggcccctcttgcctccctagcctgcccatgcttgcccctgtctcaacttctacccccactccagctgaagagatttgccattctcagctttcacctttggggatccctcttgaccatggttagcaattgctgtgaccatcctcacatcacagatttttgggcttctgtttcttaggacaatgcctgctctccctgctagcctatccctcatcccaggccctccaacctccagccactgcaactctagagccacatcctatcccattgactaacccaactgccaagccaagcccaatccccagacctggagctcagagaaattattaatccaatcaaaggcactaaagttgggattctgactctgaagcaggtaccaaattttggacagagaggggctcctgaaaccatactattcctgcattaagtgtctggcactaggcaggggatatgatgtgatctaacaaggccatgcactggaattaacctgcgtgagctccacttggctgccctctaaaggtcaatgcattgtttgagcctaggggagccagtcactgctacatcaatggctgcatcacggtatcctttttaggactaaacctgcattttcctaatattcaggtctgtagaaactttgactgcaagaattttacaggaatgggtaaatatctgtaagtacttaaaagtatatatggtaatatacaatatgatagaagaaataagacctaatgttagatagatcagcagggtaattatagtttacaaccatcttttgtacaattcaaaatagctacaagagaaaaaggtgagtgtttttagcataaagaaaagacaaatacttaatggatatcccaagtatactgatttgatatttacaaattatacaaatgtattaaattgtcatgtgtactccaaaactatgtacattattatgcatcaattaacaaaagataaaagtatgtatgaatcagtaagtacttctaaggacctgtaaatccatataagtgcacattagtataagagaactaaggagaatttgagatcagtgtttacacagtgctagcattttgttatctaaaacacctctttttcaactctatcaaagattgaatgcattttttaattcaaggaatataatattcaggatgattatttttattacagctgtgggctttttccttgggcattgaacgcttccatttagttcaactacttattatcttttcttctcctcttcttttttttttttgcttaactttctatttctttcccagtaataacatatattttctcaacttcttaaatctctttattagatacagtcgaatgtaatttggaatttacgagtcttatcacattctcattctgcttgagcaattcaagatataagaaaaacagactgtctacatttcttcagagttcctccaactattggcttaaaattcctgaaattaaaattatagttctttgacatcgcttctgtctaatcattgctgatacctggaaaacaccaaatggcttacttacacagtgtcccactctgaaatttctcacataaaggattgtcttacacagaaatactgaccattttgacaagggaatggccctagaattgggccagagctaaaaataagcagaataaacaattttgatattcttcttcaatggtcataaatctagttagcatgttatcatttacatattatgattttgttcatgatagttgtagtagaatggcctaaagaaatcaagatctgttttatcttctacattactttagttactgtaagactgataactcacattgtcgtttaccaagtatttccatttgttccttggaataatcctgtgaagtgggtattttttatcactagtttcatataatgaatatattactgttaatgtcaatacattctatttatccagctcacttattctagtattctctctgcagtgattctttaatctcattgagaagcccccatgcccaatacacgcctcctatcttcatacacgcctcctatcttcatttccctccttccccaactcacacccttgaaaacattcttatctctcttgtttctttttctgttgtccttgactggcaaatttggaggcatggatgtacccaactctttgccatttggggctacccccaactagccaaatactgctagagaaactctcctgaatgatttcactctaagttctatgaacttcaaatgggcatttaaggatacctggcagtcctactatgttttcctaataaatttcattttcctctttcaaaattgttatttattctcccgtctcctccaacctcccatatccccacctccacactcactctctgctgctgatgacctcacttcatactttattgaaaaaaatagaagcctgcagaggagcaacactttcatactgctcccactgtatctaaaaatctctaagtttctgtgcctgtcttagtcagcttgggctgccataacaaaataccataaaatgagtggcttaaacaacagaaatttttcatctcatattttgaagactcaaaatgttggcatcgttggtacctggtgagggctctcttcctggcttgcagacagctgcctgctggctgggtcctcacattgtcttttcttggtgcatgcatgagggagagagtgctagtgtctcttcctcttcttataaagacaccagccctatcaaattaaggggtagctctatgacctcatttaaatagaattatctccctaaagaccttatcttctaatatagtcacatttgagactgtggcttcaacatgaattttggggagacagaattcagtccttcagagtgcctgtgtttttcatcttaccatatgttacaacagaaaaaaatgtccctgctctcatcaaaaatcagtaacccccagtatgttctggctcctgcccgtctcactttcttaacattactgaccccctcatctcttccttctcttacataactagggttatccttctcacaagcacacaaacacgctcctcccttgactccataatccctctccatctcccaactcatttttctaccccctgtaagcaccacttctctaacaaattatctaaaattactgcttccccttcctcaacaatctattccctcatcagaagacttaaaactggctaatgtagcttctgggactcagaaaatgaaagcccaaaatatgacacttcagacttcaaactgagagcacatggagagcagcaaatgcagagaaggactttccccaaaggtccctccctacctaaacacaggattctcctaagatactcaatcattgtcaatcgcttccccagggtatctcaatgactgggagaagactgaagcctatcccaggaaaagaagactagaattgatgacacaccaggagtccagatgggctttgtctcagactaccatctgttcttcaggcccattcatcttccctaaaactcatttactcctcctctaaattgtctgcatcccacccttccccctccctgtgaagaagggtatataagcttctaaatcccattgggtcattggacactcaccttcctggaatgcacgcatacacataatatatgtgttagccttttctctcgttaagtgatctgttagtttatttctcagactcaaatatcagacatgcagagtggaaagaaagggctctctcacccaacatggctcatctcaagctcatcaaaagcccccatgttccaaattcaatggacgcctcacttgtcttttttttttttttttttttttttgagacagaatcctgctctgtcacccaggctggagtgcagtggcatgatatcggctcactgcaacctccacctcccaggtttatgcgattctcctgcctcagcctcccgagtaactgggattacaggtgcgccaccgtgctcagctaatttttttatttttagtagagacagggtttcaccatgttgcccaggctggtcttgaactcctgacctcaagtgatccaccggcctcagcctcccaaagggctgggattacagaggtgagccactgtactgggccgcacttatcttacttgatctttcaagaacacctgacccagtcaactgctcctcttccctgaaaaccacatcacactctcctggttttctttctgcatccctggctgctccctctgcctctcctttgctggcttctgcttctctttcaagcctctaaatgtgggaataccctagaacttgctcctagatccccttttcttctccacctatctccagagctaagtgagctcattctactctctggctttgagtcctatctctctggcgatgacacccagattgatatgtgcagttctgacctctcccttgagctccagactcatttatatggtcgaaatgcccatctgacatttccaattggacgtctaatagtcttgtcaaatgtagcatatccaaaacataacctttgacttccctcttttccagtcttccccatctctatggatggtaatgaactgctcaagccaaacatttatcattcggattcctgtccttctcttctctcctatacccgggcttttgacgattcagccgtaaatccatctacttctctttatcggtacttctattgcctcattcaaggcacatcagctcttgtctggatggaagccatggccccataagtagtctttctgcttcaattgcctgactgccacacattctctatgcagctatcagagtactcttttaaaaacttaaatcatacttgtcatacatgacatattgtcatgcccttgctcagaacccttctgaggcttcacttattattagaataaaactcatcctcaccaaggcttgcatcctacaacataacctgacttagtaggtctatttcctcctttgctctctgtattggtccatttacattgctgtaaataaatgcctgagactgggtagttcatcaggaaaagaggtttatttggctcacagttctgcaggctgtacacaaagcatcgtgccagcatctgcttctggtgagggattcaggaagcttataatcatggcgggatgtaaaggagagccagcacatcacatggatagagagagagagagaggagacagtgccaggctttttgaaacaaccagatcttgtgtgaactcagagaataagaactcactcattactgccgagacattcatgagggatctgcccccatgacccaaacacctctcactaggcccacttctaacactgaagctcacatttcaacatgagatttggaggggacaaccatccaaaccctatcaccctccatgatccattctttctgcttctcaaatatgccatgtttagggctgctgttcctctgccttgagcgttcctgttagtgcttcaggtcttaactcgaatgtcaacccctcagagtgacttttgctactccctatggaatgctcacctcccacccccgccatcagcatttatttcgacttctttcctaccacttagcacagtgagctccaggagggcaggcttttgtctggcatgctccctgcacattctccagcaccaagcacagacctggcacacaatgaatgttcactgaaagaatgaagttgatctcagactctccacccagctccaggctgccaaaataagcccctaattgccttccctgcttctccttttgttcctgccccatctgtctcctagggagaattgtctcagctagaccagtcctgggctcttcacacatcagagttagagagttgacagggaattaatagaagatagaacctgaaaggcttaggaggggtaagacttggagaaatctgttgtcagtcaaaaataataaagtacagaggtgtatgtgaggaggtaggggagggagtacaggaaggggaaagaaatctatatagtccaggtgtaagtgagaaagttctttcagcatttgtcaaacttgagtttgggagagggtgtgggaaataaataactgagaagagtaaatgggattgcagcatagatgaggattctgaattagggccactctgtcacccaggctggagtacagtagtgcgatcaaagctcactgcagcctggagctcctggtctcaagcaatcctcccacctcagccttccaagtagctgggactacaggcatgtgccaccaaactcagctaatttttttttgcatttttttgcag

SEQ ID NO: 135 - DNA, 10110 bp, Homo sapiens; identical to SEQ ID NO: 134

SEQ ID NO: 136 - DNA, 1205 bp, Homo sapiens
gtgatgttccctgccgacattcaggatattttgttggttgtttaactcttcaaaaacttgacataagggtctattgattgtggaggaactgatctccttctcatgggttctttgagctcctgtgtgggcataagtatatctttgttataatttgttccacctgtgcctgtcaatttctttccacttgcctcctcccgtgacattctggctcatgtttcttcataaagctctaagccagttattaataacagaccagtgagcctcctgatccaccaagaccatatggtgtttttcataaaagagagagatcattcccttgactttggacttcgcttattgaacccctggacagaatcaaggttgctaagagaccacctgtgctgaatacactttgttctggcaagagcagaaaactgagaagccgtgttacctaccactacctgggattaattcagggagcgggataattctggatatgactggtaaaaactggatattaatttctactactactcccaaaagtctagaagatgaaattgtgggaagacttctaaaaattttgtttgttatctttgttgacttaatttctattatatatgttgtgataacttcttagaaagctgacttcctttccatgtacatttcaaactgaattacagtgaataaaaatttgtattttaacttgttgagtgactcacattttatgacattgccaatttattctagaagccaacaggacactgcaatacaaacaacattgtgtattgtttagttctttatggtttatgaaacattcacatatactgaagtgaatttttttccccaaaaacatctatcctactgagtcatgaaacttctagatttttagccaggtgtggtggctcacacctgtaatcccagcactttgagaggcccaggtaggcggatcccttgagtgcaggagttcgatacgggcctgagcaacctgaagaaatcccatctctactaaaaataaaaattaaaaaaatttgacaggcatggtggtgcatgcctgtatagtcccagatactcatactcgggatgctgaggtgggagaatcgcctgagtccaggaaatcaagtttgcagtgagctgtgatcacaccactgcactccagcctgggtgaaagagagagacccagtctcaaaacaaaaacaaacaaacaaacaaacaacttctggattttt

SEQ ID NO: 137 - DNA, 1205 bp, Homo sapiens; identical to SEQ ID NO: 136

SEQ ID NO: 138 - DNA, 9975 bp, Homo sapiens
cgtgaacccaggaggtggagcttgcagtgagccgagattgcgccactgcactccagcctgagcgacagactgagactccgtctcaaaaaaaaaaaaaaaaattagctgggcatggtggcaggcgcctgaaatcccagctgctccagaggctgaagcaggagaatcgcttgaacccaggaggcggaggttgcagtgagctaagattgcgccattgcactccagcctgggcaagaaaagtgaaactccgtctcaaataaataagtaattaattaattaattagagaaaagtccacttacggaaaaaggtcagtcctcagacgggggatcttgttggattcacctggaagtagttcgaacattggtcctttttcttcaaggcagtttgcagaattactgtctggattgcagcgcacccattggtacctggctctccgcgtaggataacctgcccgaggaacccacattgttactaagtatctactacacagcttctaatcactctgtcctaagaagtttttatttttatttttttttcgagacagggtctcagtcggctgcccaagctggagtgcagtactgtgatcatagctcactgcaaccttgaactcctgggctcaagccattctcccaccccagcctcttgagtagctgggaatacaggggcaccacaacgcccagctagttttgttttgtttttgtttgtttgtttgttttttggagagatgggggtctcactatgtgcccaggctggtctcaaacacctgggctcaagcagtcctcctgccttggcctcccagtgtgctgagattacaggaatgagcaactgcaccccacccgccctaagaaggttttaactaaatagattctaaatttggtaaaaggcaaaatgtagacagattttgtgcccattcatataacagcagcacccactatgtgccaacattttatataaattgtccttcttacaacactccaaaaagtagcagtttaaagttagaataggctttggaatcagctgcctggagtgaagtcccaggtctgctgactagttatggaaccttaacttctctgaaccctcactgtaatatgaagatactaatagtgtcataagcctatcacaaaaattaaatgagaaaatacacttagagaatttaacacagtgccaggcacacagtaagcacttgataatattaactgttgttacttttgtactattatctcaattttacacaaaagaaaattgcagccacacaggcgctaggattccaacccacatctgaccccaaagcccacatcttttcatagagatgagtcaaatcaggttcagaaaggggaaggaacacactgtggagtacccgtggtatcacagaattctagttcttgtgttttagggccatacagtatccttaggaatgaaaagtagataacaatttgtcctgtgtctttgcactcagatttcacaagaacaagtctcctctattcacagagcaccaggcagcttggaatatctgagtctcagcttcttctgaatttcatttctatggaaaaggctccaaatctgatattatgaggttatataggagatttatttatgtatttattttattttattttattgagagagagtcttgctgtgtcgcccaggctggagtgcactgtcacgatctcggctcatggcaacctccacctcccgggttcaagcaatttttctgcctcaccctctggagtaactgggattacaggcactcaccaccacgcccagctaatttttagtatttttagtagagatggggttttgccatgttgcccaagctggtctcaaactcctgagctcaggcaatccacccaccttggcctctgaaaatgtgaggattacaggcgtgagccaccatgcccggcctatataggaggttctttgttagctaatgaaataaaatcttccttcctcagtttagcaaagacaaaggcctggtggtgagaaatacttcaccgcccttcaaaaagttcatctcctccccactccaagcatatactttattctaatgagtgcaactaataattacctagcaagaaggagcatgtctaggattcttgaaagtcaggaagggtagttttaaagctcaccacaaaataatggaaaacattcagataaattacaaggcatcaactcataagagaatactaaccaaatgaagaaaagtacttttttttttttttttttgagatgaagtctcgctctgttgccctggctgggatgcagtggcacaatctcggctcactgcaacctctgcctcccaggttcaagcgattctcctgcctcagcctcccgagtagctgggatgacaggtgcccacaatcatatccagctaatttttgtatttttagtagggatggggtttcaccatgttggccaggctggtctcgaactcctgacctcaggtgatccacccgcctcagtctcccaaagtgctgggattacaggtgtgagccaccacacccggccgaaagtactttttatggaaaagacaatgtggcattgtagaaaaacctatacttaaaaatgagtgagagggtgagaggcgggtaggcaaaaacttttttttttaataaaataaaaataaaaattaggttgggtgtggtagctcatgcctgaaatcccagcactttgggagactgaggtgggaggatcacttgagcccaggagttcaatacaggctgggcaacatagagagactcccatttctaccaaaaaagagaaaaaagattttaaaaattagctggatgtggtagcacacatctgcagtcccagctacttaggaggctgaggcaggaagattgcttgagactgggaggtcacagtgagccaagattgcacggctgcacttcagcctgggtgacacagcgagactgtctcagaagaaaaaagtttatttacaaaattaaaaataaataaaaataactgagaaaatcagaatacctctttgcatgaataatagtttcaattatataaacagacatggggggaaaaatggaaggaaatacacaaaaataactggaggtagaatctttggtgattttttttctcattttgttttctaaattgctataataaacaatattcctctaaaaacataaacattaaacactttaatatagaaaacagtaaatattctcccattggattttctttcttttctttgtaactatatattattctatcataatctttcctatgattcctgagtatagcttacaatgtctggtctgggagagctgtttgtccaaaatgagctaactctgccactgcctggaggctggggataaggcaggcaaaatgacctttcaatgtctgccccttactggctgtgtgatcttggccaacttaaacttcctgtgcctcaattttctcatctgtaggatggggcagtaatagagttaataaggagatacaaatgttaggttctcagagtagtacctagcacatagtcagagctcttcattgctagttcctgtcatgaaaaggaggaggacaacaatgacctatgatctccgagagtgaacatcttataaatttaaattcaaattcccattctaccatttagtatctctaggagtctcaatttatggactttctttcttttcttttttatttttccttattttgagatagagtctggctctgttgcccaggctggagtgctgtggcacatctcagctcactgcaccctccgccacctgggtttaagctattctcctgcctcagcctcccgactagctggaattacaggcacgtgccaccatgcccggctaattttttgtagttttaatagagacggggttagccaggaaggtctcgatctcctgacctcgtgatcccctcgccttggcctcccaaagtgctgagattataggcgtgagccaccgcgcccggcctggtttcactctttctcttttgattctttcctgaggcagcattagtttagcatctaattgctacttagacgtctcttcctgtaggtgaaataaaaatccagcatcttctccagcagagggcggtgtcttcacaccttgtactgtctagaccaactttgtccaatagaaacacaaagcaaaccacatagggagttttaaatgttccagcggccatatttttaaaagtaaaaagaaacaggtgaaattaattttatttaacctaacatattcaaatattgtcctttaacatatcatcaatgtaaaagttattactgggatattttgcattcttttcttcatactaagggttccaaatcttgtatattttgcattcacagcctgtcccaatttggccttgccacatttcaagtgttcagtagccacaagtgacttgtggctaccgtactggacagagcaggcctaggcagtctcttctgcaagccgctgatgcactgagtatcaagctgagaaaatgtttgctcacacaggaagctaaacagaaaaataatgcttaatgagaaagcatccaggtgaaagaccacatcttttcaccagcatgacaaatacaactgtagcatattagtaaaaaatatttctagaatacaaaattcccccagagttcagaatctcagctaattaaaattcgtaacgaaggctttcttttgggggatgatgaaaatgttctagaagcaattatagtgatggttgcatgactctgtgaatatactaaaaaacattgaacacttttttttttttttttttggagacagagtcttgctccgtcatccaggctggagtgcagtggtgcaatctcagctcactgcaacctccacctcccaggttcaagtgattctcctgcctcagcctcccaagtagctggaattacaggtgcacaccaccatgcccagttaatttttgtatttttagtagagacaagttctcaccatgttggccaggctagtctcaaactcttgacctcaagtgatccacttgccttggcctcccaaaatgctgggattacaggcatgagccaccacacctggcctaatcactgaattgaacacttttaatgggtgaactgtatggtatgtgaacactatctcaacaaagctattttaaaattttataaagaaatcaaaagtagaagggatcccactccaaaagcctatctaatttggggccgatgatgttaaatgtactttaaaataaagaacaagttacagacactaaattcttgacatagctattcaagggtgttggcaggatgtgaaaatttacagttccagcccctgaggttgtgagagtatcttgactctatcttgcttgagataaatgtcttgtgattatagtggctatgctcatggatagaaatgttatcttcctaaaaggtccacttatgggatttgttggttaattgtgtagtggattccaagggaaagaatggtttttatttgaatcctatccctcactgcccacctcccccaccaccctgagtcctgctttaccaaaatactttctatgagtaaatgttaccaaagcaaacaactttctccaatagtccatacctttttatattatggtactaacttttccctcaacataatcacaatatactaatttcttttttttttcttttcttttctttttctttttttttttttttttttttttttttttgagacagagtctcagtctatcgcccaggctggagtgcagtggcatgatcttggctcactgcaacctccatctccctggttcaagtgattctcctgcctcagcctctcgagtagctgggattacaggtgcatgccactatgcctggctaatttttgtatttttagtagagatgggggtttcaccatgttggccaggctggtcttgaactcctgacctcaagtgatccacactcctcggtctcccaaagtgctaagactacagacgtgagccactgtaccgagcctaatttcctattcttaatggaaacttactgcaggcatgttagagaaacttaagcagcaactaccatgaaggggaaaagaagaccatttgatttattcaaaatggtagcattatctaagccggagttacttcctcctggtctatcaattccacaagatggataagcttcccccactcttgcatggtttgacaagctataaaaagctcctaagtttactttcaatttctccctcaactcagtgggaaacgttatagcaagggctacggtcaaaggattttttgtttgtttgtttaaataaagaaaacctctgatccatgagctgcagtagaaagttaattctggccttgaaatcagacgaccagttcagccgttaattagttgtaatgggtcttgggcaagactcacaaattttttgcaagaggttaatgtatagagcaaatgagatgagaaatgtcagatccagttttctcctctataattggtgctaattcctcatcacagggaatgtgatgatgattaccagagaatggatgtgaaatcactttacaaagagcagcacaaggagtggatcagtatcattcctgtgagctaggagacagtatacagtggacacatggcgggcctggcctccttggctgcacctgttcatggatattccattttttttctttatgggtgtcattggaaaagagaggcaataaaagtggaagattcacaggcctcatcaaatcccctggagccctacattaaatagattagtcatctgtgctctccagagttacacatccccaaatttccatttctttgtgcttggtaaacacaatcttaccccacatctttacttgggtttgacttataataaaaatataccaccaccaaattcatatgttccagttctaacccacagaatctcacaatgtgaaattgttcagaaatagggtcattgcagatataggtagttaagatgaggccattagggtggccctgatccaatgcctggtgaccctctaagaagatggtattaagacacggatgcatggaggaaaggccatgtgcagacaagggagaaggcgccatctataagccaaggagagaggcctcagaatgcgatcgaccctgccagcaccttgatcttggactcccatctccagaactgtgaggaaatacatttctgttatttaagccactcagtccgtggtactttgttatggcaacccgagcaaaccactatagtgacctgaaatggttttgaatatgctcagtaaaagcaagccaaaagcctagttgatttcatctgccaaaccaacgggctagataaacactttttataagacaggaagaatgttgtcgaatcatatctggcattgcgtggaggtgtgaggaaatggtgtcacgactcttcacatcacagccttgtgccgcagtcactcacatgtgcagccagtgggggacatctatttccctgcatgctcagatgtgggcacaagcccttgagcccgatactgagagccttttttcggaaacaccctagtttgtcagtttctcccttgtctctttctatggtttccttttctaacaaagagctaaacctacgaggtcatgacataaatgctagtattctatacaatttcatgatgaattattttctttccttctctttctttctttcctttctttctctctctctctctttctttctttctgacagagtcttgcactgtcacctaggctgtagtacagtggtgcaatctcagctcactgcaacctccacctcccaggttcaagcaattctcctgcctcagcctcctgagtagctgggatgacaggtgtgtgccaccatgcccggctaatttttttgtatttttggtagagacgggatttcactatgttggccaggctggtctcaaactcctgacctcatgatctgcctaccttggcctctcaaagtgctgggattacaggcgtgagccaccatgcccggccttcttcatttctttctaatgaatattatacaaggaacgtttttgttttcattctagttttccttaatgaatcttagtgggaaattcatgtttctgggaaattttgacaacataaagacttacatatctctggttggggtatgcccagcaccatctggccattcaagactgtactaaagtatgggcctcattactctcgatcttgtcagaccacttggctattcgggaattatttcatcaagctgaagatattccctaaaagatcccagtgaagcctgttccctacaattgacaatgttttatattttaaaaatacataaattaataacgttccagaaacattacttgctcttttttcagcattagcataactagaagaaaatgattttataaatttccaacataaaatgaatgtctctgcgatcatctgtaagatttcatctccaccggaagtaagatcatgacaaccaaaagtcgctttgacgaaacaaatctaggacatgtgtgtcattgtgactcaacatttcccttaccatttggcggaacctagtgtttttctactataggttcagccatctctctatcaagccatgacctccgtcttatttagacatgattccttatttgccaaagaataacaaattgtatttttcttacaagcctatcattttcattgtcttagtcattacaggttttaagttgtttcagtctgactaaacaacactaaatggtagataaacctaggaagatatttccgaatatgatgcttctctgagcaagagcacaaataccaaattatttggccttctctttaaaatctgagaggttttacatgaactatgtctaaccataattgagttttcagtaagaaccaagtttatctttaaaaaaaaaaaaaagaaaagaaaatacacacagtcagattcaccccaattggaatataacgtctcccagtgttaaaataacaatgacaccgtcacagcgcactaaaacttggggctgatgtagacacttaggggtaggcagacaccccccaacagtcaaaggtgccatctcctccatgcaacaggcacaggagtcattttctagattccttttttgagcttttaaaatttataaacctcacattttcatcccaaaatagcacatttcaatcattgtaagagtttacaagactgcacacgccacagagtttaatttttcttggtaccaaacttaacagaactcatattaaagggttcagcgaccccaaatccttcttctttgcctcctttctcacaatattatacattctatgccttaaaatgaatataatgacttgcatggaccacagggcttacagagaagatggctggggaacaagactcctgagtcttaccttgaactgaggattccagaaccaggatgagggcaagagccaggacaagccgactgcatttgagtagcttctgcatcatgaccaacttagtctagctctcccagctgcacgccaacttcttgattaggaaatgtagcagggtgctctctgtcccttttagaaaatgttccaaaacctcaaaccctgcccagaacacacgtcacaatttcctgaacaaatagaaagacatccacatcaaaacccagaaagaaagggggtggggggaacacagtaaaataactattcatacccattatgaaactgtactggactccccccaggcctgctttttcaaaagttttgttgtttgccacttgcctgcaagacatttttttttcccaccgaaacagtagaatcagcatttgggacagtttgtttttcctttcttcaggtaacaatctaaacactagattgctaatattaagaatctgctgcattttttatgagataagggatctaggtgctgccttttcgtcaccaagcactttcaacataaaacattctcttcattttctttttcaccggggagtaacatacctcactgagccaagctcgtgaagtgaaacttcaaagctgagctctaaccttcaagaatgagttgtcggatttcagatgaacagtttcttcttcttctttttcttctt

SEQ ID NO: 139 - DNA, 9975 bp, Homo sapiens; identical to SEQ ID NO: 138

SEQ ID NO: 140 - DNA, 9975 bp, Homo sapiens; identical to SEQ ID NO: 138

SEQ ID NO: 141 - DNA, 1602 bp, Homo sapiens
cctacatctttctcccgtgctggatgctttctgccctcgaacatcagactagaagttcttcggttttggaactcggactggctctccttgctcctcagccagcagaaggcctattgtgggaccttgtgatcgtagttgaagtgatggaagtccttcctgtggacagccctgggaaagcaggtaagcgcttctgtgaccaagaaagttgtaacgacagtggagtccagcatgtgtgtgggtgtgtctgtcctctttaaattgctaccgctgagagtcccaggccccagccacgtcagcctgagatggggttctccactggggatcccacccactcaagctctgctggccccttctccagcaaactctagaggagaactcactccctttgggggagacaggctgaagcataagctgacccaggtcagagagcagatctccaaaccacagccgctcccatgctctggggaagctgggagttgactgcagaagactccaggtctgggactctgatcttcctgggggcagtagcccaagctgctgggctggcttagggtccatctctgccaaccttcctccccctggagcaccaggacccacctgcaggcaggcctatcccatctgcactcagcaggggaagctgtcctctgcccttccaacagcagaacctggcactcaggccaaaccctgctcacagtgcaggtgtggggcaaaatgaggtctcttaagtgctgatgggcaaatggcctgggtcccatcctgaagtggaatccccaacggaatacaatggatggagcttcccatgcctggtggtgactcactgtctccacattacacatacctatttatacacaaacacaccacaagtgtgcccatgtgacattgcccaccccacacacacccaaacacagacacagcctatacatcacacctcctgagttacaaaaggcacaaccctcctcaaacacacatccatcctccggcacacacccagtccatgcctcgcccccacacacacctgacaccccagtgcaacaccacacccaccctcccctccctgcaaactcccacctccgcccacctgcttaatacacattctcaccccccacacactccttaatacatactctcacacccacaagcctgccttcttggagaagtgagccgagccgtgcagcgccgcgaagggcatccccgaagaccgggaggaacgccgcggggacctgtggcttagcgcgctccgcccgggcttgtctgcccgcgggggcgcagcggctgaggcggctccgggccggagttccaatcaagcgccacccaactcccagtcgggggccgaggccagcgccgggatgccagcttcccccaaaaagatcctgcctcagggaaatgcatggagccggcggaaaagcccgcggcgcccccggcggatcgcagaccctaagggggcgggaggtggcgccccagtcccaacctcttgagccaacccagtgggtgggaagtgcccttaccctaggccttccgcaaagtgttctctccttgtattattctaattacggtatttttaatttccttaaaaaaataagaaacagaaaagcacagaacgca

SEQ ID NO: 142 - DNA, 1602 bp, Homo sapiens; identical to SEQ ID NO: 141

SEQ ID NO: 143 - DNA, 915 bp, Homo sapiens
ctatacatcacacctcctgagttacaaaaggcacaaccctcctcaaacacacatccatcctccggcacacacccagtccatgcctcgcccccacacacacctgacaccccagtgcaacaccacacccaccctcccctccctgcaaactcccacctccgcccacctgcttaatacacattctcaccccccacacactccttaatacatactctcacacccacaagcctgccttcttggagaagtgagccgagccgtgcagcgccgcgaaggggtaagttgcaagcactgggggcagcctgttctgggaggtgagaaggagggcggctccgtgcactcactcgctaggcggtggcgttagagctcccggggctccgcagaccgatttagctcggctggggagggaggtggagatggggactgggggtgggggacgcaggagagggtagaatccagccccacaagcggcggcgatgctaatcaggccgctaagatggaaaagcatccccgaagaccgggaggaacgccgcggggacctgtggcttagcgcgctccgcccgggcttgtctgcccgcgggggcgcagcggctgaggcggctccgggccggagttccaatcaagcgccacccaactcccagtcgggggccgaggccagcgccgggatgccagcttcccccaaaaagatcctgcctcagggaaatgcatggagccggcggaaaagcccgcggcgcccccggcggatcgcagaccctaagggggcgggaggtggcgccccagtcccaacctcttgagccaacccagtgggtgggaagtgcccttaccctaggccttccgcaaagtgttctctccttgtattattctaattacggtatttttaatttccttaaaaaaataagaaacagaaaagcacagaacgca

SEQ ID NO: 144 - DNA, 915 bp, Homo sapiens; identical to SEQ ID NO: 143

SEQ ID NO: 145 - DNA, 1647 bp, Homo sapiens
gtgctgggatcacaggcatgagccactgcacccagcctgaaggtctgtcttccctcttgttcttttctgcaaaaggtcaaacagggtaagcaaactttctgtaatttatgaagatcatcttttattaaaggactaaatgaaaaaagaacaactttggcaataaaattcagcctaattacagcttttcttggccgcatccttagatgtcagtatattaagtgtagaccctagttgttgaagcatctaacatatatctatctatataggtagatatatagatataggtatagataatattaaactgtggaacttctctagtgataactcactaatacattacaactagagtagccctaaggtccaaggtattctttcctgtcccactgccccagaaagagctaatggtctccctgctcattagactgtatgttcaaaccacagcaacagaagggtttggctgcatccccaaatctgactaagctttttttttttttttttttttgggatggagtttcgctcgtcacccaggctggagtgcaatggtgcgatctcagctcactgcaacctctgcctcccaggttcaagcaattctcctgcctcagcctcccaagtagctgggattacaggtgtgagccaccgtgcccagctctgactaagcttttatttagccagccacttgtggcttaaacctcctcatccccttgagtgggctccatcaaaaagtagtctcaggctgggcacggggctcactcctgtaatcccagcactttgggaggccgaggcgggtgggtcacttgaggtcaggagtccgagaccagcctggccaacatggcaaaaccctgtttctactaaaacaaatacaaaaaaattagccaggcatggtagtgcgtgcctgtaatcccaccactctggaggctgagacacgagaattgcttgaacctgggaggcagaggctgcagtgagccaaaatcacgccactgcactctagccttggtgatggagtgagactctgcctcaaaaaaaaaaaaaaggtgggggcacctgggcacggtggctcacgcctgtaatcccaggactttgggaggccaaggcaagtgaatcacctgagctcaggagttcgacaccagactggccaacatggtgaaaccccatctctactaaaaatacaaaaattagctagatgtggtgacgggcgcctgtaatccccactactagggaggctgaggcaggagaatcacttgaactgggaatgcagagattctagtaagctgagatcgcgccactgcactccagcctgggcaacaagagcgaaactccatctcaaaaaaaaaaaaaaagtcatagggaagcgtattagtaatacagtgaatgaagctggactattcattgcacttaaagtgaaaagtgctacagattatgaaataattactaaaacatacagccacactgtttccataactgcagaagatgggactttgtagcatataaaaacaataaaatagagggaacacttcattaggcaaacaaaagaattaggacctataaaaatttgcactttttttcctggatttttttttttttttgtcaacctactcaccaaaaaatttgcactttgactcatattggcctattttaacatttcaaaat

SEQ ID NO: 146 - DNA, 1647 bp, Homo sapiens; identical to SEQ ID NO: 145

SEQ ID NO: 147 - DNA, 1283 bp, Homo sapiens
ctggccttctcgcggctttcccccgatatctctctttattccagctgcctgaaactcggtcccacgaatggcaggcagcgtccaaaattcaaccccgtaaagccagcaccagccaataaagcgcacggatggaggccacgtgacagcagtgggccggccctccggctgagccctgatctctatggtttccgcggctcgctagaaggagtgtggtccaccggaggactccctacattcttcctccattacctcactgcctccggtggctgctgggataccggaggactcgggtcccggctcgactcagtcctccagccgcccggggaatacctctagttcttcccggccgccgccgccgccgccgccccgccgcttcctcctccgcctgccggcctccttcgccccgtcccgtccgcgcagcgcgtccggcccgcccgcaggccagcttctctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgcactgagaaaacttcagagacctaaactttttccagagaagagaagctttactggtgttccagccctaagaaacctttgttcaagaaaacggcagatgctctgttgaatccactggagattgttctgatactaaggacaagtatcaaccatctttcctgtgaaaaattccctctcgtactttagttctgtggatccaaaatttatagcattcttctaccaccacaggggctcatatgacattaacagacaagacacttttcagaaagacaggtaagtcatttgttaaaatctcactactgttgtttaacagaaacatatatatgcatgtatatgtgtgtactgtatggaaaaagtggaattagagtttatctagaaaagaaaaaattacctcatctaagtgcagaaatgaataatacttaaaccataccatacaattctctatcatatttccacagataagtcaaaaatttaaaaaatcttattgttcatgcataaatgcagaaaacaatacctctagtatatgtttgtgttctattgtactttcacagaaggtgtttgatacttaatactgtgtttattaagaaaaatctttgcaatggttatggaattaaaatttcatgtaaaaatgattatgtagatcaagaaaagttgcaattttctggattcctgatattttaaataaaagtagtttccaaa

SEQ ID NO: 148 - DNA, 17882 bp, Homo sapiens
ggaagctgtgcagacaagtgactgtctcacagcattcccctgtcacgtaccgcctgcttgctcaaatcaatcacgaccctttcatgtgaaatctttagtgttgtgagcccttaaaaggaacagaaattgtgtattcagggagctcagatttgaaggcagtagcttgccgatgctcccagctgaataaagccctgccttctacaactcagtgtctgagaggttttgtctgcggctcaccctgctacatttcttggttccctgactgggaaacgaggtgactgacggatggccgaggcagccccttaggcggcttaggcctgccctgtggagcatccgtgaggggaactccggccagcctgagtgacgtgatccaaagagcgctcccgggtaggcaattgccccaatggaacgccttgccagagcagcgtgtagcaggcccccacggaagattaacacagtggctgaacaccaggaaggaactggcacttggagtccggacatctacaacttggtaagactagtctttggaacttgccccactccatctgagtggaagcgtggcctgatcacccacagtgtgcctgtattggcattttgttctggttttgacttggcttgagttggtaagactagtctttggaacttgccctactccatctgggtggaaacatggcctgatcacccacggcatgcctgcattgacacttttgttctggttttgacttgacttagattgtgtgatactttggttttagttttgacctggcttggatttctggatactctgattttggtttggtgtaaactgcaaaagtgtgtgtgtgccctttttacctgttttttgttttgtggtgtgtgtgtggtgtgaacatggtgttttgtcttgaagaagcatgggtcaggcaaaaataagcccaccccactaggaactatgttaaaaaaaataaaaatttcaagaaagaatttaagggagattacgatgttactgtgacaccaggaaaacttagaactttgtgtgaaatagactggccagcattagagtgggttggtcatcagaaagaagcctggacaggtcccttgtttcaacggtatgacacagggcaacctgtaagccaaggcacccagaccagtttccatacatagacagttacagctggttttagacccccttcccctccacagtagttaaaagaacagcagcataagcagttgggagaggcaaggaaagaccagcagagaaaaaaaaaaaagaggccatctataccaattctaagttaatttagactaaacaaggtcttattaatagcaaaggataattgaaatcccaaacttacaaggttttcaacaaaagtgaagtttgctaaaagttaacagcataacatatattgtggtaacttctaatcttgtggccttagagagtctagtccaaagacataaagaaagttcgctttaaaaaaaggaatggttatcttcaaaaaaaaaagcgggggggaggcagaatttatgtaaaaagagtgttatatggtaaattcttgtcctgaaataaattaactggttgtttaaagaaaaaaaatgtttgtaataagtcagaaagttgaggcatgttgaagaattgtcggcgaaagttgtgaaagaaaaaatgttataaaaaaatttatgcaaaaaagcctcctgagtactactattgaagaaacagtttatgtgcaaggtgtataaaaatagtaaaatatacctttggtaaaaagattataaggaggcataagaatgtggatttttaccaacattaaaaggttaaaaaattattgttttgaaagtttaagcaagttttaaaactttaattgtaaagaaaattctgtgtataaacatattagctaaagttaaaaaggtatcatccagcttttctgtgaactggacattaaagtaaaaatgcaacaggtttttcttaaagcatcaacctgctctttaacaaaaattataaaaggttaaaaagagtctataaaatctcaccttatggtcaaacatgaaaaattggataaatatatctacaaggttttattaaaattaagtttaacattaataacacactaatataaaggtaaaatttagcttatctggtataaaaatcatacaagaagcattattaaatataaaatggtgtttaactttctttggtctaaaaactaataaaaataggtactaaaggaaacattccttttactagaggatcatagaagttaaagacttaaaacaaactttggaaattaagacagcataccaagatgcaaatgcctggttgaaatggatcaaatattccatctgcacattaaacaaaagcaattgttatgcttgtgcacatggcaggccagaggccctgattgtcccccttccactaaggtggtcctccagtcgaccaggcgtgggctgcatggtagctgttttccaggattctacagcctggagtaataagtcatgccaagctctctctgctatatcctgaagtccctgagggtcagcccccgaaggccatccagcttctgtctcccaacgctaagttcacttcttgtctctcgtggcagggaggagacttagcattccttggagacctgaagggatgcagtgagcttaagaattttcaagagcttatcaatcagtcagcccttgttcatccccgagtggatgtgtggtggtattgtggtggacctttactgggcactctgctgaataactagagtggcacttgtgctttagtccatttggctatcccttttaccctggcacttcatcaaccagaggaagaaaaaaataaaataaaataaaaatcataaagtgagagaagccccttataggtctttcaactctcacatctatttagatgcaattgaagccccgcaaggaataccagatcaatttaaagcttgaaatcaaatagttacaagatttaaatcaatatcttggtagatgacagtcaataaaaatgcagattagataaactacatctattacaaccaacagcaatgagcttttcatgaatttaaaagaaaaaattgtgttggccccagccctgaggctacctgacctgatgaaactctttacactctatgtgtcagaaagagaaaaaatgatagttggagttttaacccagactgtagggccctggccaaggccagtggcctatctctcaaaacaactgatggggtttccaaaggctggcccccatgtgcaagggccctggcagcaatggccctgttagtacaagaagcaaataagctaactcttaggcaaaacctaaagtcctcgtatgctgtggtgattttaataaataccaaaggacaccattagctaatgaatgctagactaactagataccaaagcttgctctgtgaaaatccccgcataaccattgaagtttgcaacaccctaaactccgccaccttgctcccggtatcagagagcccagttaaacataactgtgtagaagtattggactcagtttattctcgtaggcccaaccaccgagaccacccttaaacatcagtagactgggagctgtacgtggatgggagcagctttgccaacccttgcaaagtgactctgaagaagacgacaagccttgttccggtcacacccggaagctgactggttcacgcatggccgaagcatgaggaaactcatcgcgggaataattttccttaaaatttggacttgtacagtaaggacttcaactgaccttatgctaagctgcctgatcagtggacaggtagctgtgtaattggacaggtagctgtgtaattggcaccattaagccatctttcttcttactgccaataaaaacaggtgaacttctaggcttcctagtctatgcttcccgtgaaaaatgaagcatagccataggtgattagaaaataatgaatggccccctgaaagaatcatacaatactatagacccaccacttaggcacaagatggctcatgaggatatcgaacccccatctacatgctcaaccgaatcatacagttacaagcggttttagaaattattactaataaaaccggtcaagccttgactgttcttgcccggcaagagactctgatgagaaattttatctatcaaaatatactagctcttgactacttgctagcagctgaaggagaagtttgtaaaaaatttaaccttactaattgttgtctacacataaatgattaagggcaagtagttaaaaatatagttaaagatataacaaaactggcacatgtacccatgcaagtgtggcatgggctcaatccgggagccatgtttgcaaattggttcccagcaatgaaaaaatttaaaactcttataataagagtaataatagtaatagaaacctgcttactgctcctttgtctgatacctgtatttctccaaatgataaaaaactttgtcacgaccttagttcaccaaaatgctttagcagaagcatactatataaatcactatcaatctattgcacaaaaagacataagtagcaaaaataagactcagaactcccactaataaaaactgagagtctcaaaggggggaaatgagggaagagagagagaccctctcatattgttttatattgttttatactcagtacctcttttaagaaaaagtgacaaggaagtaaaaccaaagacaggcagcctggtgccaggcctgaaaccaggcctgggcctgtctggcctaaacccagtagttaaaaatcaactcataacttagaaactgatgttattcatagattccagacattgtatagaagaacattgtgaaactccctgccctgttctgtttctctctgaccactggtgcatgcagcccctgtcatgtaccgcctgcttgctcaaatcaatcacgaccctttcatgtgaaatctttagtgttgtgagcccttaaaagggacagaaattgagtatttggggagcttggattttaaggcagtagcttgctgatgctcccagctgaataaagcccttccttccacaactcagtgtctgagaggttttgtctgcagctcatcctgctataaaaccagctctgctcatgcttccagccccagctcaagaatctccctgccttgaagccttccctggcccctggtacagcttgaaggacatatgggaagatgccagtacctggttcaacacttcaggatctccctggttcctggaagccaattcagacattgcccactgccagatactggccaatggtgcacttcattggtcttctatttttgtcacagattagagaagcaatttaaaccacgtgctcaggctgctcagtgggcaaatcaatggcaggagacattttgatgggctgccctcatgcttttatgcatttgcaaaaactaaaattgatccacataaataaactggtttctttgaactacacatcatgctatgtcagttacctgactggccccagagagactctttgcaggctatgctctgagtcctgatatctgtgcgaagtggacagcagccacagcagaggataggggcaggaagaccccaggagtctaccagggacaattgcagagctggagcccaggagaggcttgagggtgaggaagaggtggggttcctcttgaggctgcattgctagctgggacactgctcttatttggaatgcctgctaagggttaataaactcagcaacattccctaacggtgcttcctaaggttagaattacatccatgttccatatcaaggatcagcaccacaattttatttttctcagggctcatttgagggtgttgtcatgagttctctgggcagcatcacaccttcagctagcactcacctgttacctgttttttgttgaaatagttccttgctgcttttggcaaaccatcatcagaggggaaaagaacaagctagctgacagagttcagctacggactaggccaactcttaaagctcactgtaatcgcttagcagtggtgcaggaattaggggcagattctgaggttagtgaagagaaagattcatctggatccactgatcaactgaaccaggtcttcggtcattttctcaagatccctcaaccactcagccatggagtcagaaagactttaggttctcaacacagctcttcttctcactgaagaacagagactaagcgcactagtctctgctaagagcaggaagaatttcctatctcaggggctctcttccttccctactcacacatacaattcacagatttgcaggttttcctaggaccatatatttctaaggaagaaaagattcagatgtcaaaaaattctacctgcttttaaaacacttacagaaaaatgactgaagcaatccatgccacattaatttaaataacacagggcgtaaagtgtaagttctgcctcaactccactccccagggacaatcactgttcacagattttcacctgcttttaacatttcaaagagagctgtcaaattcttgctttaaaaaaggaagaaacacctcgggctctttagaaaattcaaaatctcatgttgagctgagaaaggtgaaaatgagaggcattttaacaggaacacctgttagttttgagcataagcagttttggtacaaaaaatactcaaatttgaggctttagatgatttccaaaggtgattttgaaaacttgcctcccttcctgagaagaaaagttctccagagacacacctgacacactggggaatttgtaaggaagacttttttttttcaatttaatttgtaatttctaaggccagttaggaaattgcctggagcatctccaccctttactggcaaaccactctgggcgtgagtcccacacttcactcccagtcaccacgctcttctttcaaaagtgttttatagaccccaacattgatcagaaatgactctcccaccttatttacttagcaaactgcagctcagcttataatgaagggaggcaccaggcctgggcaccatcctttgcttgtcccctcatttaattatctccccacttcagggagacaggcatttacttgttacctcactcaacagggaaagggaaccttcccttcactccataaaaaaggttatgggaatttttcaactggaaccagatctgtctgactccaaagtttctttccagagttccgtgagagctcatgcacaattgagaataactcacaacattgatgttcagtgtacacacactcgccacgacctgtacaaaaacccaatagtttcctctatttttacagttagtccgaacttccttgtaagtctccagcctaccgcctctgggcatcctgctgctgaggtcaaagctggtatgtctgtccagtatctgttccctcaacccccgatccttttgaggacacccttggctctcgtgggtgctgtgaattttcccactgtttatcaacaaaaagagtaaaactctgtatatttgaaaagatttattctgagccaaatatgagtgaccaacagcacatgacacagccctaggaaatcctgagaacatgtgcccagggtagttgggctacagcttggttttatacattttagggatgtagcaggaagagccgcagaaaaaacccctcagacactgagttaaagaaggaagcggtttattcggctgagagtatcagcaagactcctgtctcaagagccgagctccccaagtaaacaattcctgtcccttttaagggctcacaactctaaggaggtccatgtgagagggtggtgatcgattgagcaagcagtggggacgagactgggggatgcatacacaggtaattagaatggaacagaacaggacagggatcttcacagtgcttttttatgcaaataaccgattaggtcaggggtcgatctttaactaccaggcccagggtgtggtgccattcttttttcctttattttcttaataaacttgcttttactttactctgtggactcacctggaattctttcttgcacgatgtccaagaaccctctcttggagtctggattgggacccctttcaagtaatagttatgtacagaaaggtgggacaattcgaaggggtggtggttccaggtcataggtggagacctgggattaatcgaaaggaatgtctgggttaagatacgaggttgtggagaccaaggttcttattatgcagatgaagtctctaggtagctggcttcggagctcttgtcagaccttcaaaggcaccagactcttagttaattttctcccggatcagggagaagacctggaaagggtggggattctctacagaatgtagattttccacacaagagacagctttgcagaaccatttcaaaatacatcaaagaagtatatgttggggtaaaatatttcaatttccttcagggcttactatctgtcatgtgatactacactagagtcaggctggaatttggtatcttattgctataaaaagtctgctttattagtcttaagatctctgttttaattttttttttttttaagagggagtttcatgctgtcccccaggctggagtgcagtggcacgatctcggctcactgcaagctccgcctctcgggttcacgccattctcctgcctcagtctcctgagtagctgggattacaggcgtctgccaccacgcccggctaatttttctatttttagtagagacggggtttcaccgtgttagccaggattgtctcgatctcctgaccttgtgatccgcccgcctcggcctcccaaaatgctgagatttgttttaaggttaatattgtttagttgtgcctgaattccaaaggaggagagtatagtgaggcatatccgacctcctcttcttatcatggcctgaactagttttttcaggtttactttggaattcccttggccaagagcaaaggagtccatcagtcagctgaggggcttataatattatttggggtttacgttgtttattgtctccttgtaccctgggttgatctgtccaccatagcattggtggtagggctaccctgcctcactatggcagcagctagcaggcctgcagactcctccgcagggaatgtgctgaaatgtcatgatctccactatgccacaaagatgagactaaaaggcaatgtctttcattctcccatggccactctaggttggtgttgaagcatgtgtgaaaccagtccctgggctcttgataagcatacccccttcatgtttggccttgctctctctctctctggagtttctgtcttttgcccccaccccttcatacccagcccaagtttcagcctaaagtaggggactcaggacccttgtatttggtgtctttctacctcccctacacttgttaaaatagcacaggctttacagccacatgatccatgctctaaccagcgctctcctatgttttagctgtgtgacctgcacaagttgctcaacttctctgtgcctttgttattttcgatgtaaaatagtaggtgcagctggagaggaacagattcactggatgagagtgtaatgttaaaagcgccatgcaatatgaacataattttttattattttaggtggccaattttcagaaatggggtacatagctttcccttcctttctcaatttttcttaccccccacgtttattataattgagtattacaatagttaaggataaaaggcttttacttttttgagacaggttctcctctggctatgctgctcatgctgcagtactgtgcctattcacaggtgcaataatattatgtgccctacagcctcaaacttgtaaaccaaaagtaaattctaagccccatccccaaccaattgagtggactcctcctctgggccaagggcattctaaagtaaacctaaaacgctagttcaggcatgatgggaatgggtgggaagacaggcctcattaccccctcctcccgttggaattcaggcacagctgaccagcattaacgttaaaatagagacctgaagactctttgtagcaatattacagctagcaggccctgaaagaaatacgtattttacctccaaaatgtatttctttgacatattctgaaatggccctgcaaagctgtctcgaggggaaaatcaacattctgtagagttgattttcatccttttccaggtctttttccagatccaggagagaattaactaagagtctagtatccagtctgataagaagcatttataatcaattctctctgaagcctgccacctggaggcttcatctgcataagaagaaccttggtctccacaacctcttatcttaacccacacaatcccttcaattgattctagatctttagataaactttcaacaaattgctattcagaaaatctttgaatccacctatgatctggaagccccccagccctctgagtagtcccacctttccgtactgaaccaatatacatcttacctgcattcatcgaaatcttaagtctccctaaaatgtacaacaccaagctatagcccaaccaccttgagcacatgttctcgtgatctcctgggttctgtcatgggccatcgtcatgcatagttggcttagaataaaactcttcaaatattttacagagttggattcttttcatcaacaaactcttgggctcaagtgatcttcccaccttagcctcccaggcagctggaactataggcacatgccattgtacctaactacagataaaagagtttagaacactcaactaacaaggccattctgaccctgaaattctagtgaaattgaacttaacgctgatccaaaatgtaatactattccccaggaattttttttttaaacttctggatctttttggttaacatcgtaaccactggcttagatttccagtttctgcagaattctcatttttaatttataatatgataatgaagtatattttaaaattaattttttgataaactataataatatattatcatggcagacacagtgatgttatatgtacacagtgtggaatcatggaatcaaactaattaccatatccatcaccataaatacacatcatttataacatctcctcattcccccccacccaccagcccctggtaaccaccactctactctccgcttctatgagtttgatttagatcccacatggaaatgaaaacgtgcattttttgtctttctgtacctggcttatttctcttaacataaggtcctccaggttcatccttgttgttgctagtaacagaatttcattctttttaaaggcattttttgagtggcattccattgtgtatatatagcacattttccttatctattcatctgttaatggacagttagcttgattccacatcttggccatcatgaatagtgctgtgataaacaggagtacagatatctcttcgagatactgattaaattcccctagaatttatagccagtagtgggactgctgatcttcctttctttttcaacagcaatctgtctccaaaaaatacccaacctcccacttgtgctcaaggatagctgatactgctttaatgaggaacgactatttttcttgccacaatttgaggcaaaggaagcacacacactgaaattaaggtccaaatgactgatcctaggctcatatccaagtgcagattttgacagagaaaggtgagaggacaaacagagcaagtgcgaggaggaactcgggcaggagggagggaggttgtgtagaaaggaggattagcagtgccaaagctttcctcttttgccggtgcttagagctggaaaactgcaggtagggctgagatggatcctgtttgtcagcgtctgttctgtactttgcaatttgacagcaggcttcccagcagacatgtgtcaccttgcctccgcattttcacccccacacctagcacacccaggaaagggcagggatgtgggaggtgaagctagggccatgtactccggggtaaacttcaacctcacagaaggagccaggctaggaggaccctgaaggccctgggttcagttccgcagggcggagagactgctttcctgggccattccactagttcccggatctggaaagctccttgtaaagtgtttccataattttcattttctccccatgtgtcctttgccttttacaaaattacttaagggcagctataatgtactaaaaaagataccaaaagccccattttcttatcaaatgcccatttttttctgccactcagaattaataacagtgaaagtcttgtcataatttatccaacttctttttaaataaccgttctatttaaatgaggaaggcaatcatgcttgcatcttctgagaaacagtgtggttaagggtggcgtcatttgattgtcacacagcagagtcctgaaggacattttatagcttttcaagaatacccacatttttgtcagggtcttgcaggcagagaaggttgggttctctgcaaaggagatcaggaagtccccatgatgctacacatgcgagccaggccagacattcccctttccacaaagtaccaacccttctgggctggtgcgtttggactcaaatgtccctatatgcactcctcatatttgcttccgtcctctgaactccggtggcaattagtctgaataaacctcttgtaatttctggataatgattttataattaccttgaatcattgaagtgtgttgctatttcttatcatttaactactctcgtactactttagagtgtctaataaatgttgatttaatctcttaaaacagtggcttctaatgattaacattccccacccacagtaaaggcttctgcctccagcactgccttctctctctagaattagatcctcctagcaactacccactcccactgctcattggatgctgtcttctagaatgatgggtttccagccattcatccttgtgtttccccacagctggtgctaacagttcattccctcaaggtgtaccaaatggaatgaacctattaaatccctaactctactaacagatcataccaaaccagtaacgtgccctttcttaacttccatttatattcctgtttgggggtcattctgtgttgctgacctcagtccgttcagcctgcatacttaaaagtacgtaactgggccttctctcttcttcccccaaccccaccatgtgaggacacagcaagaaggctgccatctacaagctagaaagtgatccttgactgagtgtggtggctcatgcctgtaatcccagcacttcggtctcagaaaaataaaagtgatccttcaccaaaaacagaacatgctggaaccttggacttggatttctagcctccagaactgtaagaaaataaatttttgttgcttaagcaaaaaaaaaaaaaaaaaaagaaaaagaaatcttcaaaaaagtacataactgggtggggtgagcttgtttgtacttcagaagatcccctctgaatcataaataagtaataattagttactgaggtcatttatcaaaagacaatgctttagatatctgttcttacaggacagtgaagtattagaaaatcatgggaaaaagaaaaccaccggcaaatatttttccattttaaaatgccactgactttaagacatgctagttttgagaaaaaaaagaaaaatcctgaaatagaatatgcacttcagaaatgaaatgcaaaaaaatgctgtctcttagaaatgagataattcaactactaagcaaataaaataaacctgtaacattcctccaatgagatggccatggacctgttttctctgttgactgtgtaaaaacactctggggacacaggtgagaaaatccatgtcaggcatatggagggttaacttggaggaatgatggcccactgacaccatacctgtgggtcatcatgctgcttttacaaattgcccagtggaaagcataaattgaatgtttaaaaactactaaacttgcgtatacggttgtgaggaaaaacgtccattcagtcctgccagaacacattaattttatctcgagtgtagccacggggatcctcgcacttctactatctgtatccagtgaggttgcaacaacctcaccatccatcaagctctctgtagaaggtggaaggttgagagaagtcccctgaggaagagtgacattgcgctgggtgactcagtctgacgcaagccacaaatgaggcagaacaggatgctgaggctgaggggaagagcttgtgcaaggcctcccctcatgctaactgcgcagcagcccataagatgcgggccataatggtcgttatgattctcctcccccaccagtcttttatttaggttcatttttgcttgtggcaaaaaatactctcttcatggttctcagatgttaatgaattgaatgttcaccgtccatcttcctgaattgcttcacaaaagaatcttactttaaaggtggaaagtcctcaaggtcatagctttctaatctattcctgaaaagtcatttccattttgtgctagttaaaaatggaatgcatttaggatttcatcttattgatgaaattgaccttaaaaaatggtcaattttgatttgtagctcggagtgaactgggcaatacaaaaaaggactattttgtaccgtaagaaatagatgtgaggaaggcacgatgatttccagtatccttcactgaggtcaatttttttttcacagaaaactaaaatgttcctgttctatttcctttaatttactcagaatactgattcccaagattttaaaagtgacttacactttaatagaatctcaacctatttaatttgtatagtgcttttgtgattctcaagcaaaattctacttcttcaacttttactttggattcatggaatacatgtgcaggttgttacttgtgtatactgcgtgatgctgaggtttggagtaccaatgatcccatcacccagataccgagcacagtgtccaataggttttcaacccttgccccactccttcctctaggaatcccaggtatctattattaccatctttatgtccatgagtagccaatgtttagttcccatttgtgagaacatggggcatttgtttttttgttcctgggttaatttgttgtttgtaacaggatgatggcctccagctaactctataaggacaagcttgctttcttttatatggctgtgtcctacacgattttagatctatcatctatcctcccggcataattggttagggagtttgtctcattattcttcccagccatatgaccttgtgcaaagatcaaactttgggcaaagagttcaattcaaacatcagctattactagtgtagctgggccaccctaccccactggaattatatgtcttgggtatcactcagttttagtacctttaacctggacacgttacccagatacaatttcaaggtaaacatgcctgcctgtcttcctagttttttttttttttttttgcccagcaggagtgcagtggcacaatcgcagcttcgaaatgctagacttaagcaatcctcctgagtagctgggactacaggcatgcgccactgcaccctgctgatttttaaatttttggtagagatgggtttttttgttgtgcagagtggtcttgaactcctgggctcaagcaatcctcctgcctcagcctcccgaagtgttgggattacaggcatgagccaccacgcctgcaggttttaacatgttaagcaaagcacacacccgcagcaagtgggaaatccagcttcaagagaatttccatttcttaccatctttttccactttgtccatctctccctgcagccctcccccatcaagcatccattgtatgaaatgcccatactacctttttctgtgtgctttacctactatgcttactcttgaaaatttcctcctgggccatcttagaaacttattattcagtctgcatttccattttgcttacctttctgtgacactcatccaatggcctatggccgtgtttacacggatttgatatgctttagaaggcaattacttttattcatcattgtctcccctgggcccagctagcatggcacctgttacataaaaaattcatgttttctgactgttcagtagatgccattttaagcaacaactcaaagggccttttttctcgggattattttaaaacatgtttcatttatcctctagtatttcagacgatgtcagaaaatgaaaaatggacatttacttttttacctaaagcctatcactttgcaggtcattactcttcgctgtgaatgaggaaaaaaaaaaacaaaaactctgtggtatgttaagagccaagaaactagtgatttttttctattaccatttacaactggtatgttttacaaacgatcacattttatatatcagcttaccttttatatgttatttatttatttatctttttgagacggagtcttgctctgttgccaggctggagtgcagtggcgcgatcttggctcacagcaacctccgcctccttgtctcaagcgattctcccgcctcagcctctcaagtacctgggactacagatgcacaccaccatgcccagctaatttttgtatttttagtagagacagggtttcaccatgttggccaggatggtctccatctcttgacctcatgatctgcctgcctcggcctcccaaagtgctgggattacaggcgtgagccaccgcacccggccacattttatatattattttgcatagccttcattgtcttagcaaagtcagaagaagtccaataacataatgtcattaaattaacaacaacgacaacaacaacaacaaaacaacccaggatgggggcagtggctcaagctagtaatgccgacacttaggaaggccaaggtgagtggattgtttgaatccaatttaagaccaaactgaacccctctatttaaaaaaaaagtaaaacagtaaaaaaatccttggttttctagataaactgcctgataccatcactgaaatgatatcattttgtgtgtgatattaatttaaaaaagacataaactttgggttctaaaaggtgactaaggaaaacaggcactttaagatcacactgatatgggtatcaggatggggagaagaaaaatagaaaattggcatttacatttttactaataaaaaaaagcatcaatagctaagacttatgtaatgcttactaagtgcctgcacgtttaaccataaacctataagacaggttccaatatattcattttacaggagaggaaactgggcacacagaggttaagtaatttgcccaaggtcacataagaaataagagttgagattcaaatagaggtagtctagctacaagtatcatgtacttatcacactgcactatactatactggcaagaaactaagttgctttcttgaagaaatccctattcaaatggcatgcatatgattcacttggaaaaattagactaatcaacatctggctgaaacctttgtttcagaaataagcctcctatgtactttgagatgattaacagtatttctgcattactgtaataaacatttgtcaaaaagagcaatcacctcagtcatcatacagacttctttcccttcattaaagacttctaaatataactcttctgtatcaaagaacttacaaatgtctcaagaaagtaatggtgtagcagtgtaagagaagtaaaagtctgctaggggaaactaatgaagcattttcctcattacacttttgggttgatatatttcattaagacagaactagttctgttttgctttgctttttagtgcttagtctgagaggcaatgcgagaaaccaaaagtcttaggagaaaaactgctttcataatttccagtgtaagccacaaagaagcttttctataaaggcttgaaagcttgaagaggtgacaagagcaagctgtattcaattagacagttcaataaatatgcaaaaataaaaaaacacttagcaa

SEQ ID NO: 149 - DNA, 17882 bp, Homo sapiens; identical to SEQ ID NO: 148

SEQ ID NO: 150 - DNA, 17882 bp, Homo sapiens; identical to SEQ ID NO: 148

SEQ ID NO: 151 - DNA, 17882 bp, Homo sapiens; identical to SEQ ID NO: 148

SEQ ID NO: 152 - DNA, 17882 bp, Homo sapiens; identical to SEQ ID NO: 148

SEQ ID NO: 153 - DNA, 17882 bp, Homo sapiens; identical to SEQ ID NO: 148

SEQ ID NO: 154 - DNA, 1252 bp, Homo sapiens
ctttgtttaacattccaaaggcgttcccagtgtcccccagagtcctcattaattacctggagaattaccaaggggttcttggacaggatgagagcctccttccactgcaactcaccacccctcatgacacttggatgacgaaaaacagcacttgatgaggtgagaagaggaatggagccaggacacggaagcagaagggcattgacctgtgagatttccaatgcacagacatggcttgctctttctcaagcagaggcaaaggatgtcggtgctattgacagtcctgggcatgaatctttcggactgcaaatggaaatcaactgcctcttcattcttccccaggccttcacaatgaacagaaagctgcagtttcctcctctgtattctttctccactcccactcgcctcatgtaccccactgacccaggtatgagaaacccagcctgcaccttctatagcaccacatgcctagactgaggaaagatccacaaatgccactcttcttcgaatagcctaccttcatgaagtctcaccaacccgctgaatatggactccaacggtgccctaggggatggtggagccaccagatggaaggagcctggtgatcccgagaaggagagatgcctcgctgacctgaacatctttccagaactgttaaatgaagcctgcaggacaccagctgacagtggaaggactgaggaaggttgtataattttgtgcaaggtccaccacaaatccagctgaagaactgctccaaagtttaggtcatggcaagaacaagactggatcactccatgtcagtggaaacatgtccaccaacttcatcattgtctgttgtcatggttcactttagatgtaaacttgactggattaaggattccctaaagtgtcaggcctctgagcccaagctaagccatcatatcccctgtgacctgcatgtacacatccagatggccggttcctgccttaactgacgacattccaccacaaaagaagtgaaaatggcctgttcctgccttaactgatgacattatcttgtgaaattccttctcctggctcatcctggctccaaagctcccccactgagcaccttgtgacccccactcctgcccaccagagaacaaccccctttgactgtaattttcctttaccttcccaaatcttataaaatggccccaccccatctccctttgctgactttcttttcagactcagccctcctgcaaccagttgattaaaagctttattgctc

SEQ ID NO: 155 - DNA, 1222 bp, Homo sapiens
ctttgtttaacattccaaaggcgttcccagtgtcccccagagtcctcattaattacctggagaattaccaaggggttcttggacaggatgagagcctccttccactgcaactcaccacccctcatgacacttggatgacgaaaaacagcacttgatgaggtgagaagaggaatggagccaggacacggaagcagaagggcattgacctgtgagatttccaatgcacagacatggcttgctctttctcaagcagaggcaaaggatgtcggtgctattgacagtcctgggcatgaatctttcggactgcaaatggccttcacaatgaacagaaagctgcagtttcctcctctgtattctttctccactcccactcgcctcatgtaccccactgacccaggtatgagaaacccagcctgcaccttctatagcaccacatgcctagactgaggaaagatccacaaatgccactcttcttcgaatagcctaccttcatgaagtctcaccaacccgctgaatatggactccaacggtgccctaggggatggtggagccaccagatggaaggagcctggtgatcccgagaaggagagatgcctcgctgacctgaacatctttccagaactgttaaatgaagcctgcaggacaccagctgacagtggaaggactgaggaaggttgtataattttgtgcaaggtccaccacaaatccagctgaagaactgctccaaagtttaggtcatggcaagaacaagactggatcactccatgtcagtggaaacatgtccaccaacttcatcattgtctgttgtcatggttcactttagatgtaaacttgactggattaaggattccctaaagtgtcaggcctctgagcccaagctaagccatcatatcccctgtgacctgcatgtacacatccagatggccggttcctgccttaactgacgacattccaccacaaaagaagtgaaaatggcctgttcctgccttaactgatgacattatcttgtgaaattccttctcctggctcatcctggctccaaagctcccccactgagcaccttgtgacccccactcctgcccaccagagaacaaccccctttgactgtaattttcctttaccttcccaaatcttataaaatggccccaccccatctccctttgctgactttcttttcagactcagccctcctgcaaccagttgattaaaagctttattgctc

SEQ ID NO: 156 - DNA, 1028 bp, Homo sapiens
ctttgtttaacattccaaaggcgttcccagtgtcccccagagtcctcattaattacctggagaattaccaaggggttcttggacaggatgagagcctccttccactgcaactcaccacccctcatgacacttggatgacgaaaaacagcacttgatgaggtgagaagaggaatggagccaggacacggaagcagaagggcattgacctgtgagatttccaatgcacagacatggcttgctctttctcaagcagaggcaaaggatgtcggtgctattgacagtcctgggcatgaatctttcggactgcaaatgcccgctgaatatggactccaacggtgccctaggggatggtggagccaccagatggaaggagcctggtgatcccgagaaggagagatgcctcgctgacctgaacatctttccagaactgttaaatgaagcctgcaggacaccagctgacagtggaaggactgaggaaggttgtataattttgtgcaaggtccaccacaaatccagctgaagaactgctccaaagtttaggtcatggcaagaacaagactggatcactccatgtcagtggaaacatgtccaccaacttcatcattgtctgttgtcatggttcactttagatgtaaacttgactggattaaggattccctaaagtgtcaggcctctgagcccaagctaagccatcatatcccctgtgacctgcatgtacacatccagatggccggttcctgccttaactgacgacattccaccacaaaagaagtgaaaatggcctgttcctgccttaactgatgacattatcttgtgaaattccttctcctggctcatcctggctccaaagctcccccactgagcaccttgtgacccccactcctgcccaccagagaacaaccccctttgactgtaattttcctttaccttcccaaatcttataaaatggccccaccccatctccctttgctgactttcttttcagactcagccctcctgcaaccagttgattaaaagctttattgctc

SEQ ID NO: 157 - DNA, 1329 bp, Homo sapiens
gagcaggggtgctcagcaagggggcaggcccggccagctggtgctgcggggatgctgggtccgcgggggcgggagccgggtcggcgggtgcgcgcatgcgcagagcttcgggcgggaaggccacgttggtgcagaagaggccgagcagcagctggcgctggcactcctcccacttggccagcgcgtcccccagcgagaggttgttgcgcatccagccgggcagtgcctctctgtaggcggcgcaggacagcggcacggacggcagcgactggacgcggcgcagctccacctgctccggcagcctgcggggcagggatgcggcagggagggcttcagctcccggcgctagcaccgcgggccccgggtggacgcgcggtcggcggctcacctggagggcaggtgcctgcccagcttcctcttggcgcgcatcaccaggtgcgcaccctcattgagccgggcgggcaggtgctccaggatgtgatcttctccgggcagctgcgagtaatcctccgcttgggcgctctccactgcctggtccttgtcctctgggccgtgggggcgggcggggggcaacgccagcaaggggttgggccggttcaggaggcctggggttggggagagaagggattctcagttcatcagcgcggccgcggcccgcagggggtagcagagccgagcccaccccgccctctcccgcccgggtccgcgcaccgttccgctgcagaaagcgcaggccatcccggtatccctgcttgcacatctctcgcagcacctgcagtgaggagggttaaatggagcggagggagccagggatgcccgttctgcccctggaatccctggcacccccaacagccacctcccttcactacccgcagctcccaaccccaaaacctatcctagatccagaacaagatcaaagctgtacagggaggttggacagaaagccgggcgcagtggcttacacctgtaaccccagcactttgggaggctgaggcaggcggatgacgaggtcaggagatcaagaccatcctggctaacacggtgaaaccccgtctctactaaaaatacaaaaaattagccaggcgtggtggtgggcacctgtagtcccagctactggggaggctgaggcaggagaatggcaggaacccgggaggtggagcttgcagtgagaggagatccagccactgcactccagcctgggtgacagtgtgagacttcatctcaaaaaaaaaataaaaaaataaaatagtttgaggccagcctggccaacatggtgaaaccctatttctttactaaaaatacaaaaagtagccaggcatggtggcaggc

SEQ ID NO: 158 - DNA, 1329 bp, Homo sapiens; identical to SEQ ID NO: 157

SEQ ID NO: 159 - DNA, 1329 bp, Homo sapiens; identical to SEQ ID NO: 157

SEQ ID NO: 160 - DNA, 540 bp, Homo sapiens
gcaacatcttgcaaaattgagaatattttctccatggcttcatcaaacagaattttcttttgtaaagtggcttgaccctcacagctatggcacagatagcagggtcatcaaaagctgctccattcttctggaagctacagagaaagggaacctggaaacctggtatgctggcaaaaaggggtcatgggtggcaaaataaaaacagagaagatgtggaccatgtcatcatttaatgaaggaaagaactgaaaattgtatttgagaacaaagacactaaacttaccaccatgccaaaagtagaagagatatgagaaactaaatgatccccacttagtaggaagcataatattgcatcagaaataaaatgggaataattatagcacctgctttatttgcattttgtgaccaataaatgaaagagtgtatctgcaaagtttttacttcaagaactcaaggtaccatgtagtaagagctgaacacacaggagctgcctttgttatcaagatttctcactaatacagcatattcaagatagaattc

SEQ ID NO: 161 - DNA, 32749 bp, Homo sapiens
ggcccgcccctcgcagccttgccgcgccccgtgcgccctgtccgcccctcgctcgcattgcaggcatcctgagtctcggcccttttcgccaaatcgctgctctgccgcgcgcctacgcaaggaaagattcaagggtccctccacttcagggagtggagcccgcgcctcggcacggatcagctgtgcgtctcctttggcctactggctcctctgcttgtgtctatagctagctggacgcatcgtgactttatcttctcatctttcctggcgcccccagacgcatttcctggtccctcgaggcagcggcgtctggggagtgcactttgcacagacagggaaaccgaggcactcagcggtctccaatggagacgctgtaatcgcattccacgaccagctagcgctataagcgctgcctctaaagcggaaggcctcccagtccttctcgacaggaagcaatatttgcatatctaaggagaacaagattcggcaatgtgctccgggagcaagtgcaggcatggaacggtatgggctggagggggacagaccttcagaggcggctgcccgttccctgtagtgtcacataagatttttagaagataggagttttcacagtggcggcagagccctctgctaaatcctcatattagatgtcaaaggtggcatgtcatttgacccaatggcttttttagtcatttatcttcctaacacctatgagagtagagacagggtttcaccatgttggccagcctggtctcaaactcctgatcgcaagtgatccgcctaccttggcctcctaaagtgctgggattacaggcgtgagccacgtctttgttccagcaaaaccaacctagtccctgattcacaaatcatcctgggagtgtacagcacttacagccagaaagaagtctctggagcaaaaagcattgcatattcaatggtctatgacatcaccatcgaagactctgtcaaaaggggttttgtttgattaattttcattatctgttgttacccaactaatgaaaggtgatactattaatgagtgtgtgaacgagacagtgtcttcgttaccacctctgaaacactcccagctttttcagggacgaatagccctgacccaaagtgtgtcctttcttcattgtagggagatacaaactgtttctctccaagtactccaacaccaattattgtgtgtcacaaccgagaacacaatatgaggcttgtgcttgaattactgctgttttatgtgccaaaaaaaatgctagctttcttttttcagtgaagttgatagagttggaagacattttaataccacatttattggtttgaaagcatgattgttttagtagctggtgcaaatttcaaggaacacataactccctttaagaaatattgtttctaagaaattacatttgactaaatttggaagctttaatgcaaataactttcaaacaatgaaaccatattcacaaggagatgcttttattttctccactgaggaagaaatggagacatgtttcctattgtcgttatgtccatctggacagaaaaggaagtctgtgggctagacaagcaaaaataggttacatctgggtagcccagcagtctctccctgactgctgaagaagctcctctttgtttcattcctgaagcacggcgttgttttcttggacccgtgcatcaagttaaacctgagttagactatggatcccttgcacttgattttatgattgtaagacttacacaaatgcaagcctagaacacaattgaactcttatttgcttacatctccatgaacaggaaagaagccacttgatcttctaaaagttttgcccggttgctttctcttttatacctattgttaagctataaaatgaaatcaccaaattatcaatctgcgagtatttgctacttcgcaatatatatttaagaattttacaaaacaaaactgtgccataaaaagtatttcatccatatgatcttacagttccacttctaagaatgcatatacccaaaagaattgaaagcaagatctcaaagatatttgtatacctgtgttcgtagcagattatccacaatagctaaaggtggaagcaagccaagcgtctatcaatgtatgaatggataagtacaatgtggtatacacaaacaatgaattgtcattcagccttaaaaaggaaggatattctgggctgggcgcggtggctcaagtctgtaatctcagtactatgggaggccgatagaggtggatcacctgaagtcaggagttcaagaccagtctgaccaacatggtgaaaccctgtctctactaaaaatcccaaaaaaaaaaaaaaaaaatagccaggtgtggtggcaggcacctgtaatctcagctactcaggtggctgaggccagggaatcgcttgaacctggaaggtggaggttgcagcaagccgagattgcaccactgcacttcagcctgggtgacagagtgagactttgtctcaaaaaagaaggagattctgacacatgctataacatggatgaaccttgaggacattatggtaagtgaaataacccattcagaaaatagacaaaatctgtatgactctacttatataagatatctagatcaaattcaagagacagaaagtaggatgatggtaatcaggggctggagggaaggaggaatgttactgtttaatggcataaagtttcagttttgtgaagtgaaaagagttctagagatggactgtggtattggttgcacagcaatgtaaacatacttaatgccattgaaagtgtcacttaaaaatagttaagatggtaagttttatgttatgtgtattttaccataatttaaaataataatttttgaaagtatttcagattttatgccaaagttcttattaagggaactttcaattttttcaaaaaagtttaaaatactttccacctaattttcaaagtaaatacaactttcaaattaaatacagggaatttaattaattccctgggactttcaggaaaccaaacttctgagcactgtttatttgaagaaagccttcctttttccctctcctttcgcataatttctccctagtgctgtatgttggtcagctttgttagctatttatttgtgctggtctgtggctttattgctctggtctttatcagaaacttaggtaaatatttgcaaccttgacaaatgatgcttggatactgataagtctttacattaagaaggatattcttaataaaattaatgttctacttagttcacaaagctgtacacaggataaatagcacaaggcctgccgaagtgcctggagacagtagacatgaacacatgttgtcctagtagatatttgcttatcaagcaccagcaaacaatagagctggagggacccaaagagagcctaatctctgtcctctagagcactaggtttctaagcaggtcatttaaaagtgacagaaaacatggctgtaaacccctatttctataacagctagtaaagcacttgcacatatttatatattggaactctgttcaccccaaaaaaggtttaaatccctttgaccatgaaaattggttgcttatgacttcaaactatactacagggctacagttaccaaaatggcatggtactggtacataaacagacacacagaccaatggaacagaatagagaacccagaaataagactgcacacctacaactgtctgatctgtgacaaacctgatgaaaacaagcaatgggaaaaggttccctattcaacaaatggtgctgggataactggatactcatatacaaaagactgaaactggactttttccttaaccatatacaaaaattaactcaaagtggattaaggacttaaatgtaaaacccaaaactgtaaaagcctggaagacaacctaggcaataccattcaggacatagacacagacaaagatttcgtgacaaaaatgccaaaagcaattgcaacaaaagcaaaaattgacaaatggaacctaattaaactacagagcttctgcacagcaaaagaaattatcaacagagtaaacagataacctacagaatgggagaaattttttgcaaacagtgcatcgacaaagatctaatatctagcatctataaagaacttaaacaaagttgcaagaaaaaaaaatcaccccattaaaaactgggcaaaggacaggacatgaacagacacttttcaaaagaagacatacatttggccaacaattatatgaaaaaagctcaacgtcactgatcattagagaaactcaaatcaaaccacaatgagatactgtctcataccagtcagaatggctaatatgaaaacgtccaaaaatgacagatgctggtgaggttgtggagaaagggaacactttacacggttggtgagagtgtaaattagttcagccattgtggaagacagtgtggtgattcttcaaagacctaaagacagaaataccattccattcagcaatcccattactgggtaatatacccaaaggaatataaatcattctgtcataaagatgcatgtgtgtatgtttactgcagcactattcacaatagcaaagacatggaattaacctaacatcaatggtagactggatgaagaaaatgtggtacatatacattgtggagtactatgcagccataaaaaagaacaagatcatttactttgcaggggcttcaatggagctggaggccatatccttagcagctaatgcagcaacagaaaaccaaatattgcatgttctcacttataagtgagagtcaaatgatgagaacacatatagggaaacaacacacactgaggcctatttgagggtagagggtggaaggagggagaggatcaggaaaaataactaatgggtactgggcttaaatacctgggtgatgaaataatctgtacaacaaacccccatgacacgagtttacctatgtaacaaacctgcacatgtacccttgaacttaaaataaaaatttaaaaaaagaaaataggttgcttgactctgcacctttccttctctgcttctcacttcccaactgttctaatttcatatgggaatccatgcagttatggagaatccaccttcagcaatgggaatgaacctagcaccacatgacctgggctggatcaatcatcacatactatcccctgacccagtgattggttcagggatggacatgtgacctaagagagtgtggttagagtaaacctcaggacttctgctgataacattggcaaaaagattttttttttaaatgaatgagggcatgtagcctcacagaacagctggaagccattttgcaaccacagagatctgccaaagtctccctaagatgaagaaacactgagatagcagagccaggaaatggtgaagggaatgttggtccctggtcaagttgtttgagctagccctgaagtttttcaaatctctgtgggcttttcaattgcatgagctagtaatttccctttattacttaagccaatgtgaaccagcttttctgttacttagaaccaaaaacattctgctacatcattgatacacgtcaaacacccccttccttttacagaagaaaagactaaatctcatggatgctacgtggctagttaggaggaattgccttcccagttccaggcctttctccttttactactctagccacttgtgatgggtttggtaacaatgagtaaaatgtgcattctccttatttctaaccacggattggatatgttcagaaatattaaaactgattttcctcaagtgtatcttctggcaattaatgtcattgctttatagccactctgtactacgggcccttgtgattcattagaaaaaacaaaggatcaaatagttagagaaggtataaggaccttgtttaaaattttatttaatttgcagctaatttaccagcaacttaggctcaaccacgtatgctgctttgctagtttcttcaaaacttgtcatgcactttcatttcttggtaatcatccctcattaccatttcttatctttcaaaaacacagcctcaccacactgtattcttacctttggtgcctccctctacagctagaatttccagattctgtgggctcttcctctgtaaactctaaaaatccttccatttttatctatacatactatttcccccactctaacagatcttacctatcaccaaccctaaaattacctaacaaaatgctcatcacatcttcaaggaaatgtcccacagtgagagaaaagagaaaggaacctgtgtttattgtgctaggaagatactagatactttacagacattaactcatttaattttcatgaccacaccatggtaagtaggtagtagtatctcagtctaaaaataaggaaactgaggttgggtgagtcatagggttgaattccaaacctaggtgtgtgcagttctaaagatactttcttccactgcttctgttggacaatagattttgccccttttgtaccagctccaaaggatagtgaccgcctggatctcgtgttgagaagactgaagcctcatccaggttgacagggaaagacaaaaggatgtcttgccaaagcttgccaagggggaaagtggcaatccacacaccacttatttcacatttcttcaggcctgtgcctggggcagttctagaggtttcccaggagaaggacaggtgcaccagggagtctggctataaagtttgtacactagaatctgttggcagattctgttgcttaaagttgagtttgcattcatactttatatctgaagaaatgggaagttagggagttaaccactgtctattgggaagtgattcatgaatcagaacaggtgagaatgtcaggctctgaaatgaacagcacacttctgtatggaatgtactggggcagcatacctgccttctttctcagatcaatgttgacacacttaaatttgtgaataaggccttccaggatatcttgtttaggaagaaccagttcacttgctagtatctaggctttctaggtatcacgagggctttctgtcaaagcataaacaagcagtgagaaatcatcagtgttctctctctgaagagagagacaccaggaaaggagagagggtagcaagttagcaggcatggaaagctgctgctttgcagatgtgttcatcaggcataatccttagctggatgttagacagtaccagaagttgcatggtgacttgtctgatggttgcaaagatattggtcctcatgtgggattattcaagatattcagaagggaagaagctgaatctggttacaaaaggtgttccttaaatacgtaatgaatgaatgaataaacagttcaatggaaattggggcaaattaaggattcagtagatgtgaggtgtatttgtctcatgtcctcatctgatgaacatctaccatattcagttgtctagtgaggactcttttagtgtagaaaccaaggaggcacatttggggttcatttagagatggggtatttggggctggggggaagccagcatatgaatgatgggcttcaccaggagacaaagggcatctgtctaagggatggatgctgagggtggacctggcaggctgagcaggtgaaactcttccattggagcagactgtgggtttatttgagcttaagaaaaggaggtcattcccaagaatgaatagcagtggatttgtagactttgaaattaacagatcaaagacaccagatctctgtagagaacttaatatgatctctagattctgaagctccaattctcagccctggctgcaccctagaatcacctgggagcttttcaaccctaccactgccagggtttctcccccagagctttggattcaggcagttcagagtgaggccctggaatcagtattttcaaaaagacctccaagtggctctgagaatatcactgcagttgagactgtccactctagacataactcaaagcaggcaaattttcaggattccatggctagactatgacatttccaacaacctcaagagagacattttaggattattcattcatactgtgtgcatccttggtttctcactagcccctgttcttaaggcctggcagattcccaggtgacttctatccatgagagtgtcccaagaagggccactgggaaacacacttatagagagtttggattatgatcccaaaagacacattcctgaatgccatcatccccgaggttgaaatcctgaaagatcaaaatttctaaagactaaatccttaacatctaaaatcctgaaaatcacaatcataggatagttgcatcatgttaggtgaaactgttaccttgttgtggtctttatttggaaattaagtatggtttaaggagatgcatatagtgccaagttgacagggatggatttattgacttaatttgagatgtcaacttgactgattaaggaatgcctgaaaccctggtaaagcattattttgggtgtgtgtgagggtgtttccagaggactgagtagactcggtgaggaagatctgcccttgatattggtggacaccattcaattggccaacaatctggagataacaaatatagaaggccaactggtctctctctgagagctgggacagacttttcttctgctgccttggacatcagaactccaggctcaccagcctttgcactccagtacttaacagcagcggccatctgggtcctgaggcttttggcctcagagagtaacaccattgtctgctgtggttctcaatataaaaacattgaaacttcctcaataaatgaacagatttcctttttgtgtatctgcatttgtgaaagaccaaaatttcttgagatcttgcctttttgggccactgcatatgcagtggtgacctatagaggtttttgattgatcttgtcaaaagacaggttgtccatcacagtatttcggatgactggagttataaagctaggtacacacaactaccaaccatcatgatacatgtttatacactttgtttttggcatattgccttatgaatacagttcatctgcttgtaattgttgtaatcatgtgactgttgttagaatagctgagtgcttatgtttgcaaagatatatatgttattattgccaattttattgtgtaaattggcctctgaagtgctctgtcagtttttatatggttctcaaataaatctcccttaaaaatgtaaataaatgttttaaagataatttcttcttattttttccagaattatatttttgggattttgatctttcaggatttcaatatttgggatgggtctttcaggattatgatcaaccccctatgtggaaccatactggggaaactatgaacaagaataaaatctcagaagcctgggattttgacattggaggcaaaggaaaatcacatcagagagccctgctcagtgcaaagagcgctaggccgggtgctggaagtgctgactttcactcatgactgcagctgccccactgtgatcctggggaagtgaccactgtgatcactgtgggtctgagtactgtcatctgttcacttccatgtccttccacttctgtgactctgtgaggctaactctgtttctatttttttttttttttttgagacgaagtctcattctgtcgcctaggctggagtgcagcggtgcaatctcggctcactgcaaccgccgcttcccgggttcaagcgattctcctgcctcagcctcctgagtagctggaactacaggtacacaccaccacacccggctaatttttatatttttagtagagacagggtttcacgatgttggccaggctagtcttgaactcctgacctcaagtgatccacacccgcccccccccggtttggccccccacagtgctgggattacaggcgtgagccaccacaccccgtcgcctaactctatttctaaaagctctgccagttggagatttctctagcccactagagtttctggctttgggggacagggagggaagggaggggaagctgtgttataagaagaaagtttaaaaagtaagcataaattatttgagcttttaagagacattaacaagctaccatactgagggtattaagaacactaaaatttgtttggctttggatagggaagctactgaaattgaagaagaaaagatgggactgaatgagcactccttgggttggagaaaaaccaacatgatcattatctaatcatcatcataataatgataatggacatttgtatagcacttggcagtttacaagttactttcttataataataattaccactatatggtacattacagtaacaaatactttttagggctttaccccgttccactgtaaaagttggtattagtggaggatgtaaatagacttatctacatgattaaggaactaggaggagtggaggttcaacaccagcagttggacagcaaacatcttagaagaccaggcacatcttcagccacacccttgggttcaacttggtggtctcctggttggggtcaggagcagaagtggggccatggcctccacttcccttcctgggcaatgtgcctttctttcatcaccatggagtccttgcctttgttttgtttctccttgtcatttatttccattaacatgcagtggtttttgtcctttctcttcccgattgtcactttcctcacctagatagagaagaaccagccctcacctagctcactagtctgtatcaggctcaaatgaggtgatgtatgtaaaaaggttttgagacgttaaaaagcacagtccagaaatacctgaaagcatgtaaactcttacgatttgggggcttagcaggaccaggaatttgatctcattgcctccaggtcatatcatgaccctctaggatccctcctccctgtcacacatccctctatgggcacattgattccaggatttccagagtacatcagggctgagccgacctcatggccctcgtggattgtctctgatatggtttggctctgcgtccctacccaaatgttatcttgaattataatccccacatgttagggagggacctggtgggaggtgactcaatcgtggtgcggtttgccccatgctgttctcgtgatgatgagtgagttctcacgagatctgacggcttaaaagtgtggcacttcctacctcactctctctctctctcctgctgcattgtgaagaaactgcttgcttccctctcaccctctgcagtttcctgaggcctccccagccatgcggaacgctgtagaccaagacctggaattaacacatcagaagattctatgaggaaacccatttaaaaataggatgcatttttttcttttctgcacagggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaagggctgccagccagagaggaggagaagcaatcactcctgcagtttctgaacactacacagacgccaggtagcttcttcaggagaacagccctctgaggaggcaggaagaggaggcttatctttcagcagccggagctgctgagatctctgggcagattaagctctctctaatggatgggctccagcctggcacattcagtggagagggatccactcatccatcatcaacataatatggtcctccctgcacttcacagtgtcctcttgctattgaaaaggcttttttgccttctcaagtttctttgtcaacagtctacaggaagaagctcaggccgccaccggcagaggtgaatgcaagctcacgttttatttctgactgcttaatcattgcctcgatcactgctcaagctctgcctttgtttccaaaggttacctgtgggaaaacttctttttctatgctgaaattaatagggaggcaaagatgagtccactgataagcagagccttaaaactcacatagagaaacaactttgctggagtgtgtgtgagtgaaccactaaggaatcagatagtgtgatggcagttatcattgcaggttaagacatttctacaaatatttcgacatctccatatactcactcctttcccccctgagtggagagactcagctaccaagagaggaagctcaaaaaaaacagaagcttcaaacaaacaaccaaccaaaaaaaaaaaaaaactgtgggttcatcagaggtggtagggaagacaaaaacatgggaggagcagctgggcacggtggctcaagcctgtaatcccagcactttgcgaggctgaggtgggtggatcacctgaggtcaggagttcgagaccagcctggccaacatggtgaaaccccatctctactaaaaatacaaaaaattagccgggcgttgtggtacgcacctgtaatcccagctactccggaggctgaggcagcagaatcgcttgaacccaggaggcagaggttgcaacgagccaagatcgcaccattgcactccagcctgggcaacaagagcgaaactccatctaaaaaaaacaaacaagcaaacaaacaaaaaacacgggaggagcaataaaaaggaatccatgctttgatttttttttttagtgagaggaagggaaggctgctgcctctcacttctccctgttttgttgttcttttaagtagcatgtgtcactctgtatatatcctgtccatgtgttttcttttattattatttgtccacttgcctagaatgaaaactccatgggagcatggctatagtgtcttgttcactcctgcctctccagggcctgaaacagaagtaggtagacagagcctgaaacaaaagtaggcagtccataaactttgctgaaggaatgagtgaatgaatgaagaccccaaggatggacctcaggaaggtgagcctgggcaaaggttttcagtcctagtccatcatgaccacatagctggaatacacttatttcactttgtcacatgaattagagattcatttggggaaacaagcaactgttagagttgcagacatctctgaggggtaaatggctgttcaaatcttgcatcttaccctgatcctcactctatctgctttccaaaaacatggagctaagatcccagcactgagaagatgggcattcctagcagggggcatttaggtgtagacagcctcagtgactcctgggtttaggatcagtgagataatctccagtatctacagtgggcaggtggaagagtgtctgatgcaaactgtatctatttacaagctttccagacagctgggcttgtgccttggaaatacaataatatttgtttctcctccttcctcttcactccttggcctcgtgttctgcagtactggaacctgggtcagatttagctacctcattcattcatttatgaattcatttagccagtgattatggagcacaaatttgtgccggaaactgtgcctcagtgtcctcaacaggttctgacttgtgaattccaaaagcttttgtgatctactgggtaaaacattgttttctaaggaaaatgacatgctgattgctgaacagcatattctaattaccttgtggatcccaggccattcttaaattgggttttgtctttattgccttagactgttaatgaattgtttcccagtctgattgaatgctccttgaagacggacccgggtccagccactgcagtaaatattgctaacttgggggtgtaattctgctgcttttgtggttgctgctttgcttatttttttatgtctgctgtttcctgtgagattgtttctgtgtttcatatgtggattgatgttcggtgaggtttatggaatttctgtgcagcttgggttaagagtatctcttcaaaaaggtttttgcatttgcttctgccaaccttgttatcagctcaagttgtttcttatgttgaattattggggatgacctcccccacactcaagtagtataaattagaacctcgctgggtgtggtggctcactcctgtaatcccaacaccttgggaggccaaggtgcgcagatctcttgagtccaggagctcaacaccagcctgggcaacatggcaaaaccctgtctctagaaaaaatgcaaaaattagccaggcatggtggcacatgcttgtagtcccagctattcgggagcctgaggtaggaggattgcttgagcccaggaggaggaggttgcagtgagcatttatcatgccactgcactccagcctgggcaatggagtgagaccctgtcccccaaaaaatttttttaaactcaaaccctatggtattatacctgctgtgggtataatcctttagttacgattggatgcttgctatgatttctcagaaggaaaacattttttcctacccagagctctttacagctaagcagaatttccccaaatgtgcctttaaaaggtattggcttatgcaggcttctcagtttgatgtcttgttcctgaatgagcaatgaaaccccaaacggacaaccttgccctcaaggacagccgaagtatcagatactccttgcaactccttatgtcagctcacactccatttgtggacatggagcatttccttccttttttcttttccttttgcaaatctagttatgcatttaaaaggatgcaatgtacccattatttccaggtgttttatggcactaatgtgtatggcagaaatgggtgttctctaattgttcataattcaaggtaattatagacatattgtttcaaaattaaatcaatagattttcaagccatgctatgtataaagctccatgcgggacacaaaaagggaaaaaacactatgtaccatgcacccttaagcaatttcacacatgctgtcttatctaattttcacgacagtcttatgagacagttattatccccattttatagatgaggaagctgaggctgcatgatgagtggcttgctcaaagtcacatatctaatcaataagacagctggcataaaacccatatctcactcgaaagtctgtgctttcccattgcacaggttcatgacatagtccaagggagaagacatagctgacaaaaggatcaatagcagtgtaagagtagacaaataaaacaataaggactgcattgcaatagatgttatgaagagggacggacatgattcattgctagtgaatataggccaaagggctataacttcagagtaggcagagatttgtgggccacagtgggaaagatggaggagaaagttagcttgggccttgaagatattgtctcagtgaatgaaggggagaagaccatgcctggcagtggagagagcacaagcagaaggtgggaaagcgtgtgcaggttatgggctccatgagtaggtaggtcatggctatatacaagtatgctgggagataagatggggaaagtttgagtccaagtatggagggctttgattggtaatgaatttggattttatttggtaggcaataaagaaccccagaagacttttgcctaaagaatgatgtagctgaggcagtactttaaaaagatgtgtatggaaaaccatgtacaaattaattgtcaggggagagaatgaaggaaaggagagagcttggattaaggggaagcagtgaaaatcaaatggaacagatggatacctagatatttctcatactgagggtgccaaggccaattgttcttaattaagcaccaatctggttgattccatgggaatttgagatgtcatcaaggtatattgctattgtcatcttccacagactgagcaccagtcaggccactgggtctgagtccctggggctggagcgggtccagtgggcaatttattaaaagttgccaggagaagaagggtgaatgcaggccacatcctgggaaacacacactgaacgtcaatgctggagaattctgagttgtacctctaagttcatggatgagcatgatataaggaagggaaggcaaaaataaaagtagaaagacaggtactgaagtattgtaaatgaacgggtccagtatttgtgaatggaacccacaacttgttttaattagctttaaggtgtctagtacattgtgggtcagcttagtttaaagatataggactaaggcgagcagctttaacatctgagctgaaagggatataaagatgacataccctcttctaaacttccacgactctaccacagcacttatcataatgcatcatgattatcaagttttatatctgtcttctcactagactgtgtactctctgtgggcagggactgtgtcctgtttatctacattcctggcatctggcacaaagcccagcacagggtagatgcccagctaagagttaatgatggcttggaccagggtgatagcagtgggagtggtgagaattgatcagtctttaaatacattttgaagataaagccaaacgggtttcctaatggattggctatggagtatgtaagcaagagagcagtgaagaatgacgcaaggatttgggtttgaggaactagaaggtaaagttgcaatcatctgagatggagaaggctgcaagcagaacaggtttcagagaaaagatggcgggttcacatttgaacatgctgatgctgggtgtctattatgttcaagtggagatggcaagtggcagtggtttcttacatttgaaatctgagagagaggtttgggccaaagatacaagtttgggagtcatctgcataaagatggtattaaagagttctaaacggggtgttatcaccaggggagtaagtgtagacaaagaagagcgccaaggtctgagtcctggaatattacaacactcagaatctgtgagaagaggaaacaccagcaaataaaactgataaagagcagccaaggagataggaaagaaactaagagaaaggggaagtcctagaagccaagtgaagagaaaatatagcaaggagaagggggatcaactgtgtcaaatgccactgatactcaagtaagatgaggagtgggagctgcccattagatttagcatgtgaagatcattgatgtccatgataagacttgggtgcctggttggggcaaaagcctgagtggggtgagtttaagagaaaataggaggacaggcattggagacaagcagtacagacaactcattataggagtgctacaatgagaagcatctaaatggggtggaagctgatgggcaaagtgggattgagagaagccacttgttcatttagatggaagaaacatcagcgtgtttgtattctgatccagtacaatgaaaaggctaagagcttagacctgctaagctcacatactcaggcttccatcttctagtgatgactcctattgtgagttcattgaggatgagagctaaatgtctacccttacctcttgacataagatatatagaagatgcttagcaaatatttatcaaataaatgactatgcataaaatactttgcaaactctctgagccgcagtttcatctgttaaatgaaagtaatatcacctacctcagagaattaaataagataaagtacatatagtatataacaaagagcttagtacttagtatatgctcagtaaatagttagttttattgttagttcaatgctttcattttacagataaggtatctgaggcccagaaaatagtttgttcaagattgcacagttaatgacagagctaccagtttcctagactcatattccttagctttttccacataaccagagaatttacctacaattcccaggtaccacagatgtgggtgctttcaagcctctgtaaattcactaagttgatgagaaacctggatattagtaattaatggcagatctgaaatctctctagaaccttcctatgtggccaacatatgtcttcctgtctaatttgtcaagatactctgcaaagtcaatcctagtacaaggctccatattcatcttgaagctttttcttgttttaccagaattctggttttaattttttgagtagcaatccatgttactctttacatacccaagtcaagggacaaagctaagccacatgcttgttttgttcattatccaatattatgtaagtctagatgactgactccattagtttaactccaggtgacaatgtagatatagatccaaaatatgtttctggacaatattaatagaaatttttatgaccttggaacacaccctccctcattgtacttgcaatagatgaataacctgctcttgctaggatgagtgaagaatgtttacctttgtcaacatttattagtggagtactatatgcagctattcctttaataaaacagtaaatcttcagcaaagtttataggttgtctttcatccaaagacctcaaagaaactttgctaacactgtgtcattattcatcatacaacttgccaagggaggcaagtggtgattgtttcaaagagagaaactgaggttccaggaaggtttctgtgacttctaagggtcatgaacagggtaaaaaagaaaaaagaaaaaaaggaaagaaagagagagagagagagagagatctgggcactgagcccaaattcctgttgctcaggccaaagacccagcgctcctcctagagctctctaaacatttctttctgatagaaaatgtaatttactaccttgatctgttaagcagaaatgaactctcaacctgtcttcaatgacagggaaagccaacctttatttctgaagttacttcaagtcataaaatgcttgattcactgtattaaataatacagtattaaaataagtaaatagctttgtagtcataatgatagcttggatttaaatggtgcctgtgctctgaaaagcagggtagttcacaggcttctgcagacctttggtctcatttggctaccctcctctacccttcttcttcttttttttttttttttagacgaagtctcgctcttgacccccaggctggagtgtgatggcgtgatcttagttcactgcaacctccgcctccccagttcaagtgattctcctgcctcagcctcccgagtagctgggattacaggcgcctgccaccacacctggtgaattttcgtatttacagtagagacagggtttcaccatgttggccaggctggtctcgaactcctgacctcagatgatctgcccgcctaggcctcccaatggctacctttcttgacttcaagtatccctttccttcccacaggtcttttcttcaccaacctgctttcttcactcacacccttattctttcattcaattattttttcttctgcactagcagctctcaagtgaaaagaaactccctgctttagctgtatatgaagaaagacctccaggccctctggaagagctgtggaaggccatcctatgtagatcctccaagaggctcttacaggaatgagttaagatcccatcttgtttggaggttaatgatcaatgtttcagagactgactagaactaatcaaacattcaagttctcttctaaatttcccagtccctcttctatttagatctgggccttataactagttctggccaataaaaagaaaggcagttgagaattatattcttcctccatcgccctcttaacttgctacagtgaccttggaggtcacatcttccaagacactacagctacaagatggaggatggttgcccacctgacttctgactttgcatgagcagtaaacaaactgtcatccggttacctggagatcaaaacccctgagattttgattgtagcagctgctgtcaattatcctgactaacagcaggagtgaaatattgcaatagtttaaaaaaatctaagagatgtggcattagcttaccagttaggctggatagatggaaatccatgatatgcagtggcaaaaaatttaatgaagtacggctggcgataacttggaaagcagaccatgagccaactgagtttatacatttaacacagaggccagccaacttttccataaaaagccagataatgaatattttcagctttattggacagactcctttgcaactactcaactaccattgtagcatgaaaacagccatagacaatatgtaaacaaatgaacatggttgtgttcaaacaaaactttatttacaaaaacaggtagcactctggatttggtctgttggctatttgctgacccctagtctaggggaagagtttagataatatgttgccattggctgcatttgacaaggaattaaagttaagagatgagtttagaaagtgttggccggcttgcaggcagaaattaaagagagaaatcaggaatttggattcccaacttttcacaagctgtaagtggtctaaaaatgctgtacagactccagtatccacttagatagggagaaagaggataaatacacaaaaataaacctcctgataagcagagtaggcatggaggagcatgaatgtaaggcgagcaggttaatatttgaacaaagacccgaaaaaagtaagggacaagccaggtgactatatagggaaagagcagaattatagcaagtgcaaaagccctggggcagcagtgcacctaatacctgcagggaactgcaaggatgccagtattgctggaaccgtgggcacaaagggtgggaaggggggtggtagtaaaagataatatcagagggagggcaggtgggcatggggcagtcttcaaaggtaaatcatacagggccttgtaggtcattatgaagatgccagctcttattctgaattagtgggaaagccatagagggtattgaggtgaacagggacacactccaacttatattcttgaaaagataattctataatatggcaaaaccccatctctacaaaaaaaaaaaaaaagaaatacaaaaattagccaggcatgatggctcacgcctgtagccccagctacttgggaggctgaggtgggaggatcatttgagccccaggaggtcgaggctgtggtgagccatgatcacactgcattatagcctcggtgacagagtgagactctgtctcaaaaagaaaaaaattcattctggttgccggactgagacaaaacaaagggggtggggagtaagcaataagaccagccaaaagtcttttgctgtaatccaagcaagaaataatcattcatttatacattcatctgttccctgagtgggtcccagagtctctgaatcatctcaaccattttgcatctagttctcaactattcgcaactagttctcaaacttggctgcacattagaatcacctgagaactgtgacgatgactgctcctagggttctacctccagagattctggtttcttgagtatagaccttggctggggtggggttggagtagatattgtgtggcccgacatcaggatttttaaagctccccaggtgattttcttgtgcaacccatttggagaaccactgatctatataatacaccctctttgagctgagctcagagcctggtggagttcccagtgttcaataatcttccaggtctctggcctcattttttgactgcagggagcatcttccctcttattgacagctttgcagtccccatctggggtgcaagagactacagggtgctcggaagtgtccatcctggaggcatcatcaaaactacctacttgttttgggggtttttccaacttttattttaggctcaagggtacatgtggaggtttgttacatgggtaaattggcatcatggggatttaatgtacagattatttcatcacccagtaatcaccataatacttgataggtagtttttccaccttcaccctccttccatcctccactctcaagtaggccccggtgtctgtttttcgtttttttgtgtccatgggtactcaatgtttaactcccactaataagggagaatatgtgatatttggttttctgttcactgtaatgtgtttaggataatgacctccagctccatccatgttgctgcaaaagacatgatctcatccttttttatggatgcataatattccatggttaatatgtaccacattttctttatcaagtccaccactgataggcatttagattgattccatgtctttactgttgtggatagtgctgtgatgaacatatgtgtgcatgtgtttttggggtagcatgatttatattcctttgggtatatacccagtaatggaattgctgggtcaaatggttgttctgttgtacattctttgagaaatctccagactgctttccacagtggctgaactaatttttctaatgaactaattacattcccaccagcagggtatagggatttccttttctctgcagcctcaccagcatctgttagtttttgactttttaataatagccattctgactggtatgagatagtatctcattgtggttttgatttgcatctctctaatgattagtgatattgagcagtttttcatactcttcttggccacatatatatcttcttttgagaagtagaaacatctattttttccagagtttctatagcttagcttagcactagggaagtgggtggggattgctgggtgtgctgtgggaagatgacccttccataaaagacagcagggtgggaaaaggccccatgttttcagaatattagtatatatacatatatatatatatatgtatatgtatacgtatatatatatacgtatatatgtgtgtatatatatacacatgtatatatatatttatatatttatttatatatatataaatatatatataaaaatatatatatatttagtcgacatccctgttctatcccaaaagcctaggcctgtttctctagcagcctggaaaatccaaatgtagcaagaaacacttgtctgcatctgaaactggccatcagaggacaggtccttgacacacaagcacagagtggtctttcctacagctcggacatgccctttgctccttccccctgtaagtcaccctccttctatgttttcctaaagaaagttatttttacccactttggaatgccagttcggaacagcctctggcatcttggaaggcactgtacaggtacttttcatctctaattgctcctgcttctccatttaaaagaaatattttcaaagcaatgggagcaagttactcattcaaatgctgttaacaaataacaggacttgagtgtgtaatctgaagttactcagctttgaaaagttgccctgaggagttaaaatttctgcttcactggaaattagaagggaggatgggggggatgtccttatgcgaggaattttcagcccctggaattttatgtctgatctccctcacatctgagctggaacgtgagatccagtgcaagattgcaggagagagcgggctggggacagttctggggcctgcaggtgttccgtttctgtgccaaccagcaagggccgctccccctgcaccaccaaacacccgccaggacttgctggagcccatgtcagtggagtcagcttataaattactcgggatcatcattccatgttggatcgaatcatagagggtggagtgtagaggtgctgcagcctgggcttcaggtggagggctttctggaggaactccacaagcaaaggctgacaacgcagccatgacaagccacagactcccagcgaactcagccccaagcctacactttctctcatgccacaagagcaactgagccaaaagctgggagcctgggccccttctcccatttctgttttaattactgctttttcttttaatatatgtttcccggcatgctgtaccatgagaagtagggacagcaatgccctccagggaggctgcacatagtaagtgttcaatataattaagtgtcagtaaatgtcaattcccttctgtggtttaagaaaatatgcaggccccagggtggtatggaagagatgtgactggtgagtcctaaagtgacgtcagtaataagggaaggaaaatgttaaggaggtcaagactcctcattagggaagaaaagggacttcacctgtgcctgccaatcaccaaggactctcaggtttggctcttctgtggacaggtccaagcttaaaagagtactcatggcataggaattctgaaaatatttattaaagagagaaaggatgattcaattagaggtgggagggaggggccatgattaaaggaagagatagaagaaaaggacttcaagtttccacttgaaggtggctcctcatcctgttggcaaagttctgaggaagaaaaggtatatatggaatgccacttactccactttggagcttcaaagagggtgtggggaggcagaaggaaaagaggctgaaggagaaagagcaggaagggaagagtcaagggtgaagtgctcaagttctcccattctgtgctaagaatagcaggctctcttcaggggaaattcagtccctcttcccaccatggacttgacctcatcaggctctccagcctgccccagaccacctaccgacagggactcatgatgatagtttgagagtgaatacattcaaggcccaaccccagtactttacatatctcccctccaaatctagaaaccaatgccttggctccctatgttcctacaacttggctttttctgcataaatcccctttcaaagctcttgtcttagagccagttgatactgatcgacacatattttaattaaatttgcatttacctattgattttcatacccagtctcattccaaaaaggattggaggcagcttctaacatttcaatgtgataatcactttgataaatctgccttaccacccctgttcacaaacacctgtatctacatccacgaaatatagatgatcttcatagtttaattgtaaaacaatacacaaaacacctttgaaacctggctccaagttttaaaataggtgcattgtactttgtatgctaagaagtttcagacaggattgggcgtcctggccacagaaatagagtcttgtgggagacccccagtttggattcagagtttgggatggccagaagtatgaccacattgattttctttccttgttaggtgtagagaaaaagaggtacacaggttgtgttgaagagcagagtttcgtccaaaccaggtgtttggagcattggaggagggaaattttcctcccttccaggagcccctccagcatcccagatcttgccaactcagaccctttcccagacaaacttgcctctcatccctcagggagtcagttgatcccagctggaactgtaatcctttgctaaaaggcctcttggctgaagcccagctcagcagggaagggttcagctttgtccttggggggcttctgcaggaggtcccattcttggggactctgacactgtgggaatctggcaggtgccccttcccaggttcacagaggttgctttggggggttgcaacaggacttgcttctctggtgtttatctcagtgaaattcaagaaagtccatgtgcagtttcatcctgggataaaggagggtcttctcttcctaccagcaactccaggcaagatactctcctcagcccaaagggctaaagagaaggcaaagggaacaaaggaaggccattttactcattgttgttgaacttaaaatgtgtaattatcttctgaaaacagctgaagggcttatgtaaagcatgacacaggagaaggtatttaaacatgaaacaaggcagcatcttttgctggagcagaatacctgctttccaaactccagatcgactttggaggaggagaatagcatgacagcctccatgtgtgagtcctgtcaacacttggcatccaccttcccattcacttttcacaacactgcatggtaaaccatttcacagataaagaaatggagtctcagagaactggagtaaattgcccaaagatgcacagctactcaataatagaacctgaatttgaacctgctgggtaattctagagccctcagccttagccactacacagcgctccttcccatactgtcactacccatagtcgttcagccatgcattccctagccactaaggcaaagcaaaagataatgggctcaatgaacctcacccctcagatgggctaagtcacacggcacttttgttttcattgtgaatgcccatcagtgaggcacatactgcctgttacagcagatctgcttcgtgcatttgtaagttttgcctgaccctggtgtgcatttgagtttgcgattccaggactacaacatttctaataggaaaaatgtcagctctgtcttattctgatattgacatgctttggggatgccttaggaggctaggaagccttctaagtagcttctgaatttaacacatttctatagaactgttacaagctggttgggaatgtggaagcatgctcaccaaagacggttttcattaggctcaaatcaatgatgagcttttcctgagaacttgaggctttaggagagagtagcatgggccgttggattattataacaacaacaacaaaaagattttaatacatttttctctcattgttttgcctgatgacagatgcaatcccagatcacaggcatttggtgcatgagagcttttctgtttacaggtgtccactgtgccttggagagggctggggcaccgccctagggattgttatttcagacaagaacttcaccctacaaagtaaaggcaagacaaaatgtcattgtcccttttatgcatcacagaggcacattggacttgtagaaggagcataccttttagacactaggtggactaggtaaaacctggatttgaatccagctttttctacttcacagttgtatgacctaggacaagttacatcaagtacatttttgagtccagtttcctcatcagggaaatgcagataaaaatacagactttgttaaggtaccgtaaggattagaggtgatatatggaagaccccatgcagggaagaccccctggaagactctttgtagttgatctagatattatcaggagcagcgtgggacatgcggcactgcacatgctggccactagcttgcacagcaggtcctcaaataatgtcatgtttttgtttttgtttttctgagacagggtcttgctctgtcacccaggctggagtgcagtgacacaatgctggctcaacctcctgggctcaagagatccttccacctcggcctcctgagtagctgggatcacagaaccttccactggccactcagcgaaaggcagctgattcagcacctggagaagaccggcaacagggctgagtttccttgcactgcagaggaggggagaggcaaggagtggacatgagcacggaggatccagggcactcccttgatggtgatgccctcgaagggctgccccgtgcccattgtacagaatgtggattccaccccacgccatgagagctctcgcgcaggcccagaccactttataagccatatttcccaccaattcctgtttctggatctgtcaggttatttcatatttctaggcccttagctttgcttcctcttccctgaacgccctttgcccacatcatcccagctctccttctcctcctgccttctgtcttctcttcctctcatttcttgtcacccaggctggagtccagtggcgtgatcacggctcactacagccttgaactcccgggctcaggtgatcctcccacctgagcctcccgagtagctgggactacagatgcacaccaccatgccagctaatttttaaaactgtttttagggatggggtcatcttcctgtgttgcccaggcttgtctcaaactcctgggctcaagtgatcctctcacctcagccttccaaagtgctgggattacaggcatgagccacaacatccagccccttttctcttttcttacccttctttcctattttcttttccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagccactagatgtcatattaatttcacagcagaatagggaagcccatgccggagctgaaaacctgcaacaacaaaaaagcatctaaatactgcaaaaaaaaaaaaaaaaaagagggagagaggcatcttaatatttgtccttaacacatcataccagacttctgcttccaggaatgactggatgtggtttttctaggtggacataatacaaaatgcagctacctgaaaacaatggaaagtggacagagcaggcagattctggtgggaagtccacgcaataaagaaaagatgttacaggaagtgagcgcccatttttgctgtttttagcttggaggcaggtgcagccattgtgcaaaccaggtgtggtgctggtggaaaaacagccatctttttggactatgaaaatggaaggttgagttcagggcaactataactgccaaaagagagaagaaagagttctggaagagaaagagccaaagagggaattcccaaattctttctgctcctgtctgtggctgatcccaaaccacggacacacacagcaaaaacaaaagcatctcagccagagacaaaagagtctaaaagagactggacctgccacctgagaaacagagtttgaagttagagttcaatcacaaaaaaatgcctgctaaaacaaaataaacaaaacctattagagaaaaggtgttctcttatcagaatgtagggcctccacaacttaacgtttataatgtgtacaatccaaacttattcgacatatgaagaactggaaaagtgggacccattctcaagggaaaagatagcggagattcactccaagatgacccagatgttggaattatccaccaaggattttaaagctactattataactgttctcatgctataaaatccactatttagatcatacttaattgtgaagaaatgaattctttcctcctaagattagaaacaaggacggcatgaatacccactttcactactaacactgaattttgtacgaaggtcccagtcagttcaatatttttaaaaagattttaaaaaaagcaataaaaggcatacatattggaaagggaaaagtaaactgtctaaatttgcagatgacaaggtcatataatggtttaaaaaaagctactagaacaatatgtgagtttaccaaggttaaaggatacaaggtcaatatgccaaagtcaagtgaatttctatatatttgcaatgaacaattcaaaatggagttttaaaacatttttatttatgatagtctccaaaatactttttaagaaagaaaatgacagaagcaacccaagtgtctactgatggataattaaattatagtatataaatacaatggggccgggtgcagtggttcatgcctgtaaacccagcactttgggaggctgaggtgggaggatcactcgagcccaggagttcaagaccagcctgggcaacatggtgaaaccccatctctagaaaaagtacaacaattagctgagcatggtggtgcacacctatggtcctagctactaggaggctgaggtgggagatcaccggagcacaggaggttgaggctgcagtgagctgtgattgtgccactgcactccagcctgggtgacagagcaagaccctgtctcaaacacatatatacatacatatgtggaatacaatggaatatttacttaaaaaagaaagaaaattccgacaacatggatggaccttgaagatattatgttgagtgaactagtcacaaaaggacaaatactgcataattgtacttttatgaggcacttagagtaatcaaactcagagacagaaagtagaatgctggttgccaggggctggtagaatggaaagttattgtttaatgtttataaagttttagttttgcaagataaaaagatttctgtggatggatggtggtgatggttgcacaatgtgaatgtacttaatgccacttaaaaatggtcaagatggtaaattttatgttatgtgtattgtaccacaattttctttacaaggtctcaagttggacattaaaatgccaggcaattaaaagtatttatgtttaaaacttaatttaaaaaataattgacaagtatattctaaaatttgttcgagaaggcaaaggacctagaatagcaagaatactcttaagaaaggaaaacaagtttggaaggacttaaactacctgaattcaagacttatcattaagatacagtaatcacaacagtgtgttactggcataaagatagaccatatgagatcaatggaacaaaataaaagctttaaaatgcaccaatacttatatggtcaattgattttcaacaatggtgccaaagtaatttaatggggaaaagatagtcttttcaaaaaatggtgttagaacaactggatatatatatatatccattatatatatacactcatttatatatacatcatatacatgtatgtatcatatatatgtatatagcctcaactcttatttcatatcatatacaaatatttgaattgattgtagacctaaatgaaggagctaaagctattaaacttttagaagacagcataaaagaatttccttccttctgccttgccttgccctgccctgccctgccttgccctgccttgccctgccctgccctgccctgccctgccctgccctgccttgccttgttttgtaacagagtctcactctgttgcccaggctggagtgcagtggcgtgatctcagctcactgcagactcaatcacctgggcttaagccatcctcttgcctcagcgtcctgagtagtttggactacaggcatgcgccaccacacttggctaattttagttttgtttttttgtttttgtttttttgtagagacaaggtttcattatgttacccaggctggtctcaaacttctggactcaagcaatcctccctcctcggcctgtaattatttcttaaacagggcacaaaaagcacaaatcacataagaaaaaaagataaaacagacttcatcaagatttaaagcttttcctcctcagataacgagttgagaaaacaaagacaagccacagattgggagaaaacattggcaaaacagctattaaaaaagccttctatccagattatataaagaacccttaaaactcagtaataaaaagacatacatagtaagtaatgggcaaatgatttgaacaatcactttataaaagaagataaatgaatagccaacaaacacataaaaagatgctgaacatcacaagtcattcaaggaagtgcaaattaaaataataataaaatactattaaatgtccactagagtggccaaatttaaaaaaaatgaaaatcaccaggtattgtggctcacacctgtaatcccagcactttgggaggctgagatgggccaatcacttgagcccaggagttcaagactggcctgggcaacatggcaaaaccctgtctttacacaaaatacaaaaattagcctggagcatatctatagttccagctactcagggggctgaggtgggaggatcgcttgaaccctgggaggccagtctgcagtgagtttagatcatgccactgtactccagcctgggtgacagagcaagacactgtctcaaaaaaaaacaaaaaacaaaaaaaaaccccaaaaaataaaaatgtgaggaactctcacacatttacacattgctgaaggcaatgcaaagtggtacagtcaggccggaaaacagagtgacaaggtcctataaaggagtggtcccaacctttttggcaccagggaccagtttcatggaagacaatttttccatggacagtgggggaagggaatggttttaggatgattcaagctcattaaatttattgtgtactttatttctattattattacattgtaatatataatgaaataattatacatctcaccataatgtagaatcagtgggagcactgagcttgttctcctgcaactagatgatcccatctgggggtgatgtgaaacaatgacagatgatcaggcattagattctcataaggaacacacaacctggatccctcgcatgtgtagttcacaatagggttcatgctcctatgagaatctaatgcctttgctgatctgacagaaggcagagctcaggcagtaatgcgactgatggcaggtggctgtaaagagagatgaagcttcattccctttcctgccgcacacctgctgtgcagccccattcccaacaggccaccgacaggtactggtccaataaagtggaagatatccttaccagtaacccaacaatcccttctcctagagaaatggaaacacatgttctcacaaagacaagtatgcaaatgcacatagcagcattattcattgtagccaaaatttgaaaacaacccaaatgtccatcagctggtgaatagatccattgtggtacatctatactgtgggatactactcagcagtaaaagggaatgaactattgatacacaaaacattatagatgaatttcaaacacattatgctaagtgaaaggaatcaaatacaaaagactacattctgtatgactaaatttatatgaaattttagaaaaggcaatattacagggaagggaagcagatcagcatatacctgaggctactaagccaggtgaagggcaggttgcaaaggggtatgagaggcttttagcaagtgatggatgtgttctgtatctttattgtggtgacat

SEQ ID NO: 162 - DNA, 32749 bp, Homo sapiens; identical to SEQ ID NO: 161

SEQ ID NO: 163 - DNA, 32749 bp, Homo sapiens; identical to SEQ ID NO: 161

SEQ ID NO: 164 - DNA, 32747 bp, Homo sapiens
ggcccgcccctcgcagccttgccgcgccccgtgcgccctgtccgcccctcgctcgcattgcaggcatcctgagtctcggcccttttcgccaaatcgctgctctgccgcgcgcctacgcaaggaaagattcaagggtccctccacttcagggagtggagcccgcgcctcggcacggatcagctgtgcgtctcctttggcctactggctcctctgcttgtgtctatagctagctggacgcatcgtgactttatcttctcatctttcctggcgcccccagacgcatttcctggtccctcgaggcagcggcgtctggggagtgcactttgcacagacagggaaaccgaggcactcagcggtctccaatggagacgctgtaatcgcattccacgaccagctagcgctataagcgctgcctctaaagcggaaggcctcccagtccttctcgacaggaagcaatatttgcatatctaaggagaacaagattcggcaatgtgctccgggagcaagtgcaggcatggaacggtatgggctggagggggacagaccttcagaggcggctgcccgttccctgtagtgtcacataagatttttagaagataggagttttcacagtggcggcagagccctctgctaaatcctcatattagatgtcaaaggtggcatgtcatttgacccaatggcttttttagtcatttatcttcctaacacctatgagaggtaagacatagctcccttacccatgagcaaactgaggccaaggaaaaggaattggccagtttcccagctcacaaagctctgtgggagctggtgttttgtttggaacttctgcttgtccaatctgtcagtcacggttcgtggccaccgtggaacacccaacacagcaacttccgcccttaattatattgagccatgaaaaagtgtgattgaaacctactgtctgaatcagatctttgcaatgattaaccccagaaaatgatctgcaaaatgcgtttacagaaacatgcagctgctctcaaacacactggaggaaatttgggagctgctgctcttgtccaagggcactaacccatccctgatgagactgagctccaggctggggcagagatgctaggctgtcatactcagagacatggcctctcaaagtgaggtcaagaggccacctatccagaattgcctgtggtgcttattaaaatgcagattcctgggtctcatcctagaactagtaaatcagaatccctgggggtggtccaggaatctgcatttaaagtagggattcttatgcacactaaaggttggccctaactgtactaggaggaaagaaccagagacaagaatgctcatagcccaaatgttctttagccgtcttggccccatagatggcagtgatacatatatcacatgcatacacaagaggatgatggtaacatatgacaggcgagaaagagttgcccctgggaagaaagagaaagaaagacagggcagagtagagaaggaactactcactcattatcctctttagaatctcatatttttggtggaagcataggttacaaagatgataacatagaaatgtttaggtaagagagtctaaggtagcagtgacttcagtctcctgaaagacattctgcaagatatttagcattcttagccttttttttgagaccgagtctcactctgtcacccaggctggagtgcagtggcacgatctcggttcactgcaacctccgcttcctgggttcaagtgattctcactgcctcagcccctcaagtagctgggattacaggcacgcaccaccacacctagctaatttttgtattttttttttttttttttttttagtagagacagggtttcaccatgttggccagcctggtctcaaactcctgatcgcaagtgatccgcctaccttggcctcctaaagtgctgggattacaggcgtgagccacgtctttgttccagcaaaaccaacctagtccctgattcacaaatcatcctgggagtgtacagcacttacagccagaaagaagtctctggagcaaaaagcattgcatattcaatggtctatgacatcaccatcgaagactctgtcaaaaggggttttgtttgattaattttcattatctgttgttacccaactaatgaaaggtgatactattaatgagtgtgtgaacgagacagtgtcttcgttaccacctctgaaacactcccagctttttcagggacgaatagccctgacccaaagtgtgtcctttcttcattgtagggagatacaaactgtttctctccaagtactccaacaccaattattgtgtgtcacaaccgagaacacaatatgaggcttgtgcttgaattactgctgttttatgtgccaaaaaaaatgctagctttcttttttcagtgaagttgatagagttggaagacattttaataccacatttattggtttgaaagcatgattgttttagtagctggtgcaaatttcaaggaacacataactccctttaagaaatattgtttctaagaaattacatttgactaaatttggaagctttaatgcaaataactttcaaacaatgaaaccatattcacaaggagatgcttttattttctccactgaggaagaaatggagacatgtttcctattgtcgttatgtccatctggacagaaaaggaagtctgtgggctagacaagcaaaaataggttacatctgggtagcccagcagtctctccctgactgctgaagaagctcctctttgtttcattcctgaagcacggcgttgttttcttggacccgtgcatcaagttaaacctgagttagactatggatcccttgcacttgattttatgattgtaagacttacacaaatgcaagcctagaacacaattgaactcttatttgcttacatctccatgaacaggaaagaagccacttgatcttctaaaagttttgcccggttgctttctcttttatacctattgttaagctataaaatgaaatcaccaaattatcaatctgcgagtatttgctacttcgcaatatatatttaagaattttacaaaacaaaactgtgccataaaaagtatttcatccatatgatcttacagttccacttctaagaatgcatatacccaaaagaattgaaagcaagatctcaaagatatttgtatacctgtgttcgtagcagattatccacaatagctaaaggtggaagcaagccaagcgtctatcaatgtatgaatggataagtacaatgtggtatacacaaacaatgaattgtcattcagccttaaaaaggaaggatattctgggctgggcgcggtggctcaagtctgtaatctcagtactatgggaggccgatagaggtggatcacctgaagtcaggagttcaagaccagtctgaccaacatggtgaaaccctgtctctactaaaaatcccaaaaaaaaaaaaaaaaaatagccaggtgtggtggcaggcacctgtaatctcagctactcaggtggctgaggccagggaatcgcttgaacctggaaggtggaggttgcagcaagccgagattgcaccactgcacttcagcctgggtgacagagtgagactttgtctcaaaaaagaaggagattctgacacatgctataacatggatgaaccttgaggacattatggtaagtgaaataacccattcagaaaatagacaaaatctgtatgactctacttatataagatatctagatcaaattcaagagacagaaagtaggatgatggtaatcaggggctggagggaaggaggaatgttactgtttaatggcataaagtttcagttttgtgaagtgaaaagagttctagagatggactgtggtattggttgcacagcaatgtaaacatacttaatgccattgaaagtgtcacttaaaaatagttaagatggtaagttttatgttatgtgtattttaccataatttaaaataataatttttgaaagtatttcagattttatgccaaagttcttattaagggaactttcaattttttcaaaaaagtttaaaatactttccacctaattttcaaagtaaatacaactttcaaattaaatacagggaatttaattaattccctgggactttcaggaaaccaaacttctgagcactgtttatttgaagaaagccttcctttttccctctcctttcgcataatttctccctagtgctgtatgttggtcagctttgttagctatttatttgtgctggtctgtggctttattgctctggtctttatcagaaacttaggtaaatatttgcaaccttgacaaatgatgcttggatactgataagtctttacattaagaaggatattcttaataaaattaatgttctacttagttcacaaagctgtacacaggataaatagcacaaggcctgccgaagtgcctggagacagtagacatgaacacatgttgtcctagtagatatttgcttatcaagcaccagcaaacaatagagctggagggacccaaagagagcctaatctctgtcctctagagcactaggtttctaagcaggtcatttaaaagtgacagaaaacatggctgtaaacccctatttctataacagctagtaaagcacttgcacatatttatatattggaactctgttcaccccaaaaaaggtttaaatccctttgaccatgaaaattggttgcttatgacttcaaactatactacagggctacagttaccaaaatggcatggtactggtacataaacagacacacagaccaatggaacagaatagagaacccagaaataagactgcacacctacaactgtctgatctgtgacaaacctgatgaaaacaagcaatgggaaaaggttccctattcaacaaatggtgctgggataactggatactcatatacaaaagactgaaactggactttttccttaaccatatacaaaaattaactcaaagtggattaaggacttaaatgtaaaacccaaaactgtaaaagcctggaagacaacctaggcaataccattcaggacatagacacagacaaagatttcgtgacaaaaatgccaaaagcaattgcaacaaaagcaaaaattgacaaatggaacctaattaaactacagagcttctgcacagcaaaagaaattatcaacagagtaaacagataacctacagaatgggagaaattttttgcaaacagtgcatcgacaaagatctaatatctagcatctataaagaacttaaacaaagttgcaagaaaaaaaaatcaccccattaaaaactgggcaaaggacaggacatgaacagacacttttcaaaagaagacatacatttggccaacaattatatgaaaaaagctcaacgtcactgatcattagagaaactcaaatcaaaccacaatgagatactgtctcataccagtcagaatggctaatatgaaaacgtccaaaaatgacagatgctggtgaggttgtggagaaagggaacactttacacggttggtgagagtgtaaattagttcagccattgtggaagacagtgtggtgattcttcaaagacctaaagacagaaataccattccattcagcaatcccattactgggtaatatacccaaaggaatataaatcattctgtcataaagatgcatgtgtgtatgtttactgcagcactattcacaatagcaaagacatggaattaacctaacatcaatggtagactggatgaagaaaatgtggtacatatacattgtggagtactatgcagccataaaaaagaacaagatcatttactttgcaggggcttcaatggagctggaggccatatccttagcagctaatgcagcaacagaaaaccaaatattgcatgttctcacttataagtgagagtcaaatgatgagaacacatatagggaaacaacacacactgaggcctatttgagggtagagggtggaaggagggagaggatcaggaaaaataactaatgggtactgggcttaaatacctgggtgatgaaataatctgtacaacaaacccccatgacacgagtttacctatgtaacaaacctgcacatgtacccttgaacttaaaataaaaatttaaaaaaagaaaataggttgcttgactctgcacctttccttctctgcttctcacttcccaactgttctaatttcatatgggaatccatgcagttatggagaatccaccttcagcaatgggaatgaacctagcaccacatgacctgggctggatcaatcatcacatactatcccctgacccagtgattggttcagggatggacatgtgacctaagagagtgtggttagagtaaacctcaggacttctgctgataacattggcaaaaagattttttttttaaatgaatgagggcatgtagcctcacagaacagctggaagccattttgcaaccacagagatctgccaaagtctccctaagatgaagaaacactgagatagcagagccaggaaatggtgaagggaatgttggtccctggtcaagttgtttgagctagccctgaagtttttcaaatctctgtgggcttttcaattgcatgagctagtaatttccctttattacttaagccaatgtgaaccagcttttctgttacttagaaccaaaaacattctgctacatcattgatacacgtcaaacacccccttccttttacagaagaaaagactaaatctcatggatgctacgtggctagttaggaggaattgccttcccagttccaggcctttctccttttactactctagccacttgtgatgggtttggtaacaatgagtaaaatgtgcattctccttatttctaaccacggattggatatgttcagaaatattaaaactgattttcctcaagtgtatcttctggcaattaatgtcattgctttatagccactctgtactacgggcccttgtgattcattagaaaaaacaaaggatcaaatagttagagaaggtataaggaccttgtttaaaattttatttaatttgcagctaatttaccagcaacttaggctcaaccacgtatgctgctttgctagtttcttcaaaacttgtcatgcactttcatttcttggtaatcatccctcattaccatttcttatctttcaaaaacacagcctcaccacactgtattcttacctttggtgcctccctctacagctagaatttccagattctgtgggctcttcctctgtaaactctaaaaatccttccatttttatctatacatactatttcccccactctaacagatcttacctatcaccaaccctaaaattacctaacaaaatgctcatcacatcttcaaggaaatgtcccacagtgagagaaaagagaaaggaacctgtgtttattgtgctaggaagatactagatactttacagacattaactcatttaattttcatgaccacaccatggtaagtaggtagtagtatctcagtctaaaaataaggaaactgaggttgggtgagtcatagggttgaattccaaacctaggtgtgtgcagttctaaagatactttcttccactgcttctgttggacaatagattttgccccttttgtaccagctccaaaggatagtgaccgcctggatctcgtgttgagaagactgaagcctcatccaggttgacagggaaagacaaaaggatgtcttgccaaagcttgccaagggggaaagtggcaatccacacaccacttatttcacatttcttcaggcctgtgcctggggcagttctagaggtttcccaggagaaggacaggtgcaccagggagtctggctataaagtttgtacactagaatctgttggcagattctgttgcttaaagttgagtttgcattcatactttatatctgaagaaatgggaagttagggagttaaccactgtctattgggaagtgattcatgaatcagaacaggtgagaatgtcaggctctgaaatgaacagcacacttctgtatggaatgtactggggcagcatacctgccttctttctcagatcaatgttgacacacttaaatttgtgaataaggccttccaggatatcttgtttaggaagaaccagttcacttgctagtatctaggctttctaggtatcacgagggctttctgtcaaagcataaacaagcagtgagaaatcatcagtgttctctctctgaagagagagacaccaggaaaggagagagggtagcaagttagcaggcatggaaagctgctgctttgcagatgtgttcatcaggcataatccttagctggatgttagacagtaccagaagttgcatggtgacttgtctgatggttgcaaagatattggtcctcatgtgggattattcaagatattcagaagggaagaagctgaatctggttacaaaaggtgttccttaaatacgtaatgaatgaatgaataaacagttcaatggaaattggggcaaattaaggattcagtagatgtgaggtgtatttgtctcatgtcctcatctgatgaacatctaccatattcagttgtctagtgaggactcttttagtgtagaaaccaaggaggcacatttggggttcatttagagatggggtatttggggctggggggaagccagcatatgaatgatgggcttcaccaggagacaaagggcatctgtctaagggatggatgctgagggtggacctggcaggctgagcaggtgaaactcttccattggagcagactgtgggtttatttgagcttaagaaaaggaggtcattcccaagaatgaatagcagtggatttgtagactttgaaattaacagatcaaagacaccagatctctgtagagaacttaatatgatctctagattctgaagctccaattctcagccctggctgcaccctagaatcacctgggagcttttcaaccctaccactgccagggtttctcccccagagctttggattcaggcagttcagagtgaggccctggaatcagtattttcaaaaagacctccaagtggctctgagaatatcactgcagttgagactgtccactctagacataactcaaagcaggcaaattttcaggattccatggctagactatgacatttccaacaacctcaagagagacattttaggattattcattcatactgtgtgcatccttggtttctcactagcccctgttcttaaggcctggcagattcccaggtgacttctatccatgagagtgtcccaagaagggccactgggaaacacacttatagagagtttggattatgatcccaaaagacacattcctgaatgccatcatccccgaggttgaaatcctgaaagatcaaaatttctaaagactaaatccttaacatctaaaatcctgaaaatcacaatcataggatagttgcatcatgttaggtgaaactgttaccttgttgtggtctttatttggaaattaagtatggtttaaggagatgcatatagtgccaagttgacagggatggatttattgacttaatttgagatgtcaacttgactgattaaggaatgcctgaaaccctggtaaagcattattttgggtgtgtgtgagggtgtttccagaggactgagtagactcggtgaggaagatctgcccttgatattggtggacaccattcaattggccaacaatctggagataacaaatatagaaggccaactggtctctctctgagagctgggacagacttttcttctgctgccttggacatcagaactccaggctcaccagcctttgcactccagtacttaacagcagcggccatctgggtcctgaggcttttggcctcagagagtaacaccattgtctgctgtggttctcaatataaaaacattgaaacttcctcaataaatgaacagatttcctttttgtgtatctgcatttgtgaaagaccaaaatttcttgagatcttgcctttttgggccactgcatatgcagtggtgacctatagaggtttttgattgatcttgtcaaaagacaggttgtccatcacagtatttcggatgactggagttataaagctaggtacacacaactaccaaccatcatgatacatgtttatacactttgtttttggcatattgccttatgaatacagttcatctgcttgtaattgttgtaatcatgtgactgttgttagaatagctgagtgcttatgtttgcaaagatatatatgttattattgccaattttattgtgtaaattggcctctgaagtgctctgtcagtttttatatggttctcaaataaatctcccttaaaaatgtaaataaatgttttaaagataatttcttcttattttttccagaattatatttttgggattttgatctttcaggatttcaatatttgggatgggtctttcaggattatgatcaaccccctatgtggaaccatactggggaaactatgaacaagaataaaatctcagaagcctgggattttgacattggaggcaaaggaaaatcacatcagagagccctgctcagtgcaaagagcgctaggccgggtgctggaagtgctgactttcactcatgactgcagctgccccactgtgatcctggggaagtgaccactgtgatcactgtgggtctgagtactgtcatctgttcacttccatgtccttccacttctgtgactctgtgaggctaactctgtttctatttttttttttttttttgagacgaagtctcattctgtcgcctaggctggagtgcagcggtgcaatctcggctcactgcaaccgccgcttcccgggttcaagcgattctcctgcctcagcctcctgagtagctggaactacaggtacacaccaccacacccggctaatttttatatttttagtagagacagggtttcacgatgttggccaggctagtcttgaactcctgacctcaagtgatccacacccgcccccccccggtttggccccccacagtgctgggattacaggcgtgagccaccacaccccgtcgcctaactctatttctaaaagctctgccagttggagatttctctagcccactagagtttctggctttgggggacagggagggaagggaggggaagctgtgttataagaagaaagtttaaaaagtaagcataaattatttgagcttttaagagacattaacaagctaccatactgagggtattaagaacactaaaatttgtttggctttggatagggaagctactgaaattgaagaagaaaagatgggactgaatgagcactccttgggttggagaaaaaccaacatgatcattatctaatcatcatcataataatgataatggacatttgtatagcacttggcagtttacaagttactttcttataataataattaccactatatggtacattacagtaacaaatactttttagggctttaccccgttccactgtaaaagttggtattagtggaggatgtaaatagacttatctacatgattaaggaactaggaggagtggaggttcaacaccagcagttggacagcaaacatcttagaagaccaggcacatcttcagccacacccttgggttcaacttggtggtctcctggttggggtcaggagcagaagtggggccatggcctccacttcccttcctgggcaatgtgcctttctttcatcaccatggagtccttgcctttgttttgtttctccttgtcatttatttccattaacatgcagtggtttttgtcctttctcttcccgattgtcactttcctcacctagatagagaagaaccagccctcacctagctcactagtctgtatcaggctcaaatgaggtgatgtatgtaaaaaggttttgagacgttaaaaagcacagtccagaaatacctgaaagcatgtaaactcttacgatttgggggcttagcaggaccaggaatttgatctcattgcctccaggtcatatcatgaccctctaggatccctcctccctgtcacacatccctctatgggcacattgattccaggatttccagagtacatcagggctgagccgacctcatggccctcgtggattgtctctgatatggtttggctctgcgtccctacccaaatgttatcttgaattataatccccacatgttagggagggacctggtgggaggtgactcaatcgtggtgcggtttgccccatgctgttctcgtgatgatgagtgagttctcacgagatctgacggcttaaaagtgtggcacttcctacctcactctctctctctctcctgctgcattgtgaagaaactgcttgcttccctctcaccctctgcagtttcctgaggcctccccagccatgcggaacggccagatgcagtgcctcatgcctgtaatcccagcactttgggaggctgagggaggattgcttgagcctgcttccatatcgtaaactgccttggaaccaattaccactaccagggagacaaactattgcttagaggatgctgacaggagcagcatgccaaaattggaagaaggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaagggctgccagccagagaggaggagaagcaatcactcctgcagtttctgaacactacacagacgccaggtagcttcttcaggagaacagccctctgaggaggcaggaagaggaggcttatctttcagcagccggagctgctgagatctctgggcagattaagctctctctaatggatgggctccagcctggcacattcagtggagagggatccactcatccatcatcaacataatatggtcctccctgcacttcacagtgtcctcttgctattgaaaaggcttttttgccttctcaagtttctttgtcaacagtctacaggaagaagctcaggccgccaccggcagaggtgaatgcaagctcacgttttatttctgactgcttaatcattgcctcgatcactgctcaagctctgcctttgtttccaaaggttacctgtgggaaaacttctttttctatgctgaaattaatagggaggcaaagatgagtccactgataagcagagccttaaaactcacatagagaaacaactttgctggagtgtgtgtgagtgaaccactaaggaatcagatagtgtgatggcagttatcattgcaggttaagacatttctacaaatatttcgacatctccatatactcactcctttcccccctgagtggagagactcagctaccaagagaggaagctcaaaaaaaacagaagcttcaaacaaacaaccaaccaaaaaaaaaaaaaaactgtgggttcatcagaggtggtagggaagacaaaaacatgggaggagcagctgggcacggtggctcaagcctgtaatcccagcactttgcgaggctgaggtgggtggatcacctgaggtcaggagttcgagaccagcctggccaacatggtgaaaccccatctctactaaaaatacaaaaaattagccgggcgttgtggtacgcacctgtaatcccagctactccggaggctgaggcagcagaatcgcttgaacccaggaggcagaggttgcaacgagccaagatcgcaccattgcactccagcctgggcaacaagagcgaaactccatctaaaaaaaacaaacaagcaaacaaacaaaaaacacgggaggagcaataaaaaggaatccatgctttgatttttttttttagtgagaggaagggaaggctgctgcctctcacttctccctgttttgttgttcttttaagtagcatgtgtcactctgtatatatcctgtccatgtgttttcttttattattatttgtccacttgcctagaatgaaaactccatgggagcatggctatagtgtcttgttcactcctgcctctccagggcctgaaacagaagtaggtagacagagcctgaaacaaaagtaggcagtccataaactttgctgaaggaatgagtgaatgaatgaagaccccaaggatggacctcaggaaggtgagcctgggcaaaggttttcagtcctagtccatcatgaccacatagctggaatacacttatttcactttgtcacatgaattagagattcatttggggaaacaagcaactgttagagttgcagacatctctgaggggtaaatggctgttcaaatcttgcatcttaccctgatcctcactctatctgctttccaaaaacatggagctaagatcccagcactgagaagatgggcattcctagcagggggcatttaggtgtagacagcctcagtgactcctgggtttaggatcagtgagataatctccagtatctacagtgggcaggtggaagagtgtctgatgcaaactgtatctatttacaagctttccagacagctgggcttgtgccttggaaatacaataatatttgtttctcctccttcctcttcactccttggcctcgtgttctgcagtactggaacctgggtcagatttagctacctcattcattcatttatgaattcatttagccagtgattatggagcacaaatttgtgccggaaactgtgcctcagtgtcctcaacaggttctgacttgtgaattccaaaagcttttgtgatctactgggtaaaacattgttttctaaggaaaatgacatgctgattgctgaacagcatattctaattaccttgtggatcccaggccattcttaaattgggttttgtctttattgccttagactgttaatgaattgtttcccagtctgattgaatgctccttgaagacggacccgggtccagccactgcagtaaatattgctaacttgggggtgtaattctgctgcttttgtggttgctgctttgcttatttttttatgtctgctgtttcctgtgagattgtttctgtgtttcatatgtggattgatgttcggtgaggtttatggaatttctgtgcagcttgggttaagagtatctcttcaaaaaggtttttgcatttgcttctgccaaccttgttatcagctcaagttgtttcttatgttgaattattggggatgacctcccccacactcaagtagtataaattagaacctcgctgggtgtggtggctcactcctgtaatcccaacaccttgggaggccaaggtgcgcagatctcttgagtccaggagctcaacaccagcctgggcaacatggcaaaaccctgtctctagaaaaaatgcaaaaattagccaggcatggtggcacatgcttgtagtcccagctattcgggagcctgaggtaggaggattgcttgagcccaggaggaggaggttgcagtgagcatttatcatgccactgcactccagcctgggcaatggagtgagaccctgtcccccaaaaaatttttttaaactcaaaccctatggtattatacctgctgtgggtataatcctttagttacgattggatgcttgctatgatttctcagaaggaaaacattttttcctacccagagctctttacagctaagcagaatttccccaaatgtgcctttaaaaggtattggcttatgcaggcttctcagtttgatgtcttgttcctgaatgagcaatgaaaccccaaacggacaaccttgccctcaaggacagccgaagtatcagatactccttgcaactccttatgtcagctcacactccatttgtggacatggagcatttccttccttttttcttttccttttgcaaatctagttatgcatttaaaaggatgcaatgtacccattatttccaggtgttttatggcactaatgtgtatggcagaaatgggtgttctctaattgttcataattcaaggtaattatagacatattgtttcaaaattaaatcaatagattttcaagccatgctatgtataaagctccatgcgggacacaaaaagggaaaaaacactatgtaccatgcacccttaagcaatttcacacatgctgtcttatctaattttcacgacagtcttatgagacagttattatccccattttatagatgaggaagctgaggctgcatgatgagtggcttgctcaaagtcacatatctaatcaataagacagctggcataaaacccatatctcactcgaaagtctgtgctttcccattgcacaggttcatgacatagtccaagggagaagacatagctgacaaaaggatcaatagcagtgtaagagtagacaaataaaacaataaggactgcattgcaatagatgttatgaagagggacggacatgattcattgctagtgaatataggccaaagggctataacttcagagtaggcagagatttgtgggccacagtgggaaagatggaggagaaagttagcttgggccttgaagatattgtctcagtgaatgaaggggagaagaccatgcctggcagtggagagagcacaagcagaaggtgggaaagcgtgtgcaggttatgggctccatgagtaggtaggtcatggctatatacaagtatgctgggagataagatggggaaagtttgagtccaagtatggagggctttgattggtaatgaatttggattttatttggtaggcaataaagaaccccagaagacttttgcctaaagaatgatgtagctgaggcagtactttaaaaagatgtgtatggaaaaccatgtacaaattaattgtcaggggagagaatgaaggaaaggagagagcttggattaaggggaagcagtgaaaatcaaatggaacagatggatacctagatatttctcatactgagggtgccaaggccaattgttcttaattaagcaccaatctggttgattccatgggaatttgagatgtcatcaaggtatattgctattgtcatcttccacagactgagcaccagtcaggccactgggtctgagtccctggggctggagcgggtccagtgggcaatttattaaaagttgccaggagaagaagggtgaatgcaggccacatcctgggaaacacacactgaacgtcaatgctggagaattctgagttgtacctctaagttcatggatgagcatgatataaggaagggaaggcaaaaataaaagtagaaagacaggtactgaagtattgtaaatgaacgggtccagtatttgtgaatggaacccacaacttgttttaattagctttaaggtgtctagtacattgtgggtcagcttagtttaaagatataggactaaggcgagcagctttaacatctgagctgaaagggatataaagatgacataccctcttctaaacttccacgactctaccacagcacttatcataatgcatcatgattatcaagttttatatctgtcttctcactagactgtgtactctctgtgggcagggactgtgtcctgtttatctacattcctggcatctggcacaaagcccagcacagggtagatgcccagctaagagttaatgatggcttggaccagggtgatagcagtgggagtggtgagaattgatcagtctttaaatacattttgaagataaagccaaacgggtttcctaatggattggctatggagtatgtaagcaagagagcagtgaagaatgacgcaaggatttgggtttgaggaactagaaggtaaagttgcaatcatctgagatggagaaggctgcaagcagaacaggtttcagagaaaagatggcgggttcacatttgaacatgctgatgctgggtgtctattatgttcaagtggagatggcaagtggcagtggtttcttacatttgaaatctgagagagaggtttgggccaaagatacaagtttgggagtcatctgcataaagatggtattaaagagttctaaacggggtgttatcaccaggggagtaagtgtagacaaagaagagcgccaaggtctgagtcctggaatattacaacactcagaatctgtgagaagaggaaacaccagcaaataaaactgataaagagcagccaaggagataggaaagaaactaagagaaaggggaagtcctagaagccaagtgaagagaaaatatagcaaggagaagggggatcaactgtgtcaaatgccactgatactcaagtaagatgaggagtgggagctgcccattagatttagcatgtgaagatcattgatgtccatgataagacttgggtgcctggttggggcaaaagcctgagtggggtgagtttaagagaaaataggaggacaggcattggagacaagcagtacagacaactcattataggagtgctacaatgagaagcatctaaatggggtggaagctgatgggcaaagtgggattgagagaagccacttgttcatttagatggaagaaacatcagcgtgtttgtattctgatccagtacaatgaaaaggctaagagcttagacctgctaagctcacatactcaggcttccatcttctagtgatgactcctattgtgagttcattgaggatgagagctaaatgtctacccttacctcttgacataagatatatagaagatgcttagcaaatatttatcaaataaatgactatgcataaaatactttgcaaactctctgagccgcagtttcatctgttaaatgaaagtaatatcacctacctcagagaattaaataagataaagtacatatagtatataacaaagagcttagtacttagtatatgctcagtaaatagttagttttattgttagttcaatgctttcattttacagataaggtatctgaggcccagaaaatagtttgttcaagattgcacagttaatgacagagctaccagtttcctagactcatattccttagctttttccacataaccagagaatttacctacaattcccaggtaccacagatgtgggtgctttcaagcctctgtaaattcactaagttgatgagaaacctggatattagtaattaatggcagatctgaaatctctctagaaccttcctatgtggccaacatatgtcttcctgtctaatttgtcaagatactctgcaaagtcaatcctagtacaaggctccatattcatcttgaagctttttcttgttttaccagaattctggttttaattttttgagtagcaatccatgttactctttacatacccaagtcaagggacaaagctaagccacatgcttgttttgttcattatccaatattatgtaagtctagatgactgactccattagtttaactccaggtgacaatgtagatatagatccaaaatatgtttctggacaatattaatagaaatttttatgaccttggaacacaccctccctcattgtacttgcaatagatgaataacctgctcttgctaggatgagtgaagaatgtttacctttgtcaacatttattagtggagtactatatgcagctattcctttaataaaacagtaaatcttcagcaaagtttataggttgtctttcatccaaagacctcaaagaaactttgctaacactgtgtcattattcatcatacaacttgccaagggaggcaagtggtgattgtttcaaagagagaaactgaggttccaggaaggtttctgtgacttctaagggtcatgaacagggtaaaaaagaaaaaagaaaaaaaggaaagaaagagagagagagagagagagatctgggcactgagcccaaattcctgttgctcaggccaaagacccagcgctcctcctagagctctctaaacatttctttctgatagaaaatgtaatttactaccttgatctgttaagcagaaatgaactctcaacctgtcttcaatgacagggaaagccaacctttatttctgaagttacttcaagtcataaaatgcttgattcactgtattaaataatacagtattaaaataagtaaatagctttgtagtcataatgatagcttggatttaaatggtgcctgtgctctgaaaagcagggtagttcacaggcttctgcagacctttggtctcatttggctaccctcctctacccttcttcttcttttttttttttttttagacgaagtctcgctcttgacccccaggctggagtgtgatggcgtgatcttagttcactgcaacctccgcctccccagttcaagtgattctcctgcctcagcctcccgagtagctgggattacaggcgcctgccaccacacctggtgaattttcgtatttacagtagagacagggtttcaccatgttggccaggctggtctcgaactcctgacctcagatgatctgcccgcctaggcctcccaatggctacctttcttgacttcaagtatccctttccttcccacaggtcttttcttcaccaacctgctttcttcactcacacccttattctttcattcaattattttttcttctgcactagcagctctcaagtgaaaagaaactccctgctttagctgtatatgaagaaagacctccaggccctctggaagagctgtggaaggccatcctatgtagatcctccaagaggctcttacaggaatgagttaagatcccatcttgtttggaggttaatgatcaatgtttcagagactgactagaactaatcaaacattcaagttctcttctaaatttcccagtccctcttctatttagatctgggccttataactagttctggccaataaaaagaaaggcagttgagaattatattcttcctccatcgccctcttaacttgctacagtgaccttggaggtcacatcttccaagacactacagctacaagatggaggatggttgcccacctgacttctgactttgcatgagcagtaaacaaactgtcatccggttacctggagatcaaaacccctgagattttgattgtagcagctgctgtcaattatcctgactaacagcaggagtgaaatattgcaatagtttaaaaaaatctaagagatgtggcattagcttaccagttaggctggatagatggaaatccatgatatgcagtggcaaaaaatttaatgaagtacggctggcgataacttggaaagcagaccatgagccaactgagtttatacatttaacacagaggccagccaacttttccataaaaagccagataatgaatattttcagctttattggacagactcctttgcaactactcaactaccattgtagcatgaaaacagccatagacaatatgtaaacaaatgaacatggttgtgttcaaacaaaactttatttacaaaaacaggtagcactctggatttggtctgttggctatttgctgacccctagtctaggggaagagtttagataatatgttgccattggctgcatttgacaaggaattaaagttaagagatgagtttagaaagtgttggccggcttgcaggcagaaattaaagagagaaatcaggaatttggattcccaacttttcacaagctgtaagtggtctaaaaatgctgtacagactccagtatccacttagatagggagaaagaggataaatacacaaaaataaacctcctgataagcagagtaggcatggaggagcatgaatgtaaggcgagcaggttaatatttgaacaaagacccgaaaaaagtaagggacaagccaggtgactatatagggaaagagcagaattatagcaagtgcaaaagccctggggcagcagtgcacctaatacctgcagggaactgcaaggatgccagtattgctggaaccgtgggcacaaagggtgggaaggggggtggtagtaaaagataatatcagagggagggcaggtgggcatggggcagtcttcaaaggtaaatcatacagggccttgtaggtcattatgaagatgccagctcttattctgaattagtgggaaagccatagagggtattgaggtgaacagggacacactccaacttatattcttgaaaagataattctataatatggcaaaaccccatctctacaaaaaaaaaaaaaaagaaatacaaaaattagccaggcatgatggctcacgcctgtagccccagctacttgggaggctgaggtgggaggatcatttgagccccaggaggtcgaggctgtggtgagccatgatcacactgcattatagcctcggtgacagagtgagactctgtctcaaaaagaaaaaaattcattctggttgccggactgagacaaaacaaagggggtggggagtaagcaataagaccagccaaaagtcttttgctgtaatccaagcaagaaataatcattcatttatacattcatctgttccctgagtgggtcccagagtctctgaatcatctcaaccattttgcatctagttctcaactattcgcaactagttctcaaacttggctgcacattagaatcacctgagaactgtgacgatgactgctcctagggttctacctccagagattctggtttcttgagtatagaccttggctggggtggggttggagtagatattgtgtggcccgacatcaggatttttaaagctccccaggtgattttcttgtgcaacccatttggagaaccactgatctatataatacaccctctttgagctgagctcagagcctggtggagttcccagtgttcaataatcttccaggtctctggcctcattttttgactgcagggagcatcttccctcttattgacagctttgcagtccccatctggggtgcaagagactacagggtgctcggaagtgtccatcctggaggcatcatcaaaactacctacttgttttgggggtttttccaacttttattttaggctcaagggtacatgtggaggtttgttacatgggtaaattggcatcatggggatttaatgtacagattatttcatcacccagtaatcaccataatacttgataggtagtttttccaccttcaccctccttccatcctccactctcaagtaggccccggtgtctgtttttcgtttttttgtgtccatgggtactcaatgtttaactcccactaataagggagaatatgtgatatttggttttctgttcactgtaatgtgtttaggataatgacctccagctccatccatgttgctgcaaaagacatgatctcatccttttttatggatgcataatattccatggttaatatgtaccacattttctttatcaagtccaccactgataggcatttagattgattccatgtctttactgttgtggatagtgctgtgatgaacatatgtgtgcatgtgtttttggggtagcatgatttatattcctttgggtatatacccagtaatggaattgctgggtcaaatggttgttctgttgtacattctttgagaaatctccagactgctttccacagtggctgaactaatttttctaatgaactaattacattcccaccagcagggtatagggatttccttttctctgcagcctcaccagcatctgttagtttttgactttttaataatagccattctgactggtatgagatagtatctcattgtggttttgatttgcatctctctaatgattagtgatattgagcagtttttcatactcttcttggccacatatatatcttcttttgagaagtagaaacatctattttttccagagtttctatagcttagcttagcactagggaagtgggtggggattgctgggtgtgctgtgggaagatgacccttccataaaagacagcagggtgggaaaaggccccatgttttcagaatattagtatatatacatatatatatatatatgtatatgtatacgtatatatatatacgtatatatgtgtgtatatatatacacatgtatatatatatttatatatttatttatatatatataaatatatatataaaaatatatatatatttagtcgacatccctgttctatcccaaaagcctaggcctgtttctctagcagcctggaaaatccaaatgtagcaagaaacacttgtctgcatctgaaactggccatcagaggacaggtccttgacacacaagcacagagtggtctttcctacagctcggacatgccctttgctccttccccctgtaagtcaccctccttctatgttttcctaaagaaagttatttttacccactttggaatgccagttcggaacagcctctggcatcttggaaggcactgtacaggtacttttcatctctaattgctcctgcttctccatttaaaagaaatattttcaaagcaatgggagcaagttactcattcaaatgctgttaacaaataacaggacttgagtgtgtaatctgaagttactcagctttgaaaagttgccctgaggagttaaaatttctgcttcactggaaattagaagggaggatgggggggatgtccttatgcgaggaattttcagcccctggaattttatgtctgatctccctcacatctgagctggaacgtgagatccagtgcaagattgcaggagagagcgggctggggacagttctggggcctgcaggtgttccgtttctgtgccaaccagcaagggccgctccccctgcaccaccaaacacccgccaggacttgctggagcccatgtcagtggagtcagcttataaattactcgggatcatcattccatgttggatcgaatcatagagggtggagtgtagaggtgctgcagcctgggcttcaggtggagggctttctggaggaactccacaagcaaaggctgacaacgcagccatgacaagccacagactcccagcgaactcagccccaagcctacactttctctcatgccacaagagcaactgagccaaaagctgggagcctgggccccttctcccatttctgttttaattactgctttttcttttaatatatgtttcccggcatgctgtaccatgagaagtagggacagcaatgccctccagggaggctgcacatagtaagtgttcaatataattaagtgtcagtaaatgtcaattcccttctgtggtttaagaaaatatgcaggccccagggtggtatggaagagatgtgactggtgagtcctaaagtgacgtcagtaataagggaaggaaaatgttaaggaggtcaagactcctcattagggaagaaaagggacttcacctgtgcctgccaatcaccaaggactctcaggtttggctcttctgtggacaggtccaagcttaaaagagtactcatggcataggaattctgaaaatatttattaaagagagaaaggatgattcaattagaggtgggagggaggggccatgattaaaggaagagatagaagaaaaggacttcaagtttccacttgaaggtggctcctcatcctgttggcaaagttctgaggaagaaaaggtatatatggaatgccacttactccactttggagcttcaaagagggtgtggggaggcagaaggaaaagaggctgaaggagaaagagcaggaagggaagagtcaagggtgaagtgctcaagttctcccattctgtgctaagaatagcaggctctcttcaggggaaattcagtccctcttcccaccatggacttgacctcatcaggctctccagcctgccccagaccacctaccgacagggactcatgatgatagtttgagagtgaatacattcaaggcccaaccccagtactttacatatctcccctccaaatctagaaaccaatgccttggctccctatgttcctacaacttggctttttctgcataaatcccctttcaaagctcttgtcttagagccagttgatactgatcgacacatattttaattaaatttgcatttacctattgattttcatacccagtctcattccaaaaaggattggaggcagcttctaacatttcaatgtgataatcactttgataaatctgccttaccacccctgttcacaaacacctgtatctacatccacgaaatatagatgatcttcatagtttaattgtaaaacaatacacaaaacacctttgaaacctggctccaagttttaaaataggtgcattgtactttgtatgctaagaagtttcagacaggattgggcgtcctggccacagaaatagagtcttgtgggagacccccagtttggattcagagtttgggatggccagaagtatgaccacattgattttctttccttgttaggtgtagagaaaaagaggtacacaggttgtgttgaagagcagagtttcgtccaaaccaggtgtttggagcattggaggagggaaattttcctcccttccaggagcccctccagcatcccagatcttgccaactcagaccctttcccagacaaacttgcctctcatccctcagggagtcagttgatcccagctggaactgtaatcctttgctaaaaggcctcttggctgaagcccagctcagcagggaagggttcagctttgtccttggggggcttctgcaggaggtcccattcttggggactctgacactgtgggaatctggcaggtgccccttcccaggttcacagaggttgctttggggggttgcaacaggacttgcttctctggtgtttatctcagtgaaattcaagaaagtccatgtgcagtttcatcctgggataaaggagggtcttctcttcctaccagcaactccaggcaagatactctcctcagcccaaagggctaaagagaaggcaaagggaacaaaggaaggccattttactcattgttgttgaacttaaaatgtgtaattatcttctgaaaacagctgaagggcttatgtaaagcatgacacaggagaaggtatttaaacatgaaacaaggcagcatcttttgctggagcagaatacctgctttccaaactccagatcgactttggaggaggagaatagcatgacagcctccatgtgtgagtcctgtcaacacttggcatccaccttcccattcacttttcacaacactgcatggtaaaccatttcacagataaagaaatggagtctcagagaactggagtaaattgcccaaagatgcacagctactcaataatagaacctgaatttgaacctgctgggtaattctagagccctcagccttagccactacacagcgctccttcccatactgtcactacccatagtcgttcagccatgcattccctagccactaaggcaaagcaaaagataatgggctcaatgaacctcacccctcagatgggctaagtcacacggcacttttgttttcattgtgaatgcccatcagtgaggcacatactgcctgttacagcagatctgcttcgtgcatttgtaagttttgcctgaccctggtgtgcatttgagtttgcgattccaggactacaacatttctaataggaaaaatgtcagctctgtcttattctgatattgacatgctttggggatgccttaggaggctaggaagccttctaagtagcttctgaatttaacacatttctatagaactgttacaagctggttgggaatgtggaagcatgctcaccaaagacggttttcattaggctcaaatcaatgatgagcttttcctgagaacttgaggctttaggagagagtagcatgggccgttggattattataacaacaacaacaaaaagattttaatacatttttctctcattgttttgcctgatgacagatgcaatcccagatcacaggcatttggtgcatgagagcttttctgtttacaggtgtccactgtgccttggagagggctggggcaccgccctagggattgttatttcagacaagaacttcaccctacaaagtaaaggcaagacaaaatgtcattgtcccttttatgcatcacagaggcacattggacttgtagaaggagcataccttttagacactaggtggactaggtaaaacctggatttgaatccagctttttctacttcacagttgtatgacctaggacaagttacatcaagtacatttttgagtccagtttcctcatcagggaaatgcagataaaaatacagactttgttaaggtaccgtaaggattagaggtgatatatggaagaccccatgcagggaagaccccctggaagactctttgtagttgatctagatattatcaggagcagcgtgggacatgcggcactgcacatgctggccactagcttgcacagcaggtcctcaaataatgtcatgtttttgtttttgtttttctgagacagggtcttgctctgtcacccaggctggagtgcagtgacacaatgctggctcaacctcctgggctcaagagatccttccacctcggcctcctgagtagctgggatcacagaaccttccactggccactcagcgaaaggcagctgattcagcacctggagaagaccggcaacagggctgagtttccttgcactgcagaggaggggagaggcaaggagtggacatgagcacggaggatccagggcactcccttgatggtgatgccctcgaagggctgccccgtgcccattgtacagaatgtggattccaccccacgccatgagagctctcgcgcaggcccagaccactttataagccatatttcccaccaattcctgtttctggatctgtcaggttatttcatatttctaggcccttagctttgcttcctcttccctgaacgccctttgcccacatcatcccagctctccttctcctcctgccttctgtcttctcttcctctcatttcttgtcacccaggctggagtccagtggcgtgatcacggctcactacagccttgaactcccgggctcaggtgatcctcccacctgagcctcccgagtagctgggactacagatgcacaccaccatgccagctaatttttaaaactgtttttagggatggggtcatcttcctgtgttgcccaggcttgtctcaaactcctgggctcaagtgatcctctcacctcagccttccaaagtgctgggattacaggcatgagccacaacatccagccccttttctcttttcttacccttctttcctattttcttttccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagccactagatgtcatattaatttcacagcagaatagggaagcccatgccggagctgaaaacctgcaacaacaaaaaagcatctaaatactgcaaaaaaaaaaaaaaaaaagagggagagaggcatcttaatatttgtccttaacacatcataccagacttctgcttccaggaatgactggatgtggtttttctaggtggacataatacaaaatgcagctacctgaaaacaatggaaagtggacagagcaggcagattctggtgggaagtccacgcaataaagaaaagatgttacaggaagtgagcgcccatttttgctgtttttagcttggaggcaggtgcagccattgtgcaaaccaggtgtggtgctggtggaaaaacagccatctttttggactatgaaaatggaaggttgagttcagggcaactataactgccaaaagagagaagaaagagttctggaagagaaagagccaaagagggaattcccaaattctttctgctcctgtctgtggctgatcccaaaccacggacacacacagcaaaaacaaaagcatctcagccagagacaaaagagtctaaaagagactggacctgccacctgagaaacagagtttgaagttagagttcaatcacaaaaaaatgcctgctaaaacaaaataaacaaaacctattagagaaaaggtgttctcttatcagaatgtagggcctccacaacttaacgtttataatgtgtacaatccaaacttattcgacatatgaagaactggaaaagtgggacccattctcaagggaaaagatagcggagattcactccaagatgacccagatgttggaattatccaccaaggattttaaagctactattataactgttctcatgctataaaatccactatttagatcatacttaattgtgaagaaatgaattctttcctcctaagattagaaacaaggacggcatgaatacccactttcactactaacactgaattttgtacgaaggtcccagtcagttcaatatttttaaaaagattttaaaaaaagcaataaaaggcatacatattggaaagggaaaagtaaactgtctaaatttgcagatgacaaggtcatataatggtttaaaaaaagctactagaacaatatgtgagtttaccaaggttaaaggatacaaggtcaatatgccaaagtcaagtgaatttctatatatttgcaatgaacaattcaaaatggagttttaaaacatttttatttatgatagtctccaaaatactttttaagaaagaaaatgacagaagcaacccaagtgtctactgatggataattaaattatagtatataaatacaatggggccgggtgcagtggttcatgcctgtaaacccagcactttgggaggctgaggtgggaggatcactcgagcccaggagttcaagaccagcctgggcaacatggtgaaaccccatctctagaaaaagtacaacaattagctgagcatggtggtgcacacctatggtcctagctactaggaggctgaggtgggagatcaccggagcacaggaggttgaggctgcagtgagctgtgattgtgccactgcactccagcctgggtgacagagcaagaccctgtctcaaacacatatatacatacatatgtggaatacaatggaatatttacttaaaaaagaaagaaaattccgacaacatggatggaccttgaagatattatgttgagtgaactagtcacaaaaggacaaatactgcataattgtacttttatgaggcacttagagtaatcaaactcagagacagaaagtagaatgctggttgccaggggctggtagaatggaaagttattgtttaatgtttataaagttttagttttgcaagataaaaagatttctgtggatggatggtggtgatggttgcacaatgtgaatgtacttaatgccacttaaaaatggtcaagatggtaaattttatgttatgtgtattgtaccacaattttctttacaaggtctcaagttggacattaaaatgccaggcaattaaaagtatttatgtttaaaacttaatttaaaaaataattgacaagtatattctaaaatttgttcgagaaggcaaaggacctagaatagcaagaatactcttaagaaaggaaaacaagtttggaaggacttaaactacctgaattcaagacttatcattaagatacagtaatcacaacagtgtgttactggcataaagatagaccatatgagatcaatggaacaaaataaaagctttaaaatgcaccaatacttatatggtcaattgattttcaacaatggtgccaaagtaatttaatggggaaaagatagtcttttcaaaaaatggtgttagaacaactggatatatatatatatccattatatatatacactcatttatatatacatcatatacatgtatgtatcatatatatgtatatagcctcaactcttatttcatatcatatacaaatatttgaattgattgtagacctaaatgaaggagctaaagctattaaacttttagaagacagcataaaagaatttccttccttctgccttgccttgccctgccctgccctgccttgccctgccttgccctgccctgccctgccctgccctgccctgccctgccttgccttgttttgtaacagagtctcactctgttgcccaggctggagtgcagtggcgtgatctcagctcactgcagactcaatcacctgggcttaagccatcctcttgcctcagcgtcctgagtagtttggactacaggcatgcgccaccacacttggctaattttagttttgtttttttgtttttgtttttttgtagagacaaggtttcattatgttacccaggctggtctcaaacttctggactcaagcaatcctccctcctcggcctgtaattatttcttaaacagggcacaaaaagcacaaatcacataagaaaaaaagataaaacagacttcatcaagatttaaagcttttcctcctcagataacgagttgagaaaacaaagacaagccacagattgggagaaaacattggcaaaacagctattaaaaaagccttctatccagattatataaagaacccttaaaactcagtaataaaaagacatacatagtaagtaatgggcaaatgatttgaacaatcactttataaaagaagataaatgaatagccaacaaacacataaaaagatgctgaacatcacaagtcattcaaggaagtgcaaattaaaataataataaaatactattaaatgtccactagagtggccaaatttaaaaaaaatgaaaatcaccaggtattgtggctcacacctgtaatcccagcactttgggaggctgagatgggccaatcacttgagcccaggagttcaagactggcctgggcaacatggcaaaaccctgtctttacacaaaatacaaaaattagcctggagcatatctatagttccagctactcag

SEQ ID NO: 165 - DNA, 32747 bp, Homo sapiens; identical to SEQ ID NO: 164

SEQ ID NO: 166 - DNA, 32745 bp, Homo sapiens
ggcccgcccctcgcagccttgccgcgccccgtgcgccctgtccgcccctcgctcgcattgcaggcatcctgagtctcggcccttttcgccaaatcgctgctctgccgcgcgcctacgcaaggaaagattcaagggtccctccacttcagggagtggagcccgcgcctcggcacggatcagctgtgcgtctcctttggcctactggctcctctgcttgtgtctatagctagctggacgcatcgtgactttatcttctcatctttcctggcgcccccagacgcatttcctggtccctcgaggcagcggcgtctggggagtgcactttgcacagacagggaaaccgaggcactcagcggtctccaatggagacgctgtaatcgcattccacgaccagctagcgctataagcgctgcctctaaagcggaaggcctcccagtccttctcgacaggaagcaatatttgcatatctaaggagaacaagattcggcaatgtgctccgggagcaagtgcaggcatggaacggtatgggctggagggggacagaccttcagaggcggctgcccgttccctgtagtgtcacataagatttttagaagataggagttttcacagtggcggcagagccctctgctaaatcctcatattagatgtcaaaggtggcatgtcatttgacccaatggcttttttagtcatttatcttcctaacacctatgagagggctacagttaccaaaatggcatggtactggtacataaacagacacacagaccaatggaacagaatagagaacccagaaataagactgcacacctacaactgtctgatctgtgacaaacctgatgaaaacaagcaatgggaaaaggttccctattcaacaaatggtgctgggataactggatactcatatacaaaagactgaaactggactttttccttaaccatatacaaaaattaactcaaagtggattaaggacttaaatgtaaaacccaaaactgtaaaagcctggaagacaacctaggcaataccattcaggacatagacacagacaaagatttcgtgacaaaaatgccaaaagcaattgcaacaaaagcaaaaattgacaaatggaacctaattaaactacagagcttctgcacagcaaaagaaattatcaacagagtaaacagataacctacagaatgggagaaattttttgcaaacagtgcatcgacaaagatctaatatctagcatctataaagaacttaaacaaagttgcaagaaaaaaaaatcaccccattaaaaactgggcaaaggacaggacatgaacagacacttttcaaaagaagacatacatttggccaacaattatatgaaaaaagctcaacgtcactgatcattagagaaactcaaatcaaaccacaatgagatactgtctcataccagtcagaatggctaatatgaaaacgtccaaaaatgacagatgctggtgaggttgtggagaaagggaacactttacacggttggtgagagtgtaaattagttcagccattgtggaagacagtgtggtgattcttcaaagacctaaagacagaaataccattccattcagcaatcccattactgggtaatatacccaaaggaatataaatcattctgtcataaagatgcatgtgtgtatgtttactgcagcactattcacaatagcaaagacatggaattaacctaacatcaatggtagactggatgaagaaaatgtggtacatatacattgtggagtactatgcagccataaaaaagaacaagatcatttactttgcaggggcttcaatggagctggaggccatatccttagcagctaatgcagcaacagaaaaccaaatattgcatgttctcacttataagtgagagtcaaatgatgagaacacatatagggaaacaacacacactgaggcctatttgagggtagagggtggaaggagggagaggatcaggaaaaataactaatgggtactgggcttaaatacctgggtgatgaaataatctgtacaacaaacccccatgacacgagtttacctatgtaacaaacctgcacatgtacccttgaacttaaaataaaaatttaaaaaaagaaaataggttgcttgactctgcacctttccttctctgcttctcacttcccaactgttctaatttcatatgggaatccatgcagttatggagaatccaccttcagcaatgggaatgaacctagcaccacatgacctgggctggatcaatcatcacatactatcccctgacccagtgattggttcagggatggacatgtgacctaagagagtgtggttagagtaaacctcaggacttctgctgataacattggcaaaaagattttttttttaaatgaatgagggcatgtagcctcacagaacagctggaagccattttgcaaccacagagatctgccaaagtctccctaagatgaagaaacactgagatagcagagccaggaaatggtgaagggaatgttggtccctggtcaagttgtttgagctagccctgaagtttttcaaatctctgtgggcttttcaattgcatgagctagtaatttccctttattacttaagccaatgtgaaccagcttttctgttacttagaaccaaaaacattctgctacatcattgatacacgtcaaacacccccttccttttacagaagaaaagactaaatctcatggatgctacgtggctagttaggaggaattgccttcccagttccaggcctttctccttttactactctagccacttgtgatgggtttggtaacaatgagtaaaatgtgcattctccttatttctaaccacggattggatatgttcagaaatattaaaactgattttcctcaagtgtatcttctggcaattaatgtcattgctttatagccactctgtactacgggcccttgtgattcattagaaaaaacaaaggatcaaatagttagagaaggtataaggaccttgtttaaaattttatttaatttgcagctaatttaccagcaacttaggctcaaccacgtatgctgctttgctagtttcttcaaaacttgtcatgcactttcatttcttggtaatcatccctcattaccatttcttatctttcaaaaacacagcctcaccacactgtattcttacctttggtgcctccctctacagctagaatttccagattctgtgggctcttcctctgtaaactctaaaaatccttccatttttatctatacatactatttcccccactctaacagatcttacctatcaccaaccctaaaattacctaacaaaatgctcatcacatcttcaaggaaatgtcccacagtgagagaaaagagaaaggaacctgtgtttattgtgctaggaagatactagatactttacagacattaactcatttaattttcatgaccacaccatggtaagtaggtagtagtatctcagtctaaaaataaggaaactgaggttgggtgagtcatagggttgaattccaaacctaggtgtgtgcagttctaaagatactttcttccactgcttctgttggacaatagattttgccccttttgtaccagctccaaaggatagtgaccgcctggatctcgtgttgagaagactgaagcctcatccaggttgacagggaaagacaaaaggatgtcttgccaaagcttgccaagggggaaagtggcaatccacacaccacttatttcacatttcttcaggcctgtgcctggggcagttctagaggtttcccaggagaaggacaggtgcaccagggagtctggctataaagtttgtacactagaatctgttggcagattctgttgcttaaagttgagtttgcattcatactttatatctgaagaaatgggaagttagggagttaaccactgtctattgggaagtgattcatgaatcagaacaggtgagaatgtcaggctctgaaatgaacagcacacttctgtatggaatgtactggggcagcatacctgccttctttctcagatcaatgttgacacacttaaatttgtgaataaggccttccaggatatcttgtttaggaagaaccagttcacttgctagtatctaggctttctaggtatcacgagggctttctgtcaaagcataaacaagcagtgagaaatcatcagtgttctctctctgaagagagagacaccaggaaaggagagagggtagcaagttagcaggcatggaaagctgctgctttgcagatgtgttcatcaggcataatccttagctggatgttagacagtaccagaagttgcatggtgacttgtctgatggttgcaaagatattggtcctcatgtgggattattcaagatattcagaagggaagaagctgaatctggttacaaaaggtgttccttaaatacgtaatgaatgaatgaataaacagttcaatggaaattggggcaaattaaggattcagtagatgtgaggtgtatttgtctcatgtcctcatctgatgaacatctaccatattcagttgtctagtgaggactcttttagtgtagaaaccaaggaggcacatttggggttcatttagagatggggtatttggggctggggggaagccagcatatgaatgatgggcttcaccaggagacaaagggcatctgtctaagggatggatgctgagggtggacctggcaggctgagcaggtgaaactcttccattggagcagactgtgggtttatttgagcttaagaaaaggaggtcattcccaagaatgaatagcagtggatttgtagactttgaaattaacagatcaaagacaccagatctctgtagagaacttaatatgatctctagattctgaagctccaattctcagccctggctgcaccctagaatcacctgggagcttttcaaccctaccactgccagggtttctcccccagagctttggattcaggcagttcagagtgaggccctggaatcagtattttcaaaaagacctccaagtggctctgagaatatcactgcagttgagactgtccactctagacataactcaaagcaggcaaattttcaggattccatggctagactatgacatttccaacaacctcaagagagacattttaggattattcattcatactgtgtgcatccttggtttctcactagcccctgttcttaaggcctggcagattcccaggtgacttctatccatgagagtgtcccaagaagggccactgggaaacacacttatagagagtttggattatgatcccaaaagacacattcctgaatgccatcatccccgaggttgaaatcctgaaagatcaaaatttctaaagactaaatccttaacatctaaaatcctgaaaatcacaatcataggatagttgcatcatgttaggtgaaactgttaccttgttgtggtctttatttggaaattaagtatggtttaaggagatgcatatagtgccaagttgacagggatggatttattgacttaatttgagatgtcaacttgactgattaaggaatgcctgaaaccctggtaaagcattattttgggtgtgtgtgagggtgtttccagaggactgagtagactcggtgaggaagatctgcccttgatattggtggacaccattcaattggccaacaatctggagataacaaatatagaaggccaactggtctctctctgagagctgggacagacttttcttctgctgccttggacatcagaactccaggctcaccagcctttgcactccagtacttaacagcagcggccatctgggtcctgaggcttttggcctcagagagtaacaccattgtctgctgtggttctcaatataaaaacattgaaacttcctcaataaatgaacagatttcctttttgtgtatctgcatttgtgaaagaccaaaatttcttgagatcttgcctttttgggccactgcatatgcagtggtgacctatagaggtttttgattgatcttgtcaaaagacaggttgtccatcacagtatttcggatgactggagttataaagctaggtacacacaactaccaaccatcatgatacatgtttatacactttgtttttggcatattgccttatgaatacagttcatctgcttgtaattgttgtaatcatgtgactgttgttagaatagctgagtgcttatgtttgcaaagatatatatgttattattgccaattttattgtgtaaattggcctctgaagtgctctgtcagtttttatatggttctcaaataaatctcccttaaaaatgtaaataaatgttttaaagataatttcttcttattttttccagaattatatttttgggattttgatctttcaggatttcaatatttgggatgggtctttcaggattatgatcaaccccctatgtggaaccatactggggaaactatgaacaagaataaaatctcagaagcctgggattttgacattggaggcaaaggaaaatcacatcagagagccctgctcagtgcaaagagcgctaggccgggtgctggaagtgctgactttcactcatgactgcagctgccccactgtgatcctggggaagtgaccactgtgatcactgtgggtctgagtactgtcatctgttcacttccatgtccttccacttctgtgactctgtgaggctaactctgtttctatttttttttttttttttgagacgaagtctcattctgtcgcctaggctggagtgcagcggtgcaatctcggctcactgcaaccgccgcttcccgggttcaagcgattctcctgcctcagcctcctgagtagctggaactacaggtacacaccaccacacccggctaatttttatatttttagtagagacagggtttcacgatgttggccaggctagtcttgaactcctgacctcaagtgatccacacccgcccccccccggtttggccccccacagtgctgggattacaggcgtgagccaccacaccccgtcgcctaactctatttctaaaagctctgccagttggagatttctctagcccactagagtttctggctttgggggacagggagggaagggaggggaagctgtgttataagaagaaagtttaaaaagtaagcataaattatttgagcttttaagagacattaacaagctaccatactgagggtattaagaacactaaaatttgtttggctttggatagggaagctactgaaattgaagaagaaaagatgggactgaatgagcactccttgggttggagaaaaaccaacatgatcattatctaatcatcatcataataatgataatggacatttgtatagcacttggcagtttacaagttactttcttataataataattaccactatatggtacattacagtaacaaatactttttagggctttaccccgttccactgtaaaagttggtattagtggaggatgtaaatagacttatctacatgattaaggaactaggaggagtggaggttcaacaccagcagttggacagcaaacatcttagaagaccaggcacatcttcagccacacccttgggttcaacttggtggtctcctggttggggtcaggagcagaagtggggccatggcctccacttcccttcctgggcaatgtgcctttctttcatcaccatggagtccttgcctttgttttgtttctccttgtcatttatttccattaacatgcagtggtttttgtcctttctcttcccgattgtcactttcctcacctagatagagaagaaccagccctcacctagctcactagtctgtatcaggctcaaatgaggtgatgtatgtaaaaaggttttgagacgttaaaaagcacagtccagaaatacctgaaagcatgtaaactcttacgatttgggggcttagcaggaccaggaatttgatctcattgcctccaggtcatatcatgaccctctaggatccctcctccctgtcacacatccctctatgggcacattgattccaggatttccagagtacatcagggctgagccgacctcatggccctcgtggattgtctctgatatggtttggctctgcgtccctacccaaatgttatcttgaattataatccccacatgttagggagggacctggtgggaggtgactcaatcgtggtgcggtttgccccatgctgttctcgtgatgatgagtgagttctcacgagatctgacggcttaaaagtgtggcacttcctacctcactctctctctctctcctgctgcattgtgaagaaactgcttgcttccctctcaccctctgcagtttcctgaggcctccccagccatgcggaacggccagatgcagtgcctcatgcctgtaatcccagcactttgggaggctgagggaggattgcttgagcctgcttccatatcgtaaactgccttggaaccaattaccactaccagggagacaaactattgcttagaggatgctgacaggagcagcatgccaaaattggaagaactgtagaccaagacctggaattaacacatcagaagattctatgaggaaacccatttaaaaataggatgcatttttttcttttctgcacagggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaagggctgccagccagagaggaggagaagcaatcactcctgcagtttctgaacactacacagacgccaggtagcttcttcaggagaacagccctctgaggaggcaggaagaggaggcttatctttcagcagccggagctgctgagatctctgggcagattaagctctctctaatggatgggctccagcctggcacattcagtggagagggatccactcatccatcatcaacataatatggtcctccctgcacttcacagtgtcctcttgctattgaaaaggcttttttgccttctcaagtttctttgtcaacagtctacaggaagaagctcaggccgccaccggcagaggtgaatgcaagctcacgttttatttctgactgcttaatcattgcctcgatcactgctcaagctctgcctttgtttccaaaggttacctgtgggaaaacttctttttctatgctgaaattaatagggaggcaaagatgagtccactgataagcagagccttaaaactcacatagagaaacaactttgctggagtgtgtgtgagtgaaccactaaggaatcagatagtgtgatggcagttatcattgcaggttaagacatttctacaaatatttcgacatctccatatactcactcctttcccccctgagtggagagactcagctaccaagagaggaagctcaaaaaaaacagaagcttcaaacaaacaaccaaccaaaaaaaaaaaaaaactgtgggttcatcagaggtggtagggaagacaaaaacatgggaggagcagctgggcacggtggctcaagcctgtaatcccagcactttgcgaggctgaggtgggtggatcacctgaggtcaggagttcgagaccagcctggccaacatggtgaaaccccatctctactaaaaatacaaaaaattagccgggcgttgtggtacgcacctgtaatcccagctactccggaggctgaggcagcagaatcgcttgaacccaggaggcagaggttgcaacgagccaagatcgcaccattgcactccagcctgggcaacaagagcgaaactccatctaaaaaaaacaaacaagcaaacaaacaaaaaacacgggaggagcaataaaaaggaatccatgctttgatttttttttttagtgagaggaagggaaggctgctgcctctcacttctccctgttttgttgttcttttaagtagcatgtgtcactctgtatatatcctgtccatgtgttttcttttattattatttgtccacttgcctagaatgaaaactccatgggagcatggctatagtgtcttgttcactcctgcctctccagggcctgaaacagaagtaggtagacagagcctgaaacaaaagtaggcagtccataaactttgctgaaggaatgagtgaatgaatgaagaccccaaggatggacctcaggaaggtgagcctgggcaaaggttttcagtcctagtccatcatgaccacatagctggaatacacttatttcactttgtcacatgaattagagattcatttggggaaacaagcaactgttagagttgcagacatctctgaggggtaaatggctgttcaaatcttgcatcttaccctgatcctcactctatctgctttccaaaaacatggagctaagatcccagcactgagaagatgggcattcctagcagggggcatttaggtgtagacagcctcagtgactcctgggtttaggatcagtgagataatctccagtatctacagtgggcaggtggaagagtgtctgatgcaaactgtatctatttacaagctttccagacagctgggcttgtgccttggaaatacaataatatttgtttctcctccttcctcttcactccttggcctcgtgttctgcagtactggaacctgggtcagatttagctacctcattcattcatttatgaattcatttagccagtgattatggagcacaaatttgtgccggaaactgtgcctcagtgtcctcaacaggttctgacttgtgaattccaaaagcttttgtgatctactgggtaaaacattgttttctaaggaaaatgacatgctgattgctgaacagcatattctaattaccttgtggatcccaggccattcttaaattgggttttgtctttattgccttagactgttaatgaattgtttcccagtctgattgaatgctccttgaagacggacccgggtccagccactgcagtaaatattgctaacttgggggtgtaattctgctgcttttgtggttgctgctttgcttatttttttatgtctgctgtttcctgtgagattgtttctgtgtttcatatgtggattgatgttcggtgaggtttatggaatttctgtgcagcttgggttaagagtatctcttcaaaaaggtttttgcatttgcttctgccaaccttgttatcagctcaagttgtttcttatgttgaattattggggatgacctcccccacactcaagtagtataaattagaacctcgctgggtgtggtggctcactcctgtaatcccaacaccttgggaggccaaggtgcgcagatctcttgagtccaggagctcaacaccagcctgggcaacatggcaaaaccctgtctctagaaaaaatgcaaaaattagccaggcatggtggcacatgcttgtagtcccagctattcgggagcctgaggtaggaggattgcttgagcccaggaggaggaggttgcagtgagcatttatcatgccactgcactccagcctgggcaatggagtgagaccctgtcccccaaaaaatttttttaaactcaaaccctatggtattatacctgctgtgggtataatcctttagttacgattggatgcttgctatgatttctcagaaggaaaacattttttcctacccagagctctttacagctaagcagaatttccccaaatgtgcctttaaaaggtattggcttatgcaggcttctcagtttgatgtcttgttcctgaatgagcaatgaaaccccaaacggacaaccttgccctcaaggacagccgaagtatcagatactccttgcaactccttatgtcagctcacactccatttgtggacatggagcatttccttccttttttcttttccttttgcaaatctagttatgcatttaaaaggatgcaatgtacccattatttccaggtgttttatggcactaatgtgtatggcagaaatgggtgttctctaattgttcataattcaaggtaattatagacatattgtttcaaaattaaatcaatagattttcaagccatgctatgtataaagctccatgcgggacacaaaaagggaaaaaacactatgtaccatgcacccttaagcaatttcacacatgctgtcttatctaattttcacgacagtcttatgagacagttattatccccattttatagatgaggaagctgaggctgcatgatgagtggcttgctcaaagtcacatatctaatcaataagacagctggcataaaacccatatctcactcgaaagtctgtgctttcccattgcacaggttcatgacatagtccaagggagaagacatagctgacaaaaggatcaatagcagtgtaagagtagacaaataaaacaataaggactgcattgcaatagatgttatgaagagggacggacatgattcattgctagtgaatataggccaaagggctataacttcagagtaggcagagatttgtgggccacagtgggaaagatggaggagaaagttagcttgggccttgaagatattgtctcagtgaatgaaggggagaagaccatgcctggcagtggagagagcacaagcagaaggtgggaaagcgtgtgcaggttatgggctccatgagtaggtaggtcatggctatatacaagtatgctgggagataagatggggaaagtttgagtccaagtatggagggctttgattggtaatgaatttggattttatttggtaggcaataaagaaccccagaagacttttgcctaaagaatgatgtagctgaggcagtactttaaaaagatgtgtatggaaaaccatgtacaaattaattgtcaggggagagaatgaaggaaaggagagagcttggattaaggggaagcagtgaaaatcaaatggaacagatggatacctagatatttctcatactgagggtgccaaggccaattgttcttaattaagcaccaatctggttgattccatgggaatttgagatgtcatcaaggtatattgctattgtcatcttccacagactgagcaccagtcaggccactgggtctgagtccctggggctggagcgggtccagtgggcaatttattaaaagttgccaggagaagaagggtgaatgcaggccacatcctgggaaacacacactgaacgtcaatgctggagaattctgagttgtacctctaagttcatggatgagcatgatataaggaagggaaggcaaaaataaaagtagaaagacaggtactgaagtattgtaaatgaacgggtccagtatttgtgaatggaacccacaacttgttttaattagctttaaggtgtctagtacattgtgggtcagcttagtttaaagatataggactaaggcgagcagctttaacatctgagctgaaagggatataaagatgacataccctcttctaaacttccacgactctaccacagcacttatcataatgcatcatgattatcaagttttatatctgtcttctcactagactgtgtactctctgtgggcagggactgtgtcctgtttatctacattcctggcatctggcacaaagcccagcacagggtagatgcccagctaagagttaatgatggcttggaccagggtgatagcagtgggagtggtgagaattgatcagtctttaaatacattttgaagataaagccaaacgggtttcctaatggattggctatggagtatgtaagcaagagagcagtgaagaatgacgcaaggatttgggtttgaggaactagaaggtaaagttgcaatcatctgagatggagaaggctgcaagcagaacaggtttcagagaaaagatggcgggttcacatttgaacatgctgatgctgggtgtctattatgttcaagtggagatggcaagtggcagtggtttcttacatttgaaatctgagagagaggtttgggccaaagatacaagtttgggagtcatctgcataaagatggtattaaagagttctaaacggggtgttatcaccaggggagtaagtgtagacaaagaagagcgccaaggtctgagtcctggaatattacaacactcagaatctgtgagaagaggaaacaccagcaaataaaactgataaagagcagccaaggagataggaaagaaactaagagaaaggggaagtcctagaagccaagtgaagagaaaatatagcaaggagaagggggatcaactgtgtcaaatgccactgatactcaagtaagatgaggagtgggagctgcccattagatttagcatgtgaagatcattgatgtccatgataagacttgggtgcctggttggggcaaaagcctgagtggggtgagtttaagagaaaataggaggacaggcattggagacaagcagtacagacaactcattataggagtgctacaatgagaagcatctaaatggggtggaagctgatgggcaaagtgggattgagagaagccacttgttcatttagatggaagaaacatcagcgtgtttgtattctgatccagtacaatgaaaaggctaagagcttagacctgctaagctcacatactcaggcttccatcttctagtgatgactcctattgtgagttcattgaggatgagagctaaatgtctacccttacctcttgacataagatatatagaagatgcttagcaaatatttatcaaataaatgactatgcataaaatactttgcaaactctctgagccgcagtttcatctgttaaatgaaagtaatatcacctacctcagagaattaaataagataaagtacatatagtatataacaaagagcttagtacttagtatatgctcagtaaatagttagttttattgttagttcaatgctttcattttacagataaggtatctgaggcccagaaaatagtttgttcaagattgcacagttaatgacagagctaccagtttcctagactcatattccttagctttttccacataaccagagaatttacctacaattcccaggtaccacagatgtgggtgctttcaagcctctgtaaattcactaagttgatgagaaacctggatattagtaattaatggcagatctgaaatctctctagaaccttcctatgtggccaacatatgtcttcctgtctaatttgtcaagatactctgcaaagtcaatcctagtacaaggctccatattcatcttgaagctttttcttgttttaccagaattctggttttaattttttgagtagcaatccatgttactctttacatacccaagtcaagggacaaagctaagccacatgcttgttttgttcattatccaatattatgtaagtctagatgactgactccattagtttaactccaggtgacaatgtagatatagatccaaaatatgtttctggacaatattaatagaaatttttatgaccttggaacacaccctccctcattgtacttgcaatagatgaataacctgctcttgctaggatgagtgaagaatgtttacctttgtcaacatttattagtggagtactatatgcagctattcctttaataaaacagtaaatcttcagcaaagtttataggttgtctttcatccaaagacctcaaagaaactttgctaacactgtgtcattattcatcatacaacttgccaagggaggcaagtggtgattgtttcaaagagagaaactgaggttccaggaaggtttctgtgacttctaagggtcatgaacagggtaaaaaagaaaaaagaaaaaaaggaaagaaagagagagagagagagagagatctgggcactgagcccaaattcctgttgctcaggccaaagacccagcgctcctcctagagctctctaaacatttctttctgatagaaaatgtaatttactaccttgatctgttaagcagaaatgaactctcaacctgtcttcaatgacagggaaagccaacctttatttctgaagttacttcaagtcataaaatgcttgattcactgtattaaataatacagtattaaaataagtaaatagctttgtagtcataatgatagcttggatttaaatggtgcctgtgctctgaaaagcagggtagttcacaggcttctgcagacctttggtctcatttggctaccctcctctacccttcttcttcttttttttttttttttagacgaagtctcgctcttgacccccaggctggagtgtgatggcgtgatcttagttcactgcaacctccgcctccccagttcaagtgattctcctgcctcagcctcccgagtagctgggattacaggcgcctgccaccacacctggtgaattttcgtatttacagtagagacagggtttcaccatgttggccaggctggtctcgaactcctgacctcagatgatctgcccgcctaggcctcccaatggctacctttcttgacttcaagtatccctttccttcccacaggtcttttcttcaccaacctgctttcttcactcacacccttattctttcattcaattattttttcttctgcactagcagctctcaagtgaaaagaaactccctgctttagctgtatatgaagaaagacctccaggccctctggaagagctgtggaaggccatcctatgtagatcctccaagaggctcttacaggaatgagttaagatcccatcttgtttggaggttaatgatcaatgtttcagagactgactagaactaatcaaacattcaagttctcttctaaatttcccagtccctcttctatttagatctgggccttataactagttctggccaataaaaagaaaggcagttgagaattatattcttcctccatcgccctcttaacttgctacagtgaccttggaggtcacatcttccaagacactacagctacaagatggaggatggttgcccacctgacttctgactttgcatgagcagtaaacaaactgtcatccggttacctggagatcaaaacccctgagattttgattgtagcagctgctgtcaattatcctgactaacagcaggagtgaaatattgcaatagtttaaaaaaatctaagagatgtggcattagcttaccagttaggctggatagatggaaatccatgatatgcagtggcaaaaaatttaatgaagtacggctggcgataacttggaaagcagaccatgagccaactgagtttatacatttaacacagaggccagccaacttttccataaaaagccagataatgaatattttcagctttattggacagactcctttgcaactactcaactaccattgtagcatgaaaacagccatagacaatatgtaaacaaatgaacatggttgtgttcaaacaaaactttatttacaaaaacaggtagcactctggatttggtctgttggctatttgctgacccctagtctaggggaagagtttagataatatgttgccattggctgcatttgacaaggaattaaagttaagagatgagtttagaaagtgttggccggcttgcaggcagaaattaaagagagaaatcaggaatttggattcccaacttttcacaagctgtaagtggtctaaaaatgctgtacagactccagtatccacttagatagggagaaagaggataaatacacaaaaataaacctcctgataagcagagtaggcatggaggagcatgaatgtaaggcgagcaggttaatatttgaacaaagacccgaaaaaagtaagggacaagccaggtgactatatagggaaagagcagaattatagcaagtgcaaaagccctggggcagcagtgcacctaatacctgcagggaactgcaaggatgccagtattgctggaaccgtgggcacaaagggtgggaaggggggtggtagtaaaagataatatcagagggagggcaggtgggcatggggcagtcttcaaaggtaaatcatacagggccttgtaggtcattatgaagatgccagctcttattctgaattagtgggaaagccatagagggtattgaggtgaacagggacacactccaacttatattcttgaaaagataattctataatatggcaaaaccccatctctacaaaaaaaaaaaaaaagaaatacaaaaattagccaggcatgatggctcacgcctgtagccccagctacttgggaggctgaggtgggaggatcatttgagccccaggaggtcgaggctgtggtgagccatgatcacactgcattatagcctcggtgacagagtgagactctgtctcaaaaagaaaaaaattcattctggttgccggactgagacaaaacaaagggggtggggagtaagcaataagaccagccaaaagtcttttgctgtaatccaagcaagaaataatcattcatttatacattcatctgttccctgagtgggtcccagagtctctgaatcatctcaaccattttgcatctagttctcaactattcgcaactagttctcaaacttggctgcacattagaatcacctgagaactgtgacgatgactgctcctagggttctacctccagagattctggtttcttgagtatagaccttggctggggtggggttggagtagatattgtgtggcccgacatcaggatttttaaagctccccaggtgattttcttgtgcaacccatttggagaaccactgatctatataatacaccctctttgagctgagctcagagcctggtggagttcccagtgttcaataatcttccaggtctctggcctcattttttgactgcagggagcatcttccctcttattgacagctttgcagtccccatctggggtgcaagagactacagggtgctcggaagtgtccatcctggaggcatcatcaaaactacctacttgttttgggggtttttccaacttttattttaggctcaagggtacatgtggaggtttgttacatgggtaaattggcatcatggggatttaatgtacagattatttcatcacccagtaatcaccataatacttgataggtagtttttccaccttcaccctccttccatcctccactctcaagtaggccccggtgtctgtttttcgtttttttgtgtccatgggtactcaatgtttaactcccactaataagggagaatatgtgatatttggttttctgttcactgtaatgtgtttaggataatgacctccagctccatccatgttgctgcaaaagacatgatctcatccttttttatggatgcataatattccatggttaatatgtaccacattttctttatcaagtccaccactgataggcatttagattgattccatgtctttactgttgtggatagtgctgtgatgaacatatgtgtgcatgtgtttttggggtagcatgatttatattcctttgggtatatacccagtaatggaattgctgggtcaaatggttgttctgttgtacattctttgagaaatctccagactgctttccacagtggctgaactaatttttctaatgaactaattacattcccaccagcagggtatagggatttccttttctctgcagcctcaccagcatctgttagtttttgactttttaataatagccattctgactggtatgagatagtatctcattgtggttttgatttgcatctctctaatgattagtgatattgagcagtttttcatactcttcttggccacatatatatcttcttttgagaagtagaaacatctattttttccagagtttctatagcttagcttagcactagggaagtgggtggggattgctgggtgtgctgtgggaagatgacccttccataaaagacagcagggtgggaaaaggccccatgttttcagaatattagtatatatacatatatatatatatatgtatatgtatacgtatatatatatacgtatatatgtgtgtatatatatacacatgtatatatatatttatatatttatttatatatatataaatatatatataaaaatatatatatatttagtcgacatccctgttctatcccaaaagcctaggcctgtttctctagcagcctggaaaatccaaatgtagcaagaaacacttgtctgcatctgaaactggccatcagaggacaggtccttgacacacaagcacagagtggtctttcctacagctcggacatgccctttgctccttccccctgtaagtcaccctccttctatgttttcctaaagaaagttatttttacccactttggaatgccagttcggaacagcctctggcatcttggaaggcactgtacaggtacttttcatctctaattgctcctgcttctccatttaaaagaaatattttcaaagcaatgggagcaagttactcattcaaatgctgttaacaaataacaggacttgagtgtgtaatctgaagttactcagctttgaaaagttgccctgaggagttaaaatttctgcttcactggaaattagaagggaggatgggggggatgtccttatgcgaggaattttcagcccctggaattttatgtctgatctccctcacatctgagctggaacgtgagatccagtgcaagattgcaggagagagcgggctggggacagttctggggcctgcaggtgttccgtttctgtgccaaccagcaagggccgctccccctgcaccaccaaacacccgccaggacttgctggagcccatgtcagtggagtcagcttataaattactcgggatcatcattccatgttggatcgaatcatagagggtggagtgtagaggtgctgcagcctgggcttcaggtggagggctttctggaggaactccacaagcaaaggctgacaacgcagccatgacaagccacagactcccagcgaactcagccccaagcctacactttctctcatgccacaagagcaactgagccaaaagctgggagcctgggccccttctcccatttctgttttaattactgctttttcttttaatatatgtttcccggcatgctgtaccatgagaagtagggacagcaatgccctccagggaggctgcacatagtaagtgttcaatataattaagtgtcagtaaatgtcaattcccttctgtggtttaagaaaatatgcaggccccagggtggtatggaagagatgtgactggtgagtcctaaagtgacgtcagtaataagggaaggaaaatgttaaggaggtcaagactcctcattagggaagaaaagggacttcacctgtgcctgccaatcaccaaggactctcaggtttggctcttctgtggacaggtccaagcttaaaagagtactcatggcataggaattctgaaaatatttattaaagagagaaaggatgattcaattagaggtgggagggaggggccatgattaaaggaagagatagaagaaaaggacttcaagtttccacttgaaggtggctcctcatcctgttggcaaagttctgaggaagaaaaggtatatatggaatgccacttactccactttggagcttcaaagagggtgtggggaggcagaaggaaaagaggctgaaggagaaagagcaggaagggaagagtcaagggtgaagtgctcaagttctcccattctgtgctaagaatagcaggctctcttcaggggaaattcagtccctcttcccaccatggacttgacctcatcaggctctccagcctgccccagaccacctaccgacagggactcatgatgatagtttgagagtgaatacattcaaggcccaaccccagtactttacatatctcccctccaaatctagaaaccaatgccttggctccctatgttcctacaacttggctttttctgcataaatcccctttcaaagctcttgtcttagagccagttgatactgatcgacacatattttaattaaatttgcatttacctattgattttcatacccagtctcattccaaaaaggattggaggcagcttctaacatttcaatgtgataatcactttgataaatctgccttaccacccctgttcacaaacacctgtatctacatccacgaaatatagatgatcttcatagtttaattgtaaaacaatacacaaaacacctttgaaacctggctccaagttttaaaataggtgcattgtactttgtatgctaagaagtttcagacaggattgggcgtcctggccacagaaatagagtcttgtgggagacccccagtttggattcagagtttgggatggccagaagtatgaccacattgattttctttccttgttaggtgtagagaaaaagaggtacacaggttgtgttgaagagcagagtttcgtccaaaccaggtgtttggagcattggaggagggaaattttcctcccttccaggagcccctccagcatcccagatcttgccaactcagaccctttcccagacaaacttgcctctcatccctcagggagtcagttgatcccagctggaactgtaatcctttgctaaaaggcctcttggctgaagcccagctcagcagggaagggttcagctttgtccttggggggcttctgcaggaggtcccattcttggggactctgacactgtgggaatctggcaggtgccccttcccaggttcacagaggttgctttggggggttgcaacaggacttgcttctctggtgtttatctcagtgaaattcaagaaagtccatgtgcagtttcatcctgggataaaggagggtcttctcttcctaccagcaactccaggcaagatactctcctcagcccaaagggctaaagagaaggcaaagggaacaaaggaaggccattttactcattgttgttgaacttaaaatgtgtaattatcttctgaaaacagctgaagggcttatgtaaagcatgacacaggagaaggtatttaaacatgaaacaaggcagcatcttttgctggagcagaatacctgctttccaaactccagatcgactttggaggaggagaatagcatgacagcctccatgtgtgagtcctgtcaacacttggcatccaccttcccattcacttttcacaacactgcatggtaaaccatttcacagataaagaaatggagtctcagagaactggagtaaattgcccaaagatgcacagctactcaataatagaacctgaatttgaacctgctgggtaattctagagccctcagccttagccactacacagcgctccttcccatactgtcactacccatagtcgttcagccatgcattccctagccactaaggcaaagcaaaagataatgggctcaatgaacctcacccctcagatgggctaagtcacacggcacttttgttttcattgtgaatgcccatcagtgaggcacatactgcctgttacagcagatctgcttcgtgcatttgtaagttttgcctgaccctggtgtgcatttgagtttgcgattccaggactacaacatttctaataggaaaaatgtcagctctgtcttattctgatattgacatgctttggggatgccttaggaggctaggaagccttctaagtagcttctgaatttaacacatttctatagaactgttacaagctggttgggaatgtggaagcatgctcaccaaagacggttttcattaggctcaaatcaatgatgagcttttcctgagaacttgaggctttaggagagagtagcatgggccgttggattattataacaacaacaacaaaaagattttaatacatttttctctcattgttttgcctgatgacagatgcaatcccagatcacaggcatttggtgcatgagagcttttctgtttacaggtgtccactgtgccttggagagggctggggcaccgccctagggattgttatttcagacaagaacttcaccctacaaagtaaaggcaagacaaaatgtcattgtcccttttatgcatcacagaggcacattggacttgtagaaggagcataccttttagacactaggtggactaggtaaaacctggatttgaatccagctttttctacttcacagttgtatgacctaggacaagttacatcaagtacatttttgagtccagtttcctcatcagggaaatgcagataaaaatacagactttgttaaggtaccgtaaggattagaggtgatatatggaagaccccatgcagggaagaccccctggaagactctttgtagttgatctagatattatcaggagcagcgtgggacatgcggcactgcacatgctggccactagcttgcacagcaggtcctcaaataatgtcatgtttttgtttttgtttttctgagacagggtcttgctctgtcacccaggctggagtgcagtgacacaatgctggctcaacctcctgggctcaagagatccttccacctcggcctcctgagtagctgggatcacagaaccttccactggccactcagcgaaaggcagctgattcagcacctggagaagaccggcaacagggctgagtttccttgcactgcagaggaggggagaggcaaggagtggacatgagcacggaggatccagggcactcccttgatggtgatgccctcgaagggctgccccgtgcccattgtacagaatgtggattccaccccacgccatgagagctctcgcgcaggcccagaccactttataagccatatttcccaccaattcctgtttctggatctgtcaggttatttcatatttctaggcccttagctttgcttcctcttccctgaacgccctttgcccacatcatcccagctctccttctcctcctgccttctgtcttctcttcctctcatttcttgtcacccaggctggagtccagtggcgtgatcacggctcactacagccttgaactcccgggctcaggtgatcctcccacctgagcctcccgagtagctgggactacagatgcacaccaccatgccagctaatttttaaaactgtttttagggatggggtcatcttcctgtgttgcccaggcttgtctcaaactcctgggctcaagtgatcctctcacctcagccttccaaagtgctgggattacaggcatgagccacaacatccagccccttttctcttttcttacccttctttcctattttcttttccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagccactagatgtcatattaatttcacagcagaatagggaagcccatgccggagctgaaaacctgcaacaacaaaaaagcatctaaatactgcaaaaaaaaaaaaaaaaaagagggagagaggcatcttaatatttgtccttaacacatcataccagacttctgcttccaggaatgactggatgtggtttttctaggtggacataatacaaaatgcagctacctgaaaacaatggaaagtggacagagcaggcagattctggtgggaagtccacgcaataaagaaaagatgttacaggaagtgagcgcccatttttgctgtttttagcttggaggcaggtgcagccattgtgcaaaccaggtgtggtgctggtggaaaaacagccatctttttggactatgaaaatggaaggttgagttcagggcaactataactgccaaaagagagaagaaagagttctggaagagaaagagccaaagagggaattcccaaattctttctgctcctgtctgtggctgatcccaaaccacggacacacacagcaaaaacaaaagcatctcagccagagacaaaagagtctaaaagagactggacctgccacctgagaaacagagtttgaagttagagttcaatcacaaaaaaatgcctgctaaaacaaaataaacaaaacctattagagaaaaggtgttctcttatcagaatgtagggcctccacaacttaacgtttataatgtgtacaatccaaacttattcgacatatgaagaactggaaaagtgggacccattctcaagggaaaagatagcggagattcactccaagatgacccagatgttggaattatccaccaaggattttaaagctactattataactgttctcatgctataaaatccactatttagatcatacttaattgtgaagaaatgaattctttcctcctaagattagaaacaaggacggcatgaatacccactttcactactaacactgaattttgtacgaaggtcccagtcagttcaatatttttaaaaagattttaaaaaaagcaataaaaggcatacatattggaaagggaaaagtaaactgtctaaatttgcagatgacaaggtcatataatggtttaaaaaaagctactagaacaatatgtgagtttaccaaggttaaaggatacaaggtcaatatgccaaagtcaagtgaatttctatatatttgcaatgaacaattcaaaatggagttttaaaacatttttatttatgatagtctccaaaatactttttaagaaagaaaatgacagaagcaacccaagtgtctactgatggataattaaattatagtatataaatacaatggggccgggtgcagtggttcatgcctgtaaacccagcactttgggaggctgaggtgggaggatcactcgagcccaggagttcaagaccagcctgggcaacatggtgaaaccccatctctagaaaaagtacaacaattagctgagcatggtggtgcacacctatggtcctagctactaggaggctgaggtgggagatcaccggagcacaggaggttgaggctgcagtgagctgtgattgtgccactgcactccagcctgggtgacagagcaagaccctgtctcaaacacatatatacatacatatgtggaatacaatggaatatttacttaaaaaagaaagaaaattccgacaacatggatggaccttgaagatattatgttgagtgaactagtcacaaaaggacaaatactgcataattgtacttttatgaggcacttagagtaatcaaactcagagacagaaagtagaatgctggttgccaggggctggtagaatggaaagttattgtttaatgtttataaagttttagttttgcaagataaaaagatttctgtggatggatggtggtgatggttgcacaatgtgaatgtacttaatgccacttaaaaatggtcaagatggtaaattttatgttatgtgtattgtaccacaattttctttacaaggtctcaagttggacattaaaatgccaggcaattaaaagtatttatgtttaaaacttaatttaaaaaataattgacaagtatattctaaaatttgttcgagaaggcaaaggacctagaatagcaagaatactcttaagaaaggaaaacaagtttggaaggacttaaactacctgaattcaagacttatcattaagatacagtaatcacaacagtgtgttactggcataaagatagaccatatgagatcaatggaacaaaataaaagctttaaaatgcaccaatacttatatggtcaattgattttcaacaatggtgccaaagtaatttaatggggaaaagatagtcttttcaaaaaatggtgttagaacaactggatatatatatatatccattatatatatacactcatttatatatacatcatatacatgtatgtatcatatatatgtatatagcctcaactcttatttcatatcatatacaaatatttgaattgattgtagacctaaatgaaggagctaaagctattaaacttttagaagacagcataaaagaatttccttccttctgccttgccttgccctgccctgccctgccttgccctgccttgccctgccctgccctgccctgccctgccctgccctgccttgccttgttttgtaacagagtctcactctgttgcccaggctggagtgcagtggcgtgatctcagctcactgcagactcaatcacctgggcttaagccatcctcttgcctcagcgtcctgagtagtttggactacaggcatgcgccaccacacttggctaattttagttttgtttttttgtttttgtttttttgtagagacaaggtttcattatgttacccaggctggtctcaaacttctggactcaagcaatcctccctcctcggcctgtaattatttcttaaacagggcacaaaaagcacaaatcacataagaaaaaaagataaaacagacttcatcaagatttaaagcttttcctcctcagataacgagttgagaaaacaaagacaagccacagattgggagaaaacattggcaaaacagctattaaaaaagccttctatccagattatataaagaacccttaaaactcagtaataaaaagacatacatagtaagtaatgggcaaatgatttgaacaatcactttataaaagaagataaatgaatagccaacaaacacataaaaagatgctgaacatcacaagtcattcaaggaagtgcaaattaaaataataataaaatactattaaatgtccactagagtggccaaatttaaaaaaaatgaaaatcaccaggtattgtggctcacacctgtaatcccagcactttgggaggctgagatgggccaatcacttgagcccaggagttcaagactggcctgggcaacatggcaaaaccctgtctttacacaaaatacaaaaattagcctggagcatatctatagttccagctactcagggggctgaggtgggaggatcgcttgaaccctgggaggccagtctgcagtgagtttagatcatgccactgtactccagcctgggtgacagagcaagacactgtctcaaaaaaaaacaaaaaacaaaaaaaaaccccaaaaaataaaaatgtgaggaactctcacacatttacacattgctgaaggcaatgcaaagtggtacagtcaggccggaaaacagagtgacaaggtcctataaaggagtggtcccaacctttttggcaccagggaccagtttcatggaagacaatttttccatggacagtgggggaagggaatggttttaggatgattcaagctcattaaatttattgtgtactttatttctattattattacattgtaatatataatgaaataattatacatctcaccataatgtagaatcagtgggagcactgagcttgttctcctgcaactagatgatcccatctgggggtgatgtgaaacaatgacagatgatcaggcattagattctcataaggaacacacaacctggatccctcgcatgtgtagttcacaatagggttcatgctcctatgagaatctaatgcctttgctgatctgacagaaggcagagctcaggcagtaatgcgactgatggcaggtggctgtaaagagagatgaagcttcattccctttcctgccgcacacctgctgtgcagccccattcccaacaggccaccgacaggtactggtccaataaagtggaagatatccttaccagtaacccaacaatcccttctcctagagaaatggaaacacatgttctcacaaagacaagtatgcaaatgcacatagcagcattattcattgtagccaaaatttgaaaacaacccaaatgtccatcagctggtgaatagatccattgtggtacatctatactgtgggatactactcagcagtaaaagggaatgaactattgatacacaaaacattatagatgaatttcaaacacattatgctaagtgaaaggaatcaaatacaaaagactacattctgtatgactaaatttatatgaaattttagaaaaggcaatattacagggaagggaagcagatcagcatatacctgaggctactaagccaggtgaagggcaggttgcaaaggggtatgagaggcttttagcaagtgatggatgtgttctgtatctttattgtggtgacatttacatgactgtatacaattacccaaagtcattaaattatacaattaaaatatatgaattgtactgtattgtaaattatacttcaatacagctgaagaaaaagtcaacaacaaccacaaaatcacagccaaagggctcttctctatggctgaaagatattgggtccacatattccagagtcccttgtactcatatcatggtctactatataaataaatcataatttatttttaaagttaatcattgctgaacatttgtaatgtttataatttctttcttttttgagtggaccaatggaggggtgtaacgttcttctatgagtccctggagcacttttgcaagtaattctacatataaaatgtgttgggttatagattataaatgtactcatgtttcttttttcatatgattttattcttttttagaatttcatttgaatagaatcctaccttatgtagtctttcttattaatacataatagtatatatttgggggttatatctggtatactgatactttcatgtaatggtaaaatcagggtaattgggatatccatcaccttgaacatttttctttatgctgggaacatttgaattattctcttttagttacatatttatcttttatgctgggaacatctgaattattatcttctagttattgtcaaatatgcaacagatatattattaactatagtcaccctactgatcgattgaacaggtcttatttcttctacctaactgtattttggtacccattaatcaacctctctttatatccccctcccctccacacttcctggcctctaggaaccaccaatctactctccatcttcatgagatccactttattagctcccacatatgagtgataacatgtggtatttgtctttctgtgccaaacttgtttcacttaacacaatgaccatgttgctgcaaatgacaggatttcattcttttttatggctgaataatattccattgtgtatatataacacgttttctttgtccaatcatccattgatggatacttaggttggttccatactttggctattgtgagtagttctgcaataaacatgggattgcagttatcttttcaatatattgatttactttcttttggatatatacccagtagtaggattgctggatcaaatggtagtcctatttttagttttttgaggaacgtccacactgctttccatagtggctgtactaacttacgtccccatcaacagtgtacaagtgttccctttttccccacacccttgccaacatccaatattccctattttttaaataatagccatcttaactagggtgaaatctcactgtggttttgatttccatttctcggatgattggtgatgttgagcattttttcatatacctgtaaaccatttgtatgtcttcagaaatgtctattcagatcttttgtccatttttattgggttatttttttttgctattgaattgtttgaattccttatgtattctagctattgatcccttgtcagatggatagtttgcaaatattttcacttattctgtgggttgtatctttattgattgtttcctttgctgtgcagaagctttttagtttgacataattgtatttgtctaatttttgcttttggtgcctgtgcttttgaggtcttactcaaaaaatctttgcacaggccaatgtcctacagcacttctccagtgttttcttctagcagtttcacagtttcaggacttacactaagtatgtatgtatgtatgtatgtatgtttttatgtatgtatgtatgtatttatttatttatttattttgagatggagtctcactctgtcgcccaggctggagtacagtggcacaatctcgtctcactgcaacctctgtctcctgggttcaagcgattctcctgcctcagcctactgagtaactggtgcacaaccccacagccactaactgtttgtattttaggagagatggggtttcaccatgttggccaggccgggctcgaactcctgacctcaagtaatccacccgcctcagcctcccaaagtgctgggattataggtgtgagccactgcgcctggccacatttaagtctaatccatttttggtttttttcatatggtgagagataggggtctagttttattcttctgcatatggttatccagttttcccagcactatttattgaagagattgtcctttccccattgtatattcttgtcaccttgtcaaaaatgtgttggctgtaaatgcgtgaattgattctaggttctccattcagttccattggtctatgtgtctgtttgtatatgagtatcatgctatgttggttactgtggctttgtagtatattgtgaagccagagtgatgtgatgcctccagttttgttttgctctggattgctttggttatttgggtcttttgtggttccatatacattttaacattgttcttttctatttctgtgaagaacgtaattagaaaattcattgtgaaagggattgcattgaatctgtaagtagctttgggtagtattgacattttaacaatattatttctttcaatccatgagcatggaatattttttcaatttttgtgtgttctcttcaatttctttcatcagtgttttattattttccttatggagatccttcacttctttggtttaatttatttatagatcttgtatatttttggta

SEQ ID NO: 167 - DNA, 2101 bp, Homo sapiens
ggcccgcccctcgcagccttgccgcgccccgtgcgccctgtccgcccctcgctcgcattgcaggcatcctgagtctcggcccttttcgccaaatcgctgctctgccgcgcgcctacgcaaggaaagattcaagggtccctccacttcagggagtggagcccgcgcctcggcacggatcagctgtgcgtctcctttggcctactggctcctctgcttgtgtctatagctagctggacgcatcgtgactttatcttctcatctttcctggcgcccccagacgcatttcctggtccctcgaggcagcggcgtctggggagtgcactttgcacagacagggaaaccgaggcactcagcggtctccaatggagacgctgtaatcgcattccacgaccagctagcgctataagcgctgcctctaaagcggaaggcctcccagtccttctcgacaggaagcaatatttgcatatctaaggagaacaagattcggcaatgtgctccgggagcaagtgcaggcatggaacggtatgggctggagggggacagaccttcagaggcggctgcccgttccctgtagtgtcacataagatttttagaagataggagttttcacagtggcggcagagccctctgctaaatcctcatattagatgtcaaaggtggcatgtcatttgacccaatggcttttttagtcatttatcttcctaacacctatgagagggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaagggctgccagccagagaggaggagaagcaatcactcctgcagtttctgaacactacacagacgccaggtagcttcttcaggagaacagccctctgaggaggcaggaagaggaggcttatctttcagcagccggagctgctgagatctctgggcagattaagctctctctaatggatgggctccagcctggcacattcagtggagagggatccactcatccatcatcaacataatatggtcctccctgcacttcacagtgtcctcttgctattgaaaaggcttttttgccttctcaagtttctttgtcaacagtctacaggaagaagctcaggccgccaccggcagaggtgaatgcaagctcacgttttatttctgactgcttaatcattgcctcgatcactgctcaagctctgcctttgtttccaaaggttacctgtgggaaaacttctttttctatgctgaaattaatagggaggcaaagatgagtccactgataagcagagccttaaaactcacatagagaaacaactttgctggagtgtgtgtgagtgaaccactaaggaatcagatagtgtgatggcagttatcattgcaggttaagacatttctacaaatatttcgacatctccatatactcactcctttcccccctgagtggagagactcagctaccaagagaggaagctcaaaaaaaacagaagcttcaaacaaacaaccaaccaaaaaaaaaaaaaaactgtgggttcatcagaggtggtagggaagacaaaaacatgggaggagcagctgggcacggtggctcaagcctgtaatcccagcactttgcgaggctgaggtgggtggatcacctgaggtcaggagttcgagaccagcctggccaacatggtgaaaccccatctctactaaaaatacaaaaaattagccgggcgttgtggtacgcacctgtaatcccagctactccggaggctgaggcagcagaatcgcttgaacccaggaggcagaggttgcaacgagccaagatcgcaccattgcactccagcctgggcaacaagagcgaaactccatctaaaaaaaacaaacaagcaaacaaacaaaaaacacgggaggagcaataaaaaggaatccatgctttgatttttttttttagtgagaggaagggaaggctgctgcctctcacttctccctgttttgttgttcttttaagtagcatgtgtcactctgtatatatcct

SEQ ID NO: 168 - DNA, 2101 bp, Homo sapiens; identical to SEQ ID NO: 167

SEQ ID NO: 169 - DNA, 2101 bp, Homo sapiens; identical to SEQ ID NO: 167

SEQ ID NO: 170 - DNA, 2101 bp, Homo sapiens; identical to SEQ ID NO: 167

SEQ ID NO: 171 - DNA, 2101 bp, Homo sapiens; identical to SEQ ID NO: 167

SEQ ID NO: 172 - DNA, 30635 bp, Homo sapiens
ggcccgcccctcgcagccttgccgcgccccgtgcgccctgtccgcccctcgctcgcattgcaggcatcctgagtctcggcccttttcgccaaatcgctgctctgccgcgcgcctacgcaaggaaagattcaagggtccctccacttcagggagtggagcccgcgcctcggcacggatcagctgtgcgtctcctttggcctactggctcctctgcttgtgtctatagctagctggacgcatcgtgactttatcttctcatctttcctggcgcccccagacgcatttcctggtccctcgaggcagcggcgtctggggagtgcactttgcacagacagggaaaccgaggcactcagcggtctccaatggagacgctgtaatcgcattccacgaccagctagcgctataagcgctgcctctaaagcggaaggcctcccagtccttctcgacaggaagcaatatttgcatatctaaggagaacaagattcggcaatgtgctccgggagcaagtgcaggcatggaacggtatgggctggagggggacagaccttcagaggcggctgcccgttccctgtagtgtcacataagatttttagaagataggagttttcacagtggcggcagagccctctgctaaatcctcatattagatgtcaaaggtggcatgtcatttgacccaatggcttttttagtcatttatcttcctaacacctatgagagaaactgcttgcttccctctcaccctctgcagtttcctgaggcctccccagccatgcggaacgcctgcttccatatcgtaaactgccttggaaccaattaccactaccagggagacaaactattgcttagaggatgctgacaggagcagcatgccaaaattggaagaaggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaagggctgccagccagagaggaggagaagcaatcactcctgcagtttctgaacactacacagacgccaggtagcttcttcaggagaacagccctctgaggaggcaggaagaggaggcttatctttcagcagccggagctgctgagatctctgggcagattaagctctctctaatggatgggctccagcctggcacattcagtggagagggatccactcatccatcatcaacataatatggtcctccctgcacttcacagtgtcctcttgctattgaaaaggcttttttgccttctcaagtttctttgtcaacagtctacaggaagaagctcaggccgccaccggcagaggtgaatgcaagctcacgttttatttctgactgcttaatcattgcctcgatcactgctcaagctctgcctttgtttccaaaggttacctgtgggaaaacttctttttctatgctgaaattaatagggaggcaaagatgagtccactgataagcagagccttaaaactcacatagagaaacaactttgctggagtgtgtgtgagtgaaccactaaggaatcagatagtgtgatggcagttatcattgcaggttaagacatttctacaaatatttcgacatctccatatactcactcctttcccccctgagtggagagactcagctaccaagagaggaagctcaaaaaaaacagaagcttcaaacaaacaaccaaccaaaaaaaaaaaaaaactgtgggttcatcagaggtggtagggaagacaaaaacatgggaggagcagctgggcacggtggctcaagcctgtaatcccagcactttgcgaggctgaggtgggtggatcacctgaggtcaggagttcgagaccagcctggccaacatggtgaaaccccatctctactaaaaatacaaaaaattagccgggcgttgtggtacgcacctgtaatcccagctactccggaggctgaggcagcagaatcgcttgaacccaggaggcagaggttgcaacgagccaagatcgcaccattgcactccagcctgggcaacaagagcgaaactccatctaaaaaaaacaaacaagcaaacaaacaaaaaacacgggaggagcaataaaaaggaatccatgctttgatttttttttttagtgagaggaagggaaggctgctgcctctcacttctccctgttttgttgttcttttaagtagcatgtgtcactctgtatatatcctgtccatgtgttttcttttattattatttgtccacttgcctagaatgaaaactccatgggagcatggctatagtgtcttgttcactcctgcctctccagggcctgaaacagaagtaggtagacagagcctgaaacaaaagtaggcagtccataaactttgctgaaggaatgagtgaatgaatgaagaccccaaggatggacctcaggaaggtgagcctgggcaaaggttttcagtcctagtccatcatgaccacatagctggaatacacttatttcactttgtcacatgaattagagattcatttggggaaacaagcaactgttagagttgcagacatctctgaggggtaaatggctgttcaaatcttgcatcttaccctgatcctcactctatctgctttccaaaaacatggagctaagatcccagcactgagaagatgggcattcctagcagggggcatttaggtgtagacagcctcagtgactcctgggtttaggatcagtgagataatctccagtatctacagtgggcaggtggaagagtgtctgatgcaaactgtatctatttacaagctttccagacagctgggcttgtgccttggaaatacaataatatttgtttctcctccttcctcttcactccttggcctcgtgttctgcagtactggaacctgggtcagatttagctacctcattcattcatttatgaattcatttagccagtgattatggagcacaaatttgtgccggaaactgtgcctcagtgtcctcaacaggttctgacttgtgaattccaaaagcttttgtgatctactgggtaaaacattgttttctaaggaaaatgacatgctgattgctgaacagcatattctaattaccttgtggatcccaggccattcttaaattgggttttgtctttattgccttagactgttaatgaattgtttcccagtctgattgaatgctccttgaagacggacccgggtccagccactgcagtaaatattgctaacttgggggtgtaattctgctgcttttgtggttgctgctttgcttatttttttatgtctgctgtttcctgtgagattgtttctgtgtttcatatgtggattgatgttcggtgaggtttatggaatttctgtgcagcttgggttaagagtatctcttcaaaaaggtttttgcatttgcttctgccaaccttgttatcagctcaagttgtttcttatgttgaattattggggatgacctcccccacactcaagtagtataaattagaacctcgctgggtgtggtggctcactcctgtaatcccaacaccttgggaggccaaggtgcgcagatctcttgagtccaggagctcaacaccagcctgggcaacatggcaaaaccctgtctctagaaaaaatgcaaaaattagccaggcatggtggcacatgcttgtagtcccagctattcgggagcctgaggtaggaggattgcttgagcccaggaggaggaggttgcagtgagcatttatcatgccactgcactccagcctgggcaatggagtgagaccctgtcccccaaaaaatttttttaaactcaaaccctatggtattatacctgctgtgggtataatcctttagttacgattggatgcttgctatgatttctcagaaggaaaacattttttcctacccagagctctttacagctaagcagaatttccccaaatgtgcctttaaaaggtattggcttatgcaggcttctcagtttgatgtcttgttcctgaatgagcaatgaaaccccaaacggacaaccttgccctcaaggacagccgaagtatcagatactccttgcaactccttatgtcagctcacactccatttgtggacatggagcatttccttccttttttcttttccttttgcaaatctagttatgcatttaaaaggatgcaatgtacccattatttccaggtgttttatggcactaatgtgtatggcagaaatgggtgttctctaattgttcataattcaaggtaattatagacatattgtttcaaaattaaatcaatagattttcaagccatgctatgtataaagctccatgcgggacacaaaaagggaaaaaacactatgtaccatgcacccttaagcaatttcacacatgctgtcttatctaattttcacgacagtcttatgagacagttattatccccattttatagatgaggaagctgaggctgcatgatgagtggcttgctcaaagtcacatatctaatcaataagacagctggcataaaacccatatctcactcgaaagtctgtgctttcccattgcacaggttcatgacatagtccaagggagaagacatagctgacaaaaggatcaatagcagtgtaagagtagacaaataaaacaataaggactgcattgcaatagatgttatgaagagggacggacatgattcattgctagtgaatataggccaaagggctataacttcagagtaggcagagatttgtgggccacagtgggaaagatggaggagaaagttagcttgggccttgaagatattgtctcagtgaatgaaggggagaagaccatgcctggcagtggagagagcacaagcagaaggtgggaaagcgtgtgcaggttatgggctccatgagtaggtaggtcatggctatatacaagtatgctgggagataagatggggaaagtttgagtccaagtatggagggctttgattggtaatgaatttggattttatttggtaggcaataaagaaccccagaagacttttgcctaaagaatgatgtagctgaggcagtactttaaaaagatgtgtatggaaaaccatgtacaaattaattgtcaggggagagaatgaaggaaaggagagagcttggattaaggggaagcagtgaaaatcaaatggaacagatggatacctagatatttctcatactgagggtgccaaggccaattgttcttaattaagcaccaatctggttgattccatgggaatttgagatgtcatcaaggtatattgctattgtcatcttccacagactgagcaccagtcaggccactgggtctgagtccctggggctggagcgggtccagtgggcaatttattaaaagttgccaggagaagaagggtgaatgcaggccacatcctgggaaacacacactgaacgtcaatgctggagaattctgagttgtacctctaagttcatggatgagcatgatataaggaagggaaggcaaaaataaaagtagaaagacaggtactgaagtattgtaaatgaacgggtccagtatttgtgaatggaacccacaacttgttttaattagctttaaggtgtctagtacattgtgggtcagcttagtttaaagatataggactaaggcgagcagctttaacatctgagctgaaagggatataaagatgacataccctcttctaaacttccacgactctaccacagcacttatcataatgcatcatgattatcaagttttatatctgtcttctcactagactgtgtactctctgtgggcagggactgtgtcctgtttatctacattcctggcatctggcacaaagcccagcacagggtagatgcccagctaagagttaatgatggcttggaccagggtgatagcagtgggagtggtgagaattgatcagtctttaaatacattttgaagataaagccaaacgggtttcctaatggattggctatggagtatgtaagcaagagagcagtgaagaatgacgcaaggatttgggtttgaggaactagaaggtaaagttgcaatcatctgagatggagaaggctgcaagcagaacaggtttcagagaaaagatggcgggttcacatttgaacatgctgatgctgggtgtctattatgttcaagtggagatggcaagtggcagtggtttcttacatttgaaatctgagagagaggtttgggccaaagatacaagtttgggagtcatctgcataaagatggtattaaagagttctaaacggggtgttatcaccaggggagtaagtgtagacaaagaagagcgccaaggtctgagtcctggaatattacaacactcagaatctgtgagaagaggaaacaccagcaaataaaactgataaagagcagccaaggagataggaaagaaactaagagaaaggggaagtcctagaagccaagtgaagagaaaatatagcaaggagaagggggatcaactgtgtcaaatgccactgatactcaagtaagatgaggagtgggagctgcccattagatttagcatgtgaagatcattgatgtccatgataagacttgggtgcctggttggggcaaaagcctgagtggggtgagtttaagagaaaataggaggacaggcattggagacaagcagtacagacaactcattataggagtgctacaatgagaagcatctaaatggggtggaagctgatgggcaaagtgggattgagagaagccacttgttcatttagatggaagaaacatcagcgtgtttgtattctgatccagtacaatgaaaaggctaagagcttagacctgctaagctcacatactcaggcttccatcttctagtgatgactcctattgtgagttcattgaggatgagagctaaatgtctacccttacctcttgacataagatatatagaagatgcttagcaaatatttatcaaataaatgactatgcataaaatactttgcaaactctctgagccgcagtttcatctgttaaatgaaagtaatatcacctacctcagagaattaaataagataaagtacatatagtatataacaaagagcttagtacttagtatatgctcagtaaatagttagttttattgttagttcaatgctttcattttacagataaggtatctgaggcccagaaaatagtttgttcaagattgcacagttaatgacagagctaccagtttcctagactcatattccttagctttttccacataaccagagaatttacctacaattcccaggtaccacagatgtgggtgctttcaagcctctgtaaattcactaagttgatgagaaacctggatattagtaattaatggcagatctgaaatctctctagaaccttcctatgtggccaacatatgtcttcctgtctaatttgtcaagatactctgcaaagtcaatcctagtacaaggctccatattcatcttgaagctttttcttgttttaccagaattctggttttaattttttgagtagcaatccatgttactctttacatacccaagtcaagggacaaagctaagccacatgcttgttttgttcattatccaatattatgtaagtctagatgactgactccattagtttaactccaggtgacaatgtagatatagatccaaaatatgtttctggacaatattaatagaaatttttatgaccttggaacacaccctccctcattgtacttgcaatagatgaataacctgctcttgctaggatgagtgaagaatgtttacctttgtcaacatttattagtggagtactatatgcagctattcctttaataaaacagtaaatcttcagcaaagtttataggttgtctttcatccaaagacctcaaagaaactttgctaacactgtgtcattattcatcatacaacttgccaagggaggcaagtggtgattgtttcaaagagagaaactgaggttccaggaaggtttctgtgacttctaagggtcatgaacagggtaaaaaagaaaaaagaaaaaaaggaaagaaagagagagagagagagagagatctgggcactgagcccaaattcctgttgctcaggccaaagacccagcgctcctcctagagctctctaaacatttctttctgatagaaaatgtaatttactaccttgatctgttaagcagaaatgaactctcaacctgtcttcaatgacagggaaagccaacctttatttctgaagttacttcaagtcataaaatgcttgattcactgtattaaataatacagtattaaaataagtaaatagctttgtagtcataatgatagcttggatttaaatggtgcctgtgctctgaaaagcagggtagttcacaggcttctgcagacctttggtctcatttggctaccctcctctacccttcttcttcttttttttttttttttagacgaagtctcgctcttgacccccaggctggagtgtgatggcgtgatcttagttcactgcaacctccgcctccccagttcaagtgattctcctgcctcagcctcccgagtagctgggattacaggcgcctgccaccacacctggtgaattttcgtatttacagtagagacagggtttcaccatgttggccaggctggtctcgaactcctgacctcagatgatctgcccgcctaggcctcccaatggctacctttcttgacttcaagtatccctttccttcccacaggtcttttcttcaccaacctgctttcttcactcacacccttattctttcattcaattattttttcttctgcactagcagctctcaagtgaaaagaaactccctgctttagctgtatatgaagaaagacctccaggccctctggaagagctgtggaaggccatcctatgtagatcctccaagaggctcttacaggaatgagttaagatcccatcttgtttggaggttaatgatcaatgtttcagagactgactagaactaatcaaacattcaagttctcttctaaatttcccagtccctcttctatttagatctgggccttataactagttctggccaataaaaagaaaggcagttgagaattatattcttcctccatcgccctcttaacttgctacagtgaccttggaggtcacatcttccaagacactacagctacaagatggaggatggttgcccacctgacttctgactttgcatgagcagtaaacaaactgtcatccggttacctggagatcaaaacccctgagattttgattgtagcagctgctgtcaattatcctgactaacagcaggagtgaaatattgcaatagtttaaaaaaatctaagagatgtggcattagcttaccagttaggctggatagatggaaatccatgatatgcagtggcaaaaaatttaatgaagtacggctggcgataacttggaaagcagaccatgagccaactgagtttatacatttaacacagaggccagccaacttttccataaaaagccagataatgaatattttcagctttattggacagactcctttgcaactactcaactaccattgtagcatgaaaacagccatagacaatatgtaaacaaatgaacatggttgtgttcaaacaaaactttatttacaaaaacaggtagcactctggatttggtctgttggctatttgctgacccctagtctaggggaagagtttagataatatgttgccattggctgcatttgacaaggaattaaagttaagagatgagtttagaaagtgttggccggcttgcaggcagaaattaaagagagaaatcaggaatttggattcccaacttttcacaagctgtaagtggtctaaaaatgctgtacagactccagtatccacttagatagggagaaagaggataaatacacaaaaataaacctcctgataagcagagtaggcatggaggagcatgaatgtaaggcgagcaggttaatatttgaacaaagacccgaaaaaagtaagggacaagccaggtgactatatagggaaagagcagaattatagcaagtgcaaaagccctggggcagcagtgcacctaatacctgcagggaactgcaaggatgccagtattgctggaaccgtgggcacaaagggtgggaaggggggtggtagtaaaagataatatcagagggagggcaggtgggcatggggcagtcttcaaaggtaaatcatacagggccttgtaggtcattatgaagatgccagctcttattctgaattagtgggaaagccatagagggtattgaggtgaacagggacacactccaacttatattcttgaaaagataattctataatatggcaaaaccccatctctacaaaaaaaaaaaaaaagaaatacaaaaattagccaggcatgatggctcacgcctgtagccccagctacttgggaggctgaggtgggaggatcatttgagccccaggaggtcgaggctgtggtgagccatgatcacactgcattatagcctcggtgacagagtgagactctgtctcaaaaagaaaaaaattcattctggttgccggactgagacaaaacaaagggggtggggagtaagcaataagaccagccaaaagtcttttgctgtaatccaagcaagaaataatcattcatttatacattcatctgttccctgagtgggtcccagagtctctgaatcatctcaaccattttgcatctagttctcaactattcgcaactagttctcaaacttggctgcacattagaatcacctgagaactgtgacgatgactgctcctagggttctacctccagagattctggtttcttgagtatagaccttggctggggtggggttggagtagatattgtgtggcccgacatcaggatttttaaagctccccaggtgattttcttgtgcaacccatttggagaaccactgatctatataatacaccctctttgagctgagctcagagcctggtggagttcccagtgttcaataatcttccaggtctctggcctcattttttgactgcagggagcatcttccctcttattgacagctttgcagtccccatctggggtgcaagagactacagggtgctcggaagtgtccatcctggaggcatcatcaaaactacctacttgttttgggggtttttccaacttttattttaggctcaagggtacatgtggaggtttgttacatgggtaaattggcatcatggggatttaatgtacagattatttcatcacccagtaatcaccataatacttgataggtagtttttccaccttcaccctccttccatcctccactctcaagtaggccccggtgtctgtttttcgtttttttgtgtccatgggtactcaatgtttaactcccactaataagggagaatatgtgatatttggttttctgttcactgtaatgtgtttaggataatgacctccagctccatccatgttgctgcaaaagacatgatctcatccttttttatggatgcataatattccatggttaatatgtaccacattttctttatcaagtccaccactgataggcatttagattgattccatgtctttactgttgtggatagtgctgtgatgaacatatgtgtgcatgtgtttttggggtagcatgatttatattcctttgggtatatacccagtaatggaattgctgggtcaaatggttgttctgttgtacattctttgagaaatctccagactgctttccacagtggctgaactaatttttctaatgaactaattacattcccaccagcagggtatagggatttccttttctctgcagcctcaccagcatctgttagtttttgactttttaataatagccattctgactggtatgagatagtatctcattgtggttttgatttgcatctctctaatgattagtgatattgagcagtttttcatactcttcttggccacatatatatcttcttttgagaagtagaaacatctattttttccagagtttctatagcttagcttagcactagggaagtgggtggggattgctgggtgtgctgtgggaagatgacccttccataaaagacagcagggtgggaaaaggccccatgttttcagaatattagtatatatacatatatatatatatatgtatatgtatacgtatatatatatacgtatatatgtgtgtatatatatacacatgtatatatatatttatatatttatttatatatatataaatatatatataaaaatatatatatatttagtcgacatccctgttctatcccaaaagcctaggcctgtttctctagcagcctggaaaatccaaatgtagcaagaaacacttgtctgcatctgaaactggccatcagaggacaggtccttgacacacaagcacagagtggtctttcctacagctcggacatgccctttgctccttccccctgtaagtcaccctccttctatgttttcctaaagaaagttatttttacccactttggaatgccagttcggaacagcctctggcatcttggaaggcactgtacaggtacttttcatctctaattgctcctgcttctccatttaaaagaaatattttcaaagcaatgggagcaagttactcattcaaatgctgttaacaaataacaggacttgagtgtgtaatctgaagttactcagctttgaaaagttgccctgaggagttaaaatttctgcttcactggaaattagaagggaggatgggggggatgtccttatgcgaggaattttcagcccctggaattttatgtctgatctccctcacatctgagctggaacgtgagatccagtgcaagattgcaggagagagcgggctggggacagttctggggcctgcaggtgttccgtttctgtgccaaccagcaagggccgctccccctgcaccaccaaacacccgccaggacttgctggagcccatgtcagtggagtcagcttataaattactcgggatcatcattccatgttggatcgaatcatagagggtggagtgtagaggtgctgcagcctgggcttcaggtggagggctttctggaggaactccacaagcaaaggctgacaacgcagccatgacaagccacagactcccagcgaactcagccccaagcctacactttctctcatgccacaagagcaactgagccaaaagctgggagcctgggccccttctcccatttctgttttaattactgctttttcttttaatatatgtttcccggcatgctgtaccatgagaagtagggacagcaatgccctccagggaggctgcacatagtaagtgttcaatataattaagtgtcagtaaatgtcaattcccttctgtggtttaagaaaatatgcaggccccagggtggtatggaagagatgtgactggtgagtcctaaagtgacgtcagtaataagggaaggaaaatgttaaggaggtcaagactcctcattagggaagaaaagggacttcacctgtgcctgccaatcaccaaggactctcaggtttggctcttctgtggacaggtccaagcttaaaagagtactcatggcataggaattctgaaaatatttattaaagagagaaaggatgattcaattagaggtgggagggaggggccatgattaaaggaagagatagaagaaaaggacttcaagtttccacttgaaggtggctcctcatcctgttggcaaagttctgaggaagaaaaggtatatatggaatgccacttactccactttggagcttcaaagagggtgtggggaggcagaaggaaaagaggctgaaggagaaagagcaggaagggaagagtcaagggtgaagtgctcaagttctcccattctgtgctaagaatagcaggctctcttcaggggaaattcagtccctcttcccaccatggacttgacctcatcaggctctccagcctgccccagaccacctaccgacagggactcatgatgatagtttgagagtgaatacattcaaggcccaaccccagtactttacatatctcccctccaaatctagaaaccaatgccttggctccctatgttcctacaacttggctttttctgcataaatcccctttcaaagctcttgtcttagagccagttgatactgatcgacacatattttaattaaatttgcatttacctattgattttcatacccagtctcattccaaaaaggattggaggcagcttctaacatttcaatgtgataatcactttgataaatctgccttaccacccctgttcacaaacacctgtatctacatccacgaaatatagatgatcttcatagtttaattgtaaaacaatacacaaaacacctttgaaacctggctccaagttttaaaataggtgcattgtactttgtatgctaagaagtttcagacaggattgggcgtcctggccacagaaatagagtcttgtgggagacccccagtttggattcagagtttgggatggccagaagtatgaccacattgattttctttccttgttaggtgtagagaaaaagaggtacacaggttgtgttgaagagcagagtttcgtccaaaccaggtgtttggagcattggaggagggaaattttcctcccttccaggagcccctccagcatcccagatcttgccaactcagaccctttcccagacaaacttgcctctcatccctcagggagtcagttgatcccagctggaactgtaatcctttgctaaaaggcctcttggctgaagcccagctcagcagggaagggttcagctttgtccttggggggcttctgcaggaggtcccattcttggggactctgacactgtgggaatctggcaggtgccccttcccaggttcacagaggttgctttggggggttgcaacaggacttgcttctctggtgtttatctcagtgaaattcaagaaagtccatgtgcagtttcatcctgggataaaggagggtcttctcttcctaccagcaactccaggcaagatactctcctcagcccaaagggctaaagagaaggcaaagggaacaaaggaaggccattttactcattgttgttgaacttaaaatgtgtaattatcttctgaaaacagctgaagggcttatgtaaagcatgacacaggagaaggtatttaaacatgaaacaaggcagcatcttttgctggagcagaatacctgctttccaaactccagatcgactttggaggaggagaatagcatgacagcctccatgtgtgagtcctgtcaacacttggcatccaccttcccattcacttttcacaacactgcatggtaaaccatttcacagataaagaaatggagtctcagagaactggagtaaattgcccaaagatgcacagctactcaataatagaacctgaatttgaacctgctgggtaattctagagccctcagccttagccactacacagcgctccttcccatactgtcactacccatagtcgttcagccatgcattccctagccactaaggcaaagcaaaagataatgggctcaatgaacctcacccctcagatgggctaagtcacacggcacttttgttttcattgtgaatgcccatcagtgaggcacatactgcctgttacagcagatctgcttcgtgcatttgtaagttttgcctgaccctggtgtgcatttgagtttgcgattccaggactacaacatttctaataggaaaaatgtcagctctgtcttattctgatattgacatgctttggggatgccttaggaggctaggaagccttctaagtagcttctgaatttaacacatttctatagaactgttacaagctggttgggaatgtggaagcatgctcaccaaagacggttttcattaggctcaaatcaatgatgagcttttcctgagaacttgaggctttaggagagagtagcatgggccgttggattattataacaacaacaacaaaaagattttaatacatttttctctcattgttttgcctgatgacagatgcaatcccagatcacaggcatttggtgcatgagagcttttctgtttacaggtgtccactgtgccttggagagggctggggcaccgccctagggattgttatttcagacaagaacttcaccctacaaagtaaaggcaagacaaaatgtcattgtcccttttatgcatcacagaggcacattggacttgtagaaggagcataccttttagacactaggtggactaggtaaaacctggatttgaatccagctttttctacttcacagttgtatgacctaggacaagttacatcaagtacatttttgagtccagtttcctcatcagggaaatgcagataaaaatacagactttgttaaggtaccgtaaggattagaggtgatatatggaagaccccatgcagggaagaccccctggaagactctttgtagttgatctagatattatcaggagcagcgtgggacatgcggcactgcacatgctggccactagcttgcacagcaggtcctcaaataatgtcatgtttttgtttttgtttttctgagacagggtcttgctctgtcacccaggctggagtgcagtgacacaatgctggctcaacctcctgggctcaagagatccttccacctcggcctcctgagtagctgggatcacagaaccttccactggccactcagcgaaaggcagctgattcagcacctggagaagaccggcaacagggctgagtttccttgcactgcagaggaggggagaggcaaggagtggacatgagcacggaggatccagggcactcccttgatggtgatgccctcgaagggctgccccgtgcccattgtacagaatgtggattccaccccacgccatgagagctctcgcgcaggcccagaccactttataagccatatttcccaccaattcctgtttctggatctgtcaggttatttcatatttctaggcccttagctttgcttcctcttccctgaacgccctttgcccacatcatcccagctctccttctcctcctgccttctgtcttctcttcctctcatttcttgtcacccaggctggagtccagtggcgtgatcacggctcactacagccttgaactcccgggctcaggtgatcctcccacctgagcctcccgagtagctgggactacagatgcacaccaccatgccagctaatttttaaaactgtttttagggatggggtcatcttcctgtgttgcccaggcttgtctcaaactcctgggctcaagtgatcctctcacctcagccttccaaagtgctgggattacaggcatgagccacaacatccagccccttttctcttttcttacccttctttcctattttcttttccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagccactagatgtcatattaatttcacagcagaatagggaagcccatgccggagctgaaaacctgcaacaacaaaaaagcatctaaatactgcaaaaaaaaaaaaaaaaaagagggagagaggcatcttaatatttgtccttaacacatcataccagacttctgcttccaggaatgactggatgtggtttttctaggtggacataatacaaaatgcagctacctgaaaacaatggaaagtggacagagcaggcagattctggtgggaagtccacgcaataaagaaaagatgttacaggaagtgagcgcccatttttgctgtttttagcttggaggcaggtgcagccattgtgcaaaccaggtgtggtgctggtggaaaaacagccatctttttggactatgaaaatggaaggttgagttcagggcaactataactgccaaaagagagaagaaagagttctggaagagaaagagccaaagagggaattcccaaattctttctgctcctgtctgtggctgatcccaaaccacggacacacacagcaaaaacaaaagcatctcagccagagacaaaagagtctaaaagagactggacctgccacctgagaaacagagtttgaagttagagttcaatcacaaaaaaatgcctgctaaaacaaaataaacaaaacctattagagaaaaggtgttctcttatcagaatgtagggcctccacaacttaacgtttataatgtgtacaatccaaacttattcgacatatgaagaactggaaaagtgggacccattctcaagggaaaagatagcggagattcactccaagatgacccagatgttggaattatccaccaaggattttaaagctactattataactgttctcatgctataaaatccactatttagatcatacttaattgtgaagaaatgaattctttcctcctaagattagaaacaaggacggcatgaatacccactttcactactaacactgaattttgtacgaaggtcccagtcagttcaatatttttaaaaagattttaaaaaaagcaataaaaggcatacatattggaaagggaaaagtaaactgtctaaatttgcagatgacaaggtcatataatggtttaaaaaaagctactagaacaatatgtgagtttaccaaggttaaaggatacaaggtcaatatgccaaagtcaagtgaatttctatatatttgcaatgaacaattcaaaatggagttttaaaacatttttatttatgatagtctccaaaatactttttaagaaagaaaatgacagaagcaacccaagtgtctactgatggataattaaattatagtatataaatacaatggggccgggtgcagtggttcatgcctgtaaacccagcactttgggaggctgaggtgggaggatcactcgagcccaggagttcaagaccagcctgggcaacatggtgaaaccccatctctagaaaaagtacaacaattagctgagcatggtggtgcacacctatggtcctagctactaggaggctgaggtgggagatcaccggagcacaggaggttgaggctgcagtgagctgtgattgtgccactgcactccagcctgggtgacagagcaagaccctgtctcaaacacatatatacatacatatgtggaatacaatggaatatttacttaaaaaagaaagaaaattccgacaacatggatggaccttgaagatattatgttgagtgaactagtcacaaaaggacaaatactgcataattgtacttttatgaggcacttagagtaatcaaactcagagacagaaagtagaatgctggttgccaggggctggtagaatggaaagttattgtttaatgtttataaagttttagttttgcaagataaaaagatttctgtggatggatggtggtgatggttgcacaatgtgaatgtacttaatgccacttaaaaatggtcaagatggtaaattttatgttatgtgtattgtaccacaattttctttacaaggtctcaagttggacattaaaatgccaggcaattaaaagtatttatgtttaaaacttaatttaaaaaataattgacaagtatattctaaaatttgttcgagaaggcaaaggacctagaatagcaagaatactcttaagaaaggaaaacaagtttggaaggacttaaactacctgaattcaagacttatcattaagatacagtaatcacaacagtgtgttactggcataaagatagaccatatgagatcaatggaacaaaataaaagctttaaaatgcaccaatacttatatggtcaattgattttcaacaatggtgccaaagtaatttaatggggaaaagatagtcttttcaaaaaatggtgttagaacaactggatatatatatatatccattatatatatacactcatttatatatacatcatatacatgtatgtatcatatatatgtatatagcctcaactcttatttcatatcatatacaaatatttgaattgattgtagacctaaatgaaggagctaaagctattaaacttttagaagacagcataaaagaatttccttccttctgccttgccttgccctgccctgccctgccttgccctgccttgccctgccctgccctgccctgccctgccctgccctgccttgccttgttttgtaacagagtctcactctgttgcccaggctggagtgcagtggcgtgatctcagctcactgcagactcaatcacctgggcttaagccatcctcttgcctcagcgtcctgagtagtttggactacaggcatgcgccaccacacttggctaattttagttttgtttttttgtttttgtttttttgtagagacaaggtttcattatgttacccaggctggtctcaaacttctggactcaagcaatcctccctcctcggcctgtaattatttcttaaacagggcacaaaaagcacaaatcacataagaaaaaaagataaaacagacttcatcaagatttaaagcttttcctcctcagataacgagttgagaaaacaaagacaagccacagattgggagaaaacattggcaaaacagctattaaaaaagccttctatccagattatataaagaacccttaaaactcagtaataaaaagacatacatagtaagtaatgggcaaatgatttgaacaatcactttataaaagaagataaatgaatagccaacaaacacataaaaagatgctgaacatcacaagtcattcaaggaagtgcaaattaaaataataataaaatactattaaatgtccactagagtggccaaatttaaaaaaaatgaaaatcaccaggtattgtggctcacacctgtaatcccagcactttgggaggctgagatgggccaatcacttgagcccaggagttcaagactggcctgggcaacatggcaaaaccctgtctttacacaaaatacaaaaattagcctggagcatatctatagttccagctactcagggggctgaggtgggaggatcgcttgaaccctgggaggccagtctgcagtgagtttagatcatgccactgtactccagcctgggtgacagagcaagacactgtctcaaaaaaaaacaaaaaacaaaaaaaaaccccaaaaaataaaaatgtgaggaactctcacacatttacacattgctgaaggcaatgcaaagtggtacagtcaggccggaaaacagagtgacaaggtcctataaaggagtggtcccaacctttttggcaccagggaccagtttcatggaagacaatttttccatggacagtgggggaagggaatggttttaggatgattcaagctcattaaatttattgtgtactttatttctattattattacattgtaatatataatgaaataattatacatctcaccataatgtagaatcagtgggagcactgagcttgttctcctgcaactagatgatcccatctgggggtgatgtgaaacaatgacagatgatcaggcattagattctcataaggaacacacaacctggatccctcgcatgtgtagttcacaatagggttcatgctcctatgagaatctaatgcctttgctgatctgacagaaggcagagctcaggcagtaatgcgactgatggcaggtggctgtaaagagagatgaagcttcattccctttcctgccgcacacctgctgtgcagccccattcccaacaggccaccgacaggtactggtccaataaagtggaagatatccttaccagtaacccaacaatcccttctcctagagaaatggaaacacatgttctcacaaagacaagtatgcaaatgcacatagcagcattattcattgtagccaaaatttgaaaacaacccaaatgtccatcagctggtgaatagatccattgtggtacatctatactgtgggatactactcagcagtaaaagggaatgaactattgatacacaaaacattatagatgaatttcaaacacattatgctaagtgaaaggaatcaaatacaaaagactacattctgtatgactaaatttatatgaaattttagaaaaggcaatattacagggaagggaagcagatcagcatatacctgaggctactaagccaggtgaagggcaggttgcaaaggggtatgagaggcttttagcaagtgatggatgtgttctgtatctttattgtggtgacatttacatgactgtatacaattacccaaagtcattaaattatacaattaaaatatatgaattgtactgtattgtaaattatacttcaatacagctgaagaaaaagtcaacaacaaccacaaaatcacagccaaagggctcttctctatggctgaaagatattgggtccacatattccagagtcccttgtactcatatcatggtctactatataaataaatcataatttatttttaaagttaatcattgctgaacatttgtaatgtttataatttctttcttttttgagtggaccaatggaggggtgtaacgttcttctatgagtccctggagcacttttgcaagtaattctacatataaaatgtgttgggttatagattataaatgtactcatgtttcttttttcatatgattttattcttttttagaatttcatttgaatagaatcctaccttatgtagtctttcttattaatacataatagtatatatttgggggttatatctggtatactgatactttcatgtaatggtaaaatcagggtaattgggatatccatcaccttgaacatttttctttatgctgggaacatttgaattattctcttttagttacatatttatcttttatgctgggaacatctgaattattatcttctagttattgtcaaatatgcaacagatatattattaactatagtcaccctactgatcgattgaacaggtcttatttcttctacctaactgtattttggtacccattaatcaacctctctttatatccccctcccctccacacttcctggcctctaggaaccaccaatctactctccatcttcatgagatccactttattagctcccacatatgagtgataacatgtggtatttgtctttctgtgccaaacttgtttcacttaacacaatgaccatgttgctgcaaatgacaggatttcattcttttttatggctgaataatattccattgtgtatatataacacgttttctttgtccaatcatccattgatggatacttaggttggttccatactttggctattgtgagtagttctgcaataaacatgggattgcagttatcttttcaatatattgatttactttcttttggatatatacccagtagtaggattgctggatcaaatggtagtcctatttttagttttttgaggaacgtccacactgctttccatagtggctgtactaacttacgtccccatcaacagtgtacaagtgttccctttttccccacacccttgccaacatccaatattccctattttttaaataatagccatcttaactagggtgaaatctcactgtggttttgatttccatttctcggatgattggtgatgttgagcattttttcatatacctgtaaaccatttgtatgtcttcagaaatgtctattcagatcttttgtccatttttattgggttatttttttttgctattgaattgtttgaattccttatgtattctagctattgatcccttgtcagatggatagtttgcaaatattttcacttattctgtgggttgtatctttattgattgtttcctttgctgtgcagaagctttttagtttgacataattgtatttgtctaatttttgcttttggtgcctgtgcttttgaggtcttactcaaaaaatctttgcacaggccaatgtcctacagcacttctccagtgttttcttctagcagtttcacagtttcaggacttacactaagtatgtatgtatgtatgtatgtatgtttttatgtatgtatgtatgtatttatttatttatttattttgagatggagtctcactctgtcgcccaggctggagtacagtggcacaatctcgtctcactgcaacctctgtctcctgggttcaagcgattctcctgcctcagcctactgagtaactggtgcacaaccccacagccactaactgtttgtattttaggagagatggggtttcaccatgttggccaggccgggctcgaactcctgacctcaagtaatccacccgcctcagcctcccaaagtgctgggattataggtgtgagccactgcgcctggccacatttaagtctaatccatttttggtttttttcatatggtgagagataggggtctagttttattcttctgcatatggttatccagttttcccagcactatttattgaagagattgtcctttccccattgtatattcttgtcaccttgtcaaaaatgtgttggctgtaaatgcgtgaattgattctaggttctccattcagttccattggtctatgtgtctgtttgtatatgagtatcatgctatgttggttactgtggctttgtagtatattgtgaagccagagtgatgtgatgcctccagttttgttttgctctggattgctttggttatttgggtcttttgtggttccatatacattttaacattgttcttttctatttctgtgaagaacgtaattagaaaattcattgtgaaagggattgcattgaatctgtaagtagctttgggtagtattgacattttaacaatattatttctttcaatccatgagcatggaatattttttcaatttttgtgtgttctcttcaatttctttcatcagtgttttattattttccttatggagatccttcacttctttggtttaatttatttatagatcttgtatatttttggtagctattgtaaatgggattgctttcttgatttccttttcagattgttcactgccagcatatataaatactactaatttttgtgtgctaattttgtatcctgcaactttactaaattcatttatcaattttacccatttttggtggagtcgtcaggtttttcaaattataagattatgtcatttgcaaacaaagataatttgatatttttctttccaatttttctctttctttctcttgactaattgctctggctaggacttccagtgttatgttgaataaaagtggcgaaagtgggcatccttgtcttgttccagatcttagaggaaagactttcgattttttcccatttggtataatgctatctgtgggtttgtcatatacagcctttattgttttgaggtatgttccttctgcacccagtttgtggaaagttttttgtcataaaaggatattgaattttatcaaatgctttttcagcatctattgaaacgatcatacggattttgaccttggttttgatgtgatgtattatattattgatttgtgtatgttgaaccagccttgcatcgctgggatgaaacccactggatgatggtaaattatctttttaatgagctgttgaattcagtttgctagtattctgttaaggatttttgcatctgtgttcatcagggatattggcctgtatctttctttttgttgtgtccttgtctggttttggttatcagagtaatgctggccttgtagaattagtttggtcctcactcttcaatttttttgaatagttggaacagaattggtattacttcttcttcatatatttgctggaattcaacagtgaagccatcagattctgggcttttctttggtggaaaactttttatcatggctttgatctcattactcattattggtttgttcaggtcttccatttctttgtggtttaatcttggaagattgcatgtgtccagaaatttattcttctgttttccaatttgttggtgtatagttgttcataatagtctctgattctttgcatttctgtgctgcctgtacttatgtcttcattttcatttctaatttgatttgggccttctatatttttttcttagtgtagctaaaagtttgtcaatttatttatcttttcaaatagccaattttaaatttcattgattttttgtattttttttagtctcaatttcatttgtttctgttctggtctttattatctctttcctgctaataattttgggtttggtttgttcttgcttttctagttccttgaggtacatcgttaggctgtttatttggaatctattttttgatgtatgcatttattattataaacttcctcttagtcttgcttttgctgtatcccatagattttggtatgttgtatttccatttttgtttcaataaatttttaaaccactttcttaattttgtcattgacccattgattgttcatgagtatgttgtttaatttccatgtgtttgtatggtttccagtttcctcttgtttttggtttctagtttcattccattacgatcagaaaatatatttaatataatttcaacttttttgaatttgttgagacttgttttgtggcctaagatatgatctattctggacaatgctctgaagagaagaatgtatattctgcagcaattgggtgaaatgttctgtaaatgtcagttaggcctatttggtctagtgtgtagtttaactccaatgtttctttcttcaatgatttgtccgttactgagagtcggaagttgaagtctcccacaattattattttgcagtctctttctttaaatctattagtgtttgcttcatacacttgggtgctccagtattgggtgcatagatatttataactgtaatattgtcttgctgagctgacccctttatcgttatgtaataccttggctctttttacagtctttaacttgtagtctattttatctaagtatagctaatcttgcaattttttggtctctatttgcatggaatatctttttccatcccctatttcagtctatgtgtgtctttgtaggtgaagtaggttttttataggcagcacatagttggatattgtttatttattcagcctctgtatgtcttttacttggagaatttaatccatttacatttaatgttattattgatagggaaggacttactactgccattttgttacttgttttctagttgttttgtaactcctctcttcctttcttactgttgtcctgtgtggttattttctattgtagtatgttttaatttgttgttttttatttttagtcaatctattgtaggtttttgctctgtggttaccatgaggtttaggaaaaaaccactgtattgttactaaaagttattattttaaaaaggtgacaacttatctttgatcataaaacatatagaaacaaaggaaaaactgaaaaaaaatctacattttaacttcatcactactcccaccctgccccattttaacatttggattttctacatatagaagtttatcatattagcataatgacagattgaatttcaatcttcatttatttatttttcttgccttactacactgtctagaaccttggtatgttgagtagatgtcttaatgtaggcattcttgtctcattcgcaacatcaaaagaaatgtttttattgtaagctgattttttttttagtagatactcttatcagttcagaaaggtttcttctagtcctaatttgctaagtttttaaaaatcatgaatggacataaacaacatttgtttctcacaattctaaaggctgagaggttcaggatcaaggtgctgacagattctgtatcttgtgagcaccattttctgagtttgaaaatggcctccttctcgccatctcctcatatggtgaacagaaagggaggactctagccttttcttcttataagggcactaatcctatcatggagtccctaaccccatgactcatctaaccttaattacctcccagagactccacctccaaatatcatcacattgggaattagagattcaacatatgaatttgggaaaggaaggacacaaatattaattccacagcagacattggattttatcaggtgtatgtgtcttcatctactcagatgatctatgatttttctctcatcttttaatatgaattacatgggttgattttctaagttaaattaaccttgcattcttaaaatgaaccccattttgccttcattatgctttatatacatcgttactcttaaattgctaatattttgtcagtttctattatgcatgagattagcctatattcttcctttttcatattgtcttcttgttggtattttagccttatcaaataaatgggaaagcatacttagaaacacactttgtgtaccttctcagattcccttaactgcctccctctttccttcccttggtgggcaccccacacatgccaggtttccccttcacttttgaactttaataaaacaccacatcatagtacatggatctcaattcctgaacagctgctaagtcggcatgatgcaacacagatgaaatggcagtaatatccttgttgggtgaatgttactcaatgagaactgggagatgggagcttacctgacaggaagattacccccttttctctcttccactgactactccaagatattgttcctccttgcaacctttccaaaaacatccacattccaagaatctcacatactgagtaacctaacatgtcccttttgacttactatgaagtggtagtcaatatagtaatgcatcatatcacatttcattggatttcccttgctttatttctacttttctctcattcatactgtgctgaatttgcatttcccaaataaaatattagcatctttttcgagatggagtctcactctgtcattcaggctggagtgcagtggcatgataccagctcattgcaacctctgcctcccggcttcaagtgattctcctgcctcagcctcccaagtagctgggattacaggcaggtgcccaccatgcccagctaatttttgtatatttagtagagatggggtttcaccatgttggccaggctggtctcaaactcctgacctcaagtgatctgtccacctcggcctcccaacgtgctgggattacaggcatgagcgactgcgcctggtcaaatattagcatcttaatccttgcctcaggctccactttctagaagacctaaactaagaccaaaattgcctcctttgttctatgcactggagtattttatgtaagattccataattttgttcctttaaagtttgatagagcttataaaccatctaggcctgggtttttctgtgtggaaatactgggaagtactgttatctttaatgattttaagactattcagtttttctacatcttcatgagacaattttcctaagttatagtatttaaagaattcaccctgttatctatacttacaaatttattggcataaagtttatatagtatacttttattacctttttaaatacttgtattaatctttatatgacctgtaggaatgctcatattttcattcttatcgttttggttctttcagtcttgccagggttttatatattttatgagtatttttgaagaaccagttgctgactttgttcatctctattgtgttttctatttccaaggttgctcttacctttagtagttcctttttttttttttttggtttccattttgttattgtttaactttgtgtattgaatgactcatttttagtctctcttttctaatatgcacatttctaagcaggtctgcctatatgctctctaaatactgctctagctgcattccacatattttaataggatttgacagttttaatttccatgactttttcccatgactaattagaaatgtttattaattctcaaatacatggagctttcctaaagatgccttttatactgatttctatctgaaatccattgtggtcagagaatactgtgtgttttgtagcaatcctttgaaatacattgagacttgcttaatttgcaagtacaggttttcatatttttccatatgtgattggaaaaatattaatttgacaatttggggatatagtatacacacaatacacacaaacatatatgtattttcagtacttcaaaatttctacatatttcctggtatttgtctgcttgcttcattaattactgagagatgtacgattttgagttgtactttcttttgttgctctctcatttttctttcatatccttatggcaattgtattaagtgcataccaatttaaaattatttcaccttcatgaatgtcaccttttattacacaaagtgatattttctattaattcgcctaaataaactttgcacttgagtcctttttcagggtctgcttcttgggggaacctaaactacgacagttcgtctcccctggtatgttgtagcaccacgatagctaagactcccacctgtggtaaattggtattgggcccatcaggaaggggatacactcacttacgtaatctctagaatgatagagagatgggggtggtgttaattataaggatggtggaataggttggttgtt

SEQ ID NO: 173 - DNA, 30635 bp, Homo sapiens; identical to SEQ ID NO: 172

SEQ ID NO: 174 - DNA, 14161 bp, Homo sapiens
cctgcttccatatcgtaaactgccttggaaccaattaccactaccagggagacaaactattgcttagaggatgctgacaggagcagcatgccaaaattggaagaaggtcttgctctgtcacccaggctggagtgcagtgacacaatgctggctcaacctcctgggctcaagagatccttccacctcggcctcctgagtagctgggatcacagaaccttccactggccactcagcgaaaggcagctgattcagcacctggagaagaccggcaacagggctgagtttccttgcactgcagaggaggggagaggcaaggagtggacatgagcacggaggatccagggcactcccttgatggtgatgccctcgaagggctgccccgtgcccattgtacagaatgtggattccaccccacgccatgagagctctcgcgcaggcccagaccactttataagccatatttcccaccaattcctgtttctggatctgtcaggttatttcatatttctaggcccttagctttgcttcctcttccctgaacgccctttgcccacatcatcccagctctccttctcctcctgccttctgtcttctcttcctctcatttcttgtcacccaggctggagtccagtggcgtgatcacggctcactacagccttgaactcccgggctcaggtgatcctcccacctgagcctcccgagtagctgggactacagatgcacaccaccatgccagctaatttttaaaactgtttttagggatggggtcatcttcctgtgttgcccaggcttgtctcaaactcctgggctcaagtgatcctctcacctcagccttccaaagtgctgggattacaggcatgagccacaacatccagccccttttctcttttcttacccttctttcctattttcttttccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagccactagatgtcatattaatttcacagcagaatagggaagcccatgccggagctgaaaacctgcaacaacaaaaaagcatctaaatactgcaaaaaaaaaaaaaaaaaagagggagagaggcatcttaatatttgtccttaacacatcataccagacttctgcttccaggaatgactggatgtggtttttctaggtggacataatacaaaatgcagctacctgaaaacaatggaaagtggacagagcaggcagattctggtgggaagtccacgcaataaagaaaagatgttacaggaagtgagcgcccatttttgctgtttttagcttggaggcaggtgcagccattgtgcaaaccaggtgtggtgctggtggaaaaacagccatctttttggactatgaaaatggaaggttgagttcagggcaactataactgccaaaagagagaagaaagagttctggaagagaaagagccaaagagggaattcccaaattctttctgctcctgtctgtggctgatcccaaaccacggacacacacagcaaaaacaaaagcatctcagccagagacaaaagagtctaaaagagactggacctgccacctgagaaacagagtttgaagttagagttcaatcacaaaaaaatgcctgctaaaacaaaataaacaaaacctattagagaaaaggtgttctcttatcagaatgtagggcctccacaacttaacgtttataatgtgtacaatccaaacttattcgacatatgaagaactggaaaagtgggacccattctcaagggaaaagatagcggagattcactccaagatgacccagatgttggaattatccaccaaggattttaaagctactattataactgttctcatgctataaaatccactatttagatcatacttaattgtgaagaaatgaattctttcctcctaagattagaaacaaggacggcatgaatacccactttcactactaacactgaattttgtacgaaggtcccagtcagttcaatatttttaaaaagattttaaaaaaagcaataaaaggcatacatattggaaagggaaaagtaaactgtctaaatttgcagatgacaaggtcatataatggtttaaaaaaagctactagaacaatatgtgagtttaccaaggttaaaggatacaaggtcaatatgccaaagtcaagtgaatttctatatatttgcaatgaacaattcaaaatggagttttaaaacatttttatttatgatagtctccaaaatactttttaagaaagaaaatgacagaagcaacccaagtgtctactgatggataattaaattatagtatataaatacaatggggccgggtgcagtggttcatgcctgtaaacccagcactttgggaggctgaggtgggaggatcactcgagcccaggagttcaagaccagcctgggcaacatggtgaaaccccatctctagaaaaagtacaacaattagctgagcatggtggtgcacacctatggtcctagctactaggaggctgaggtgggagatcaccggagcacaggaggttgaggctgcagtgagctgtgattgtgccactgcactccagcctgggtgacagagcaagaccctgtctcaaacacatatatacatacatatgtggaatacaatggaatatttacttaaaaaagaaagaaaattccgacaacatggatggaccttgaagatattatgttgagtgaactagtcacaaaaggacaaatactgcataattgtacttttatgaggcacttagagtaatcaaactcagagacagaaagtagaatgctggttgccaggggctggtagaatggaaagttattgtttaatgtttataaagttttagttttgcaagataaaaagatttctgtggatggatggtggtgatggttgcacaatgtgaatgtacttaatgccacttaaaaatggtcaagatggtaaattttatgttatgtgtattgtaccacaattttctttacaaggtctcaagttggacattaaaatgccaggcaattaaaagtatttatgtttaaaacttaatttaaaaaataattgacaagtatattctaaaatttgttcgagaaggcaaaggacctagaatagcaagaatactcttaagaaaggaaaacaagtttggaaggacttaaactacctgaattcaagacttatcattaagatacagtaatcacaacagtgtgttactggcataaagatagaccatatgagatcaatggaacaaaataaaagctttaaaatgcaccaatacttatatggtcaattgattttcaacaatggtgccaaagtaatttaatggggaaaagatagtcttttcaaaaaatggtgttagaacaactggatatatatatatatccattatatatatacactcatttatatatacatcatatacatgtatgtatcatatatatgtatatagcctcaactcttatttcatatcatatacaaatatttgaattgattgtagacctaaatgaaggagctaaagctattaaacttttagaagacagcataaaagaatttccttccttctgccttgccttgccctgccctgccctgccttgccctgccttgccctgccctgccctgccctgccctgccctgccctgccttgccttgttttgtaacagagtctcactctgttgcccaggctggagtgcagtggcgtgatctcagctcactgcagactcaatcacctgggcttaagccatcctcttgcctcagcgtcctgagtagtttggactacaggcatgcgccaccacacttggctaattttagttttgtttttttgtttttgtttttttgtagagacaaggtttcattatgttacccaggctggtctcaaacttctggactcaagcaatcctccctcctcggcctgtaattatttcttaaacagggcacaaaaagcacaaatcacataagaaaaaaagataaaacagacttcatcaagatttaaagcttttcctcctcagataacgagttgagaaaacaaagacaagccacagattgggagaaaacattggcaaaacagctattaaaaaagccttctatccagattatataaagaacccttaaaactcagtaataaaaagacatacatagtaagtaatgggcaaatgatttgaacaatcactttataaaagaagataaatgaatagccaacaaacacataaaaagatgctgaacatcacaagtcattcaaggaagtgcaaattaaaataataataaaatactattaaatgtccactagagtggccaaatttaaaaaaaatgaaaatcaccaggtattgtggctcacacctgtaatcccagcactttgggaggctgagatgggccaatcacttgagcccaggagttcaagactggcctgggcaacatggcaaaaccctgtctttacacaaaatacaaaaattagcctggagcatatctatagttccagctactcagggggctgaggtgggaggatcgcttgaaccctgggaggccagtctgcagtgagtttagatcatgccactgtactccagcctgggtgacagagcaagacactgtctcaaaaaaaaacaaaaaacaaaaaaaaaccccaaaaaataaaaatgtgaggaactctcacacatttacacattgctgaaggcaatgcaaagtggtacagtcaggccggaaaacagagtgacaaggtcctataaaggagtggtcccaacctttttggcaccagggaccagtttcatggaagacaatttttccatggacagtgggggaagggaatggttttaggatgattcaagctcattaaatttattgtgtactttatttctattattattacattgtaatatataatgaaataattatacatctcaccataatgtagaatcagtgggagcactgagcttgttctcctgcaactagatgatcccatctgggggtgatgtgaaacaatgacagatgatcaggcattagattctcataaggaacacacaacctggatccctcgcatgtgtagttcacaatagggttcatgctcctatgagaatctaatgcctttgctgatctgacagaaggcagagctcaggcagtaatgcgactgatggcaggtggctgtaaagagagatgaagcttcattccctttcctgccgcacacctgctgtgcagccccattcccaacaggccaccgacaggtactggtccaataaagtggaagatatccttaccagtaacccaacaatcccttctcctagagaaatggaaacacatgttctcacaaagacaagtatgcaaatgcacatagcagcattattcattgtagccaaaatttgaaaacaacccaaatgtccatcagctggtgaatagatccattgtggtacatctatactgtgggatactactcagcagtaaaagggaatgaactattgatacacaaaacattatagatgaatttcaaacacattatgctaagtgaaaggaatcaaatacaaaagactacattctgtatgactaaatttatatgaaattttagaaaaggcaatattacagggaagggaagcagatcagcatatacctgaggctactaagccaggtgaagggcaggttgcaaaggggtatgagaggcttttagcaagtgatggatgtgttctgtatctttattgtggtgacatttacatgactgtatacaattacccaaagtcattaaattatacaattaaaatatatgaattgtactgtattgtaaattatacttcaatacagctgaagaaaaagtcaacaacaaccacaaaatcacagccaaagggctcttctctatggctgaaagatattgggtccacatattccagagtcccttgtactcatatcatggtctactatataaataaatcataatttatttttaaagttaatcattgctgaacatttgtaatgtttataatttctttcttttttgagtggaccaatggaggggtgtaacgttcttctatgagtccctggagcacttttgcaagtaattctacatataaaatgtgttgggttatagattataaatgtactcatgtttcttttttcatatgattttattcttttttagaatttcatttgaatagaatcctaccttatgtagtctttcttattaatacataatagtatatatttgggggttatatctggtatactgatactttcatgtaatggtaaaatcagggtaattgggatatccatcaccttgaacatttttctttatgctgggaacatttgaattattctcttttagttacatatttatcttttatgctgggaacatctgaattattatcttctagttattgtcaaatatgcaacagatatattattaactatagtcaccctactgatcgattgaacaggtcttatttcttctacctaactgtattttggtacccattaatcaacctctctttatatccccctcccctccacacttcctggcctctaggaaccaccaatctactctccatcttcatgagatccactttattagctcccacatatgagtgataacatgtggtatttgtctttctgtgccaaacttgtttcacttaacacaatgaccatgttgctgcaaatgacaggatttcattcttttttatggctgaataatattccattgtgtatatataacacgttttctttgtccaatcatccattgatggatacttaggttggttccatactttggctattgtgagtagttctgcaataaacatgggattgcagttatcttttcaatatattgatttactttcttttggatatatacccagtagtaggattgctggatcaaatggtagtcctatttttagttttttgaggaacgtccacactgctttccatagtggctgtactaacttacgtccccatcaacagtgtacaagtgttccctttttccccacacccttgccaacatccaatattccctattttttaaataatagccatcttaactagggtgaaatctcactgtggttttgatttccatttctcggatgattggtgatgttgagcattttttcatatacctgtaaaccatttgtatgtcttcagaaatgtctattcagatcttttgtccatttttattgggttatttttttttgctattgaattgtttgaattccttatgtattctagctattgatcccttgtcagatggatagtttgcaaatattttcacttattctgtgggttgtatctttattgattgtttcctttgctgtgcagaagctttttagtttgacataattgtatttgtctaatttttgcttttggtgcctgtgcttttgaggtcttactcaaaaaatctttgcacaggccaatgtcctacagcacttctccagtgttttcttctagcagtttcacagtttcaggacttacactaagtatgtatgtatgtatgtatgtatgtttttatgtatgtatgtatgtatttatttatttatttattttgagatggagtctcactctgtcgcccaggctggagtacagtggcacaatctcgtctcactgcaacctctgtctcctgggttcaagcgattctcctgcctcagcctactgagtaactggtgcacaaccccacagccactaactgtttgtattttaggagagatggggtttcaccatgttggccaggccgggctcgaactcctgacctcaagtaatccacccgcctcagcctcccaaagtgctgggattataggtgtgagccactgcgcctggccacatttaagtctaatccatttttggtttttttcatatggtgagagataggggtctagttttattcttctgcatatggttatccagttttcccagcactatttattgaagagattgtcctttccccattgtatattcttgtcaccttgtcaaaaatgtgttggctgtaaatgcgtgaattgattctaggttctccattcagttccattggtctatgtgtctgtttgtatatgagtatcatgctatgttggttactgtggctttgtagtatattgtgaagccagagtgatgtgatgcctccagttttgttttgctctggattgctttggttatttgggtcttttgtggttccatatacattttaacattgttcttttctatttctgtgaagaacgtaattagaaaattcattgtgaaagggattgcattgaatctgtaagtagctttgggtagtattgacattttaacaatattatttctttcaatccatgagcatggaatattttttcaatttttgtgtgttctcttcaatttctttcatcagtgttttattattttccttatggagatccttcacttctttggtttaatttatttatagatcttgtatatttttggtagctattgtaaatgggattgctttcttgatttccttttcagattgttcactgccagcatatataaatactactaatttttgtgtgctaattttgtatcctgcaactttactaaattcatttatcaattttacccatttttggtggagtcgtcaggtttttcaaattataagattatgtcatttgcaaacaaagataatttgatatttttctttccaatttttctctttctttctcttgactaattgctctggctaggacttccagtgttatgttgaataaaagtggcgaaagtgggcatccttgtcttgttccagatcttagaggaaagactttcgattttttcccatttggtataatgctatctgtgggtttgtcatatacagcctttattgttttgaggtatgttccttctgcacccagtttgtggaaagttttttgtcataaaaggatattgaattttatcaaatgctttttcagcatctattgaaacgatcatacggattttgaccttggttttgatgtgatgtattatattattgatttgtgtatgttgaaccagccttgcatcgctgggatgaaacccactggatgatggtaaattatctttttaatgagctgttgaattcagtttgctagtattctgttaaggatttttgcatctgtgttcatcagggatattggcctgtatctttctttttgttgtgtccttgtctggttttggttatcagagtaatgctggccttgtagaattagtttggtcctcactcttcaatttttttgaatagttggaacagaattggtattacttcttcttcatatatttgctggaattcaacagtgaagccatcagattctgggcttttctttggtggaaaactttttatcatggctttgatctcattactcattattggtttgttcaggtcttccatttctttgtggtttaatcttggaagattgcatgtgtccagaaatttattcttctgttttccaatttgttggtgtatagttgttcataatagtctctgattctttgcatttctgtgctgcctgtacttatgtcttcattttcatttctaatttgatttgggccttctatatttttttcttagtgtagctaaaagtttgtcaatttatttatcttttcaaatagccaattttaaatttcattgattttttgtattttttttagtctcaatttcatttgtttctgttctggtctttattatctctttcctgctaataattttgggtttggtttgttcttgcttttctagttccttgaggtacatcgttaggctgtttatttggaatctattttttgatgtatgcatttattattataaacttcctcttagtcttgcttttgctgtatcccatagattttggtatgttgtatttccatttttgtttcaataaatttttaaaccactttcttaattttgtcattgacccattgattgttcatgagtatgttgtttaatttccatgtgtttgtatggtttccagtttcctcttgtttttggtttctagtttcattccattacgatcagaaaatatatttaatataatttcaacttttttgaatttgttgagacttgttttgtggcctaagatatgatctattctggacaatgctctgaagagaagaatgtatattctgcagcaattgggtgaaatgttctgtaaatgtcagttaggcctatttggtctagtgtgtagtttaactccaatgtttctttcttcaatgatttgtccgttactgagagtcggaagttgaagtctcccacaattattattttgcagtctctttctttaaatctattagtgtttgcttcatacacttgggtgctccagtattgggtgcatagatatttataactgtaatattgtcttgctgagctgacccctttatcgttatgtaataccttggctctttttacagtctttaacttgtagtctattttatctaagtatagctaatcttgcaattttttggtctctatttgcatggaatatctttttccatcccctatttcagtctatgtgtgtctttgtaggtgaagtaggttttttataggcagcacatagttggatattgtttatttattcagcctctgtatgtcttttacttggagaatttaatccatttacatttaatgttattattgatagggaaggacttactactgccattttgttacttgttttctagttgttttgtaactcctctcttcctttcttactgttgtcctgtgtggttattttctattgtagtatgttttaatttgttgttttttatttttagtcaatctattgtaggtttttgctctgtggttaccatgaggtttaggaaaaaaccactgtattgttactaaaagttattattttaaaaaggtgacaacttatctttgatcataaaacatatagaaacaaaggaaaaactgaaaaaaaatctacattttaacttcatcactactcccaccctgccccattttaacatttggattttctacatatagaagtttatcatattagcataatgacagattgaatttcaatcttcatttatttatttttcttgccttactacactgtctagaaccttggtatgttgagtagatgtcttaatgtaggcattcttgtctcattcgcaacatcaaaagaaatgtttttattgtaagctgattttttttttagtagatactcttatcagttcagaaaggtttcttctagtcctaatttgctaagtttttaaaaatcatgaatggacataaacaacatttgtttctcacaattctaaaggctgagaggttcaggatcaaggtgctgacagattctgtatcttgtgagcaccattttctgagtttgaaaatggcctccttctcgccatctcctcatatggtgaacagaaagggaggactctagccttttcttcttataagggcactaatcctatcatggagtccctaaccccatgactcatctaaccttaattacctcccagagactccacctccaaatatcatcacattgggaattagagattcaacatatgaatttgggaaaggaaggacacaaatattaattccacagcagacattggattttatcaggtgtatgtgtcttcatctactcagatgatctatgatttttctctcatcttttaatatgaattacatgggttgattttctaagttaaattaaccttgcattcttaaaatgaaccccattttgccttcattatgctttatatacatcgttactcttaaattgctaatattttgtcagtttctattatgcatgagattagcctatattcttcctttttcatattgtcttcttgttggtattttagccttatcaaataaatgggaaagcatacttagaaacacactttgtgtaccttctcagattcccttaactgcctccctctttccttcccttggtgggcaccccacacatgccaggtttccccttcacttttgaactttaataaaacaccacatcatagtacatggatctcaattcctgaacagctgctaagtcggcatgatgcaacacagatgaaatggcagtaatatccttgttgggtgaatgttactcaatgagaactgggagatgggagcttacctgacaggaagattacccccttttctctcttccactgactactccaagatattgttcctccttgcaacctttccaaaaacatccacattccaagaatctcacatactgagtaacctaacatgtcccttttgacttactatgaagtggtagtcaatatagtaatgcatcatatcacatttcattggatttcccttgctttatttctacttttctctcattcatactgtgctgaatttgcatttcccaaataaaatattagcatctttttcgagatggagtctcactctgtcattcaggctggagtgcagtggcatgataccagctcattgcaacctctgcctcccggcttcaagtgattctcctgcctcagcctcccaagtagctgggattacaggcaggtgcccaccatgcccagctaatttttgtatatttagtagagatggggtttcaccatgttggccaggctggtctcaaactcctgacctcaagtgatctgtccacctcggcctcccaacgtgctgggattacaggcatgagcgactgcgcctggtcaaatattagcatcttaatccttgcctcaggctccactttctagaagacctaaactaagaccaaaattgcctcctttgttctatgcactggagtattttatgtaagattccataattttgttcctttaaagtttgatagagcttataaaccatctaggcctgggtttttctgtgtggaaatactgggaagtactgttatctttaatgattttaagactattcagtttttctacatcttcatgagacaattttcctaagttatagtatttaaagaattcaccctgttatctatacttacaaatttattggcataaagtttatatagtatacttttattacctttttaaatacttgtattaatctttatatgacctgtaggaatgctcatattttcattcttatcgttttggttctttcagtcttgccagggttttatatattttatgagtatttttgaagaaccagttgctgactttgttcatctctattgtgttttctatttccaaggttgctcttacctttagtagttcctttttttttttttttggtttccattttgttattgtttaactttgtgtattgaatgactcatttttagtctctcttttctaatatgcacatttctaagcaggtctgcctatatgctctctaaatactgctctagctgcattccacatattttaataggatttgacagttttaatttccatgactttttcccatgactaattagaaatgtttattaattctcaaatacatggagctttcctaaagatgccttttatactgatttctatctgaaatccattgtggtcagagaatactgtgtgttttgtagcaatcctttgaaatacattgagacttgcttaatttgcaagtacaggttttcatatttttccatatgtgattggaaaaatattaatttgacaatttggggatatagtatacacacaatacacacaaacatatatgtattttcagtacttcaaaatttctacatatttcctggtatttgtctgcttgcttcattaattactgagagatgtacgattttgagttgtactttcttttgttgctctctcatttttctttcatatccttatggcaattgtattaagtgcataccaatttaaaattatttcaccttcatgaatgtcaccttttattacacaaagtgatattttctattaattcgcctaaataaactttgcacttgagtcctttttcagggtctgcttcttgggggaacctaaactacgacagttcgtctcccctggtatgttgtagcaccacgatagctaagactcccacctgtggtaaattggtattgggcccatcaggaaggggatacactcacttacgtaatctctagaatgatagagagatgggggtggtgttaattataaggatggtggaataggttggttgtt

SEQ ID NO: 175 - DNA, 14161 bp, Homo sapiens; identical to SEQ ID NO: 174

SEQ ID NO: 176 - DNA, 8665 bp, Homo sapiens
ggcccgcccctcgcagccttgccgcgccccgtgcgccctgtccgcccctcgctcgcattgcaggcatcctgagtctcggcccttttcgccaaatcgctgctctgccgcgcgcctacgcaaggaaagattcaagggtccctccacttcagggagtggagcccgcgcctcggcacggatcagctgtgcgtctcctttggcctactggctcctctgcttgtgtctatagctagctggacgcatcgtgactttatcttctcatctttcctggcgcccccagacgcatttcctggtccctcgaggcagcggcgtctggggagtgcactttgcacagacagggaaaccgaggcactcagcggtctccaatggagacgctgtaatcgcattccacgaccagctagcgctataagcgctgcctctaaagcggaaggcctcccagtccttctcgacaggaagcaatatttgcatatctaaggagaacaagattcggcaatgtgctccgggagcaagtgcaggcatggaacggtatgggctggagggggacagaccttcagaggcggctgcccgttccctgtagtgtcacataagatttttagaagataggagttttcacagtggcggcagagccctctgctaaatcctcatattagatgtcaaaggtggcatgtcatttgacccaatggcttttttagtcatttatcttcctaacacctatgagagggctacagttaccaaaatggcatggtactggtacataaacagacacacagaccaatggaacagaatagagaacccagaaataagactgcacacctacaactgtctgatctgtgacaaacctgatgaaaacaagcaatgggaaaaggttccctattcaacaaatggtgctgggataactggatactcatatacaaaagactgaaactggactttttccttaaccatatacaaaaattaactcaaagtggattaaggacttaaatgtaaaacccaaaactgtaaaagcctggaagacaacctaggcaataccattcaggacatagacacagacaaagatttcgtgacaaaaatgccaaaagcaattgcaacaaaagcaaaaattgacaaatggaacctaattaaactacagagcttctgcacagcaaaagaaattatcaacagagtaaacagataacctacagaatgggagaaattttttgcaaacagtgcatcgacaaagatctaatatctagcatctataaagaacttaaacaaagttgcaagaaaaaaaaatcaccccattaaaaactgggcaaaggacaggacatgaacagacacttttcaaaagaagacatacatttggccaacaattatatgaaaaaagctcaacgtcactgatcattagagaaactcaaatcaaaccacaatgagatactgtctcataccagtcagaatggctaatatgaaaacgtccaaaaatgacagatgctggtgaggttgtggagaaagggaacactttacacggttggtgagagtgtaaattagttcagccattgtggaagacagtgtggtgattcttcaaagacctaaagacagaaataccattccattcagcaatcccattactgggtaatatacccaaaggaatataaatcattctgtcataaagatgcatgtgtgtatgtttactgcagcactattcacaatagcaaagacatggaattaacctaacatcaatggtagactggatgaagaaaatgtggtacatatacattgtggagtactatgcagccataaaaaagaacaagatcatttactttgcaggggcttcaatggagctggaggccatatccttagcagctaatgcagcaacagaaaaccaaatattgcatgttctcacttataagtgagagtcaaatgatgagaacacatatagggaaacaacacacactgaggcctatttgagggtagagggtggaaggagggagaggatcaggaaaaataactaatgggtactgggcttaaatacctgggtgatgaaataatctgtacaacaaacccccatgacacgagtttacctatgtaacaaacctgcacatgtacccttgaacttaaaataaaaatttaaaaaaagaaaataggttgcttgactctgcacctttccttctctgcttctcacttcccaactgttctaatttcatatgggaatccatgcagttatggagaatccaccttcagcaatgggaatgaacctagcaccacatgacctgggctggatcaatcatcacatactatcccctgacccagtgattggttcagggatggacatgtgacctaagagagtgtggttagagtaaacctcaggacttctgctgataacattggcaaaaagattttttttttaaatgaatgagggcatgtagcctcacagaacagctggaagccattttgcaaccacagagatctgccaaagtctccctaagatgaagaaacactgagatagcagagccaggaaatggtgaagggaatgttggtccctggtcaagttgtttgagctagccctgaagtttttcaaatctctgtgggcttttcaattgcatgagctagtaatttccctttattacttaagccaatgtgaaccagcttttctgttacttagaaccaaaaacattctgctacatcattgatacacgtcaaacacccccttccttttacagaagaaaagactaaatctcatggatgctacgtggctagttaggaggaattgccttcccagttccaggcctttctccttttactactctagccacttgtgatgggtttggtaacaatgagtaaaatgtgcattctccttatttctaaccacggattggatatgttcagaaatattaaaactgattttcctcaagtgtatcttctggcaattaatgtcattgctttatagccactctgtactacgggcccttgtgattcattagaaaaaacaaaggatcaaatagttagagaaggtataaggaccttgtttaaaattttatttaatttgcagctaatttaccagcaacttaggctcaaccacgtatgctgctttgctagtttcttcaaaacttgtcatgcactttcatttcttggtaatcatccctcattaccatttcttatctttcaaaaacacagcctcaccacactgtattcttacctttggtgcctccctctacagctagaatttccagattctgtgggctcttcctctgtaaactctaaaaatccttccatttttatctatacatactatttcccccactctaacagatcttacctatcaccaaccctaaaattacctaacaaaatgctcatcacatcttcaaggaaatgtcccacagtgagagaaaagagaaaggaacctgtgtttattgtgctaggaagatactagatactttacagacattaactcatttaattttcatgaccacaccatggtaagtaggtagtagtatctcagtctaaaaataaggaaactgaggttgggtgagtcatagggttgaattccaaacctaggtgtgtgcagttctaaagatactttcttccactgcttctgttggacaatagattttgccccttttgtaccagctccaaaggatagtgaccgcctggatctcgtgttgagaagactgaagcctcatccaggttgacagggaaagacaaaaggatgtcttgccaaagcttgccaagggggaaagtggcaatccacacaccacttatttcacatttcttcaggcctgtgcctggggcagttctagaggtttcccaggagaaggacaggtgcaccagggagtctggctataaagtttgtacactagaatctgttggcagattctgttgcttaaagttgagtttgcattcatactttatatctgaagaaatgggaagttagggagttaaccactgtctattgggaagtgattcatgaatcagaacaggtgagaatgtcaggctctgaaatgaacagcacacttctgtatggaatgtactggggcagcatacctgccttctttctcagatcaatgttgacacacttaaatttgtgaataaggccttccaggatatcttgtttaggaagaaccagttcacttgctagtatctaggctttctaggtatcacgagggctttctgtcaaagcataaacaagcagtgagaaatcatcagtgttctctctctgaagagagagacaccaggaaaggagagagggtagcaagttagcaggcatggaaagctgctgctttgcagatgtgttcatcaggcataatccttagctggatgttagacagtaccagaagttgcatggtgacttgtctgatggttgcaaagatattggtcctcatgtgggattattcaagatattcagaagggaagaagctgaatctggttacaaaaggtgttccttaaatacgtaatgaatgaatgaataaacagttcaatggaaattggggcaaattaaggattcagtagatgtgaggtgtatttgtctcatgtcctcatctgatgaacatctaccatattcagttgtctagtgaggactcttttagtgtagaaaccaaggaggcacatttggggttcatttagagatggggtatttggggctggggggaagccagcatatgaatgatgggcttcaccaggagacaaagggcatctgtctaagggatggatgctgagggtggacctggcaggctgagcaggtgaaactcttccattggagcagactgtgggtttatttgagcttaagaaaaggaggtcattcccaagaatgaatagcagtggatttgtagactttgaaattaacagatcaaagacaccagatctctgtagagaacttaatatgatctctagattctgaagctccaattctcagccctggctgcaccctagaatcacctgggagcttttcaaccctaccactgccagggtttctcccccagagctttggattcaggcagttcagagtgaggccctggaatcagtattttcaaaaagacctccaagtggctctgagaatatcactgcagttgagactgtccactctagacataactcaaagcaggcaaattttcaggattccatggctagactatgacatttccaacaacctcaagagagacattttaggattattcattcatactgtgtgcatccttggtttctcactagcccctgttcttaaggcctggcagattcccaggtgacttctatccatgagagtgtcccaagaagggccactgggaaacacacttatagagagtttggattatgatcccaaaagacacattcctgaatgccatcatccccgaggttgaaatcctgaaagatcaaaatttctaaagactaaatccttaacatctaaaatcctgaaaatcacaatcataggatagttgcatcatgttaggtgaaactgttaccttgttgtggtctttatttggaaattaagtatggtttaaggagatgcatatagtgccaagttgacagggatggatttattgacttaatttgagatgtcaacttgactgattaaggaatgcctgaaaccctggtaaagcattattttgggtgtgtgtgagggtgtttccagaggactgagtagactcggtgaggaagatctgcccttgatattggtggacaccattcaattggccaacaatctggagataacaaatatagaaggccaactggtctctctctgagagctgggacagacttttcttctgctgccttggacatcagaactccaggctcaccagcctttgcactccagtacttaacagcagcggccatctgggtcctgaggcttttggcctcagagagtaacaccattgtctgctgtggttctcaatataaaaacattgaaacttcctcaataaatgaacagatttcctttttgtgtatctgcatttgtgaaagaccaaaatttcttgagatcttgcctttttgggccactgcatatgcagtggtgacctatagaggtttttgattgatcttgtcaaaagacaggttgtccatcacagtatttcggatgactggagttataaagctaggtacacacaactaccaaccatcatgatacatgtttatacactttgtttttggcatattgccttatgaatacagttcatctgcttgtaattgttgtaatcatgtgactgttgttagaatagctgagtgcttatgtttgcaaagatatatatgttattattgccaattttattgtgtaaattggcctctgaagtgctctgtcagtttttatatggttctcaaataaatctcccttaaaaatgtaaataaatgttttaaagataatttcttcttattttttccagaattatatttttgggattttgatctttcaggatttcaatatttgggatgggtctttcaggattatgatcaaccccctatgtggaaccatactggggaaactatgaacaagaataaaatctcagaagcctgggattttgacattggaggcaaaggaaaatcacatcagagagccctgctcagtgcaaagagcgctaggccgggtgctggaagtgctgactttcactcatgactgcagctgccccactgtgatcctggggaagtgaccactgtgatcactgtgggtctgagtactgtcatctgttcacttccatgtccttccacttctgtgactctgtgaggctaactctgtttctatttttttttttttttttgagacgaagtctcattctgtcgcctaggctggagtgcagcggtgcaatctcggctcactgcaaccgccgcttcccgggttcaagcgattctcctgcctcagcctcctgagtagctggaactacaggtacacaccaccacacccggctaatttttatatttttagtagagacagggtttcacgatgttggccaggctagtcttgaactcctgacctcaagtgatccacacccgcccccccccggtttggccccccacagtgctgggattacaggcgtgagccaccacaccccgtcgcctaactctatttctaaaagctctgccagttggagatttctctagcccactagagtttctggctttgggggacagggagggaagggaggggaagctgtgttataagaagaaagtttaaaaagtaagcataaattatttgagcttttaagagacattaacaagctaccatactgagggtattaagaacactaaaatttgtttggctttggatagggaagctactgaaattgaagaagaaaagatgggactgaatgagcactccttgggttggagaaaaaccaacatgatcattatctaatcatcatcataataatgataatggacatttgtatagcacttggcagtttacaagttactttcttataataataattaccactatatggtacattacagtaacaaatactttttagggctttaccccgttccactgtaaaagttggtattagtggaggatgtaaatagacttatctacatgattaaggaactaggaggagtggaggttcaacaccagcagttggacagcaaacatcttagaagaccaggcacatcttcagccacacccttgggttcaacttggtggtctcctggttggggtcaggagcagaagtggggccatggcctccacttcccttcctgggcaatgtgcctttctttcatcaccatggagtccttgcctttgttttgtttctccttgtcatttatttccattaacatgcagtggtttttgtcctttctcttcccgattgtcactttcctcacctagatagagaagaaccagccctcacctagctcactagtctgtatcaggctcaaatgaggtgatgtatgtaaaaaggttttgagacgttaaaaagcacagtccagaaatacctgaaagcatgtaaactcttacgatttgggggcttagcaggaccaggaatttgatctcattgcctccaggtcatatcatgaccctctaggatccctcctccctgtcacacatccctctatgggcacattgattccaggatttccagagtacatcagggctgagccgacctcatggccctcgtggattgtctctgatatggtttggctctgcgtccctacccaaatgttatcttgaattataatccccacatgttagggagggacctggtgggaggtgactcaatcgtggtgcggtttgccccatgctgttctcgtgatgatgagtgagttctcacgagatctgacggcttaaaagtgtggcacttcctacctcactctctctctctctcctgctgcattgtgaagaaactgcttgcttccctctcaccctctgcagtttcctgaggcctccccagccatgcggaacgcctgcttccatatcgtaaactgccttggaaccaattaccactaccagggagacaaactattgcttagaggatgctgacaggagcagcatgccaaaattggaagaaaatcaagcccaagttttccctatggatgatgcaaattcaactgctgactgaccactaggaacccaatccaacaacctggtcagttccctcggcgcaggcccagcgcctcccaggcccaccttcctcacttctgtcaagcctcatggcagcatctgcccacagaggaaagagacaaaaccattaccaataaaattgtgaagttttccaaaaca

SEQ ID NO: 177 - DNA, 1080 bp, Homo sapiens
gtttgatctcagactgctgtgctagcaatcagcgagactccgtgggcgtaggaccctccgagccaggtgcgggatataatctcgtggtgcgacgctttttaagcccttcagaaaagcgcagtgttcgggtgggagtgacccgattttccaggtgccgcccgtcacccctttctttgactcagaaagggaactccctgaccccttgcgcttcccaagtgaggcaatgcctcgccctgcttcggctcgcgcacggtgcgcgcacccgctgacctgcacccactgtctggcactccttagtgagatgaacccggtacctcagatggaaatgcagaaatcacccgtcttctgcgtcgctcacgctgggagctgtagaccggagctgttcctattcggccatcttggctcctcctgtaacaatttcttgagttctaggaagtcagcatgaatcggctttatgttccctgcctccagaccctattctcctgcctcacagggagtgacctcacagaaaggcattttttttttttaattggaagtttctttcaaactctgcctgcttttagatggctcctcttagaactatgcatctctcctgatacttggatgcttttcctctgactgatgaagatcctgaataccaaagagggccgctgacaggtctaggagtacacttctagcacctagcagagagaggcttcactacatcatgcttcctgacatctctccctttgaagagcagtcagactcctgctttgctcttcagacttaatttgggggtttaacaggtgaggttgctgggggaactcttttacaacatctctctgaaagaatccgggctgccagtttcatttggtttgggtgtcagtagcatgatggaaagacaaaaaaacacaacttgacatctgcagaaatgggttcaaattttacctgcaactcaccaattctgtggccttggttcagcaattaaactccctaaaattcagttttttctttgtaaaatggggttatgaacagtacctacttcaaaatgtgtttgtgaagattaaaaaagttaacataaagagtttagaagagtgtctg

SEQ ID NO: 178 - DNA, 1080 bp, Homo sapiens; identical to SEQ ID NO: 177

SEQ ID NO: 179 - DNA, 471 bp, Homo sapiens
tttaaaaataacattgtgtgggttgtttttttttgtttttgattgttttttgtttttcaaacaggtctcactcctatccatgtaggctagagtgcagtagtgcaatcttggctcactgcagcctcgacttcctgagctcaggtgatcttcccacctcagtctcctgagtagctgggactccaggtgtgtgccaccatgcctggctaaatttttgtatttttattagatacagggtctcaccatgttgcccagactggtcttgaactcctgggcctgcccacctcagcctcccaaagtgctagaattacaggcatgtgccaccatatccagcctaataacattgtttttaatgttcattaagtcatcccaccctctcagtcttgcagaagcctctcaagagggacagaatcagttgcaaagtaccatttctgaccctgagacatggatattatttgttcatttaaatgtcac

SEQ ID NO: 180 - DNA, 4079 bp, Homo sapiens
gaggttgcagtgagccaagatcacgccactgcgtgatcacgccactccagcctggtgacagagggagactgtgtctcaaaaaaaaaaaaaaaagaaaagaaaagaaaagaaaatggcagagctcaggttgaagtgattctaaagcctttgatgctaactgctctagcgtcttagaggactgagtaaaaccattccctgtcatccaggtaccattgttagtcaagctcctgtggaaacacattcaaatggggcaatcgaggaacacttaatgaacagtctgtttttttgtttgtttggttggttggttgttttttgagagagagtctcactatgttgcccaggctggagtgtagtggtacaacctccgcctcccaggttcaagtgattctcctgcctcagcctctcaagtggctgtgactacaggtatacaccaccatgcccagctaatttttatattttcagtagagacaaggtttcaccatggaggccaggctgtaatgaagggtctattttaaaaggtgtgggcagggttaagggaaatgagtgaggggtagtgaagtcccctggctctagacactgcagggagtctgttaccatccctgtggctgagagaggagggaagaggagtgagtggttctagaacccagacagagaggaactggagagagtggagaagcctacggtacagaaaggctgaacttctgaaaggaacattgttaacttgagctgacttagcagggaaggagccaaggaacacagagcctgacctcattcttctttctccctccaggctctgtcactatttcccattggccaaacgctactggaagtggaaggctaagaagcccgatggtgcaatccatacacgtcagcctctggggccagagtgggatgaaaaaaggctcatgatggagcccgagttatatggcaggagatgatttccacggtctgtgaacactgaagatgagactggcttggggccacgtgccaaactgcacagccagtaagacctgcttccatcgacccacagcagctctgactttttttttttaacaatagagaagaaactaccacagggaagagagagaacaatggcattttgacaaatggaacaaagatagagtgtgactgacaattcaggtcagaaggaaaattaaagcacaggaagactgatgttggtcggcctccttgccaagaagcaaaaactcagggggaggcatccagccacatgcgaactggctcaacactggccattttgtttgagcaattttgttggatgttttctacaaaagagcactttttctcggacttcaaacattcttatatgcaggatcgacaccacacactgccatcatcccctggagtagtatccttgagacctgaggaggggaaaactggagggacgttgtgggactccattgagaaatgtggtcctttgtctccctggagatctttgaggacggttcagataaagttgctgccagtggaagcagctaggctcagaaacctccagttgccctttctagacttgtaatcctctgaaaaatggaaattaggaagcgttcatttatgaccttgaaaaaaatcgtttacaaaagtatattatatcactaaaatgagctggaaaaagggtttatgtgaaagttcatgtgagaaacacagctattagcacgcatgccattccccaccttgacctcagcaggaatgtgtaaattgtaacatatggaatgtaagccctgtcgagatgtttcataaatctgcctggcaatgagcatcacaaggccctgcatgagaacaggccccagaaatggagagacaaataaagaaacatcagaaatattaaaatgaggaccaaaaggagtcccaggtataggagcatgaaacatctggcaacatgtagcaaaaacaggagacttttttcttctaacggaattttggcctcttggtgccagtatgtgaaaaaggccttgtaggccaggtgcagaggctcacgcctgtaatcccagcactttgggaggccgaggctggcagattacgaggtcaggagttcaagaccagcctggtcaacatggtgaagccccgtctctactaaaaatacaaaaattagttgggcgtggtggcgcatgcctgtaatgccagctacttggaaggctgaggcaggagagacgcttgaaccctggaggcggaggttgcagagagccaagatcgcaccactgcactccaacctgggtgacagggtgagactccatctcaaaaaagaaaaaagataaaggccttgtaattggccagaatgaggggaagttagacaagagaggaagaaatataaatataattaaactgtcggaattgatttttttttttttttttgagatggagtcttgctctgtcacccaggctggagtgcagtggcgtgatcttggctcactgcaagctccgcctcccaggttcacaccatactcccgcctcagcctcctgaatagctgggactacatgggcccgccactacacccggctaatttttttgtttttgtatttttagtagagatggggtttcaccgtgttagccaggatagtctcaatctcctgacctcatgatccgcctgccttggcctcccaaagtgctgggattacaggtgtgagccaccatgcccagccaaattttcaaataaataaataaatgtgtagcaaaagcaaatgggctggtttgttttggtttgtgtggtttttttaatgcctgtaatgagattgggctgggggtgcaggaagcagaccgagcgatagaggacccaggctcattatggctctgcaggaaatagcatgggtccagggactaatgtggaaaaggaaagcatctggagatggagtcaagagagatggtttctaaccaccaataagcatttgacaaggaaagccccataacctccctactcagcctaccctgtaaggattctgtgagaggcacctgtattcacggactctgtaaagctctagggaatcctcaggagaagcctatcttactggcatgtgagaatcctccaagatctcaccagccccaccagcttgagagtggcctagaaggaccttctgcctctgtcctcccaaagtgactcctattaaaggcaaaatgtgtccgagtcagcccatcttaaatggctgactagtgaaatttatttctgcatgcaacagaatacctttttttttcctcccttctgcctgggtctatgacttggttgtgctcagcagaaggaaggtaggaaaggcacattttgaaagtgtagcgagcatttgagcagactgaattcaattttggatacaaatgtcaaggaaagattctcttggctctgagctccttgctcactgaggcgcagtgtgatgctccattgaaagacctgctgatctggccagtgctgggctgatgataataaagggggagcgaggggcagaccactgagcaggaggaggaatgaccttccagaggatgtgttggaaagactctgccaggctctcctgcacacactggacagagggcaagaacctggagatctgcttcagtcccagctgtgccatgaatatgctgtgcatatagccccttccctcagcttaggcttgattttcctggcccataaaatgaaagaactggaacagataatctctaaggctttttctttccaatattttatgattctggcatttaaagcatctgcaggtgccggagaggaatgccagcaaagagtgtatgagaaaaattggcataactattgggagggtaatttgatattagctttcaaattttttattatttcgtttaatttttttgggggggacagcatcttgccctgccacccaggctagtgtgcagtggcatgatcatggttcactgcagcctctatctctgaggctcaagtgatcctcccacctcagcctcccaagtagctggcactacaagcatatgccaccaggcctggctagttttttttttttttttttttttgagacagagtctcactctgtcacccaggctggagtgcagtggctgatctcggctcactgcaagctctgcttcccaggttcacaccatt

SEQ ID NO: 181 - DNA, 3132 bp, Homo sapiens
aattacatacatctctgtgcttccacgtgttcatctctaaaatcagaataataatattgatcatctagcattattgtaaggattaaatgaattagacatgagagcattaaaaatggcacctggtacacagtaagcactcagaaattttaacaatggtgatgatgattgttattattatttcctacagcatttggcatgaggcttaaaagtccttttttcttttttctttttttttcttttttgagacggagtctcgctctgtcacccaggctggagtgcagtggcgtgatctcagctcactgcaacctctgcctcccaggttcaagcaattctcctgcctcagcctccctagaagctgggattacagccacacaccgcaagcctggctaatttttgtaatttttttagtagagacggggtttcaccatgttggccaggctggtctcaaactcctgacctcaagtgatccgcctgcctcggcctcccgaagtgttgggattacaggcatgagccaccatggctggccaaaagtccttttttgatcatttggtctacaatgtggaaaatgcactagaggggcaagttgacaggagccaactaggggaagactgaattagggtgatgatgactgaaatggaaagaggtggatagacttgagaaataccgcataagtaaaaatcaacaaggcctgctgatgaattgcatctaggggttgaggatgtacctagggtgacatagtcagaagccttttaatgatattttataatgatgtgttaatacagtataaaagaaatccttagtttgcttctctgcttccctcccctctcctatcatcttttcctattgtgatacctcttttctttctttccagaataaagaaacatcagaaatattaaaatgaggaccaaaaggagtcccaggtataggagcatgaaacatctggcaacatgtagcaaaaacaggagacttttttcttctaacggaattttggcctcttggtgccagtatgtgaaaaaggccttgtaggccaggtgcagaggctcacgcctgtaatcccagcactttgggaggccgaggctggcagattacgaggtcaggagttcaagaccagcctggtcaacatggtgaagccccgtctctactaaaaatacaaaaattagttgggcgtggtggcgcatgcctgtaatgccagctacttggaaggctgaggcaggagagacgcttgaaccctggaggcggaggttgcagagagccaagatcgcaccactgcactccaacctgggtgacagggtgagactccatctcaaaaaagaaaaaagataaaggccttgtaattggccagaatgaggggaagttagacaagagaggaagaaatataaatataattaaactgtcggaattgatttttttttttttttttgagatggagtcttgctctgtcacccaggctggagtgcagtggcgtgatcttggctcactgcaagctccgcctcccaggttcacaccatactcccgcctcagcctcctgaatagctgggactacatgggcccgccactacacccggctaatttttttgtttttgtatttttagtagagatggggtttcaccgtgttagccaggatagtctcaatctcctgacctcatgatccgcctgccttggcctcccaaagtgctgggattacaggtgtgagccaccatgcccagccaaattttcaaataaataaataaatgtgtagcaaaagcaaatgggctggtttgttttggtttgtgtggtttttttaatgcctgtaatgagattgggctgggggtgcaggaagcagaccgagcgatagaggacccaggctcattatggctctgcaggaaatagcatgggtccagggactaatgtggaaaaggaaagcatctggagatggagtcaagagagatggtttctaaccaccaataagcatttgacaaggaaagccccataacctccctactcagcctaccctgtaaggattctgtgagaggcacctgtattcacggactctgtaaagctctagggaatcctcaggagaagcctatcttactggcatgtgagaatcctccaagatctcaccagccccaccagcttgagagtggcctagaaggaccttctgcctctgtcctcccaaagtgactcctattaaaggcaaaatgtgtccgagtcagcccatcttaaatggctgactagtgaaatttatttctgcatgcaacagaatacctttttttttcctcccttctgcctgggtctatgacttggttgtgctcagcagaaggaaggtaggaaaggcacattttgaaagtgtagcgagcatttgagcagactgaattcaattttggatacaaatgtcaaggaaagattctcttggctctgagctccttgctcactgaggcgcagtgtgatgctccattgaaagacctgctgatctggccagtgctgggctgatgataataaagggggagcgaggggcagaccactgagcaggaggaggaatgaccttccagaggatgtgttggaaagactctgccaggctctcctgcacacactggacagagggcaagaacctggagatctgcttcagtcccagctgtgccatgaatatgctgtgcatatagccccttccctcagcttaggcttgattttcctggcccataaaatgaaagaactggaacagataatctctaaggctttttctttccaatattttatgattctggcatttaaagcatctgcaggtgccggagaggaatgccagcaaagagtgtatgagaaaaattggcataactattgggagggtaatttgatattagctttcaaattttttattatttcgtttaatttttttgggggggacagcatcttgccctgccacccaggctagtgtgcagtggcatgatcatggttcactgcagcctctatctctgaggctcaagtgatcctcccacctcagcctcccaagtagctggcactacaagcatatgccaccaggcctggctagttttttttttttttttttttttgagacagagtctcactctgtcacccaggctggagtgcagtggctgatctcggctcactgcaagctctgcttcccaggttcacaccatt

SEQ ID NO: 182 - DNA, 3618 bp, Homo sapiens
ggcccgggcgcctgggctgccgtcccggctctggcttcccaaagctcaaataagaggggccggcggcgcggggaagaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcaggctctgtcactatttcccattggccaaacgctactggaagtggaaggctaagaagcccgatggtgcaatccatacacgtcagcctctggggccagagtgggatgaaaaaaggctcatgatggagcccgagttatatggcaggagatgatttccacggtctgtgaacactgaagatgagactggcttggggccacgtgccaaactgcacagccagtaagacctgcttccatcgacccacagcagctctgactttttttttttaacaatagagaagaaactaccacagggaagagagagaacaatggcattttgacaaatggaacaaagatagagtgtgactgacaattcaggtcagaaggaaaattaaagcacaggaagactgatgttggtcggcctccttgccaagaagcaaaaactcagggggaggcatccagccacatgcgaactggctcaacactggccattttgtttgagcaattttgttggatgttttctacaaaagagcactttttctcggacttcaaacattcttatatgcaggatcgacaccacacactgccatcatcccctggagtagtatccttgagacctgaggaggggaaaactggagggacgttgtgggactccattgagaaatgtggtcctttgtctccctggagatctttgaggacggttcagataaagttgctgccagtggaagcagctaggctcagaaacctccagttgccctttctagacttgtaatcctctgaaaaatggaaattaggaagcgttcatttatgaccttgaaaaaaatcgtttacaaaagtatattatatcactaaaatgagctggaaaaagggtttatgtgaaagttcatgtgagaaacacagctattagcacgcatgccattccccaccttgacctcagcaggaatgtgtaaattgtaacatatggaatgtaagccctgtcgagatgtttcataaatctgcctggcaatgagcatcacaaggccctgcatgagaacaggccccagaaatggagagacaaataaagaaacatcagaaatattaaaatgaggaccaaaaggagtcccaggtataggagcatgaaacatctggcaacatgtagcaaaaacaggagacttttttcttctaacggaattttggcctcttggtgccagtatgtgaaaaaggccttgtaggccaggtgcagaggctcacgcctgtaatcccagcactttgggaggccgaggctggcagattacgaggtcaggagttcaagaccagcctggtcaacatggtgaagccccgtctctactaaaaatacaaaaattagttgggcgtggtggcgcatgcctgtaatgccagctacttggaaggctgaggcaggagagacgcttgaaccctggaggcggaggttgcagagagccaagatcgcaccactgcactccaacctgggtgacagggtgagactccatctcaaaaaagaaaaaagataaaggccttgtaattggccagaatgaggggaagttagacaagagaggaagaaatataaatataattaaactgtcggaattgatttttttttttttttttgagatggagtcttgctctgtcacccaggctggagtgcagtggcgtgatcttggctcactgcaagctccgcctcccaggttcacaccatactcccgcctcagcctcctgaatagctgggactacatgggcccgccactacacccggctaatttttttgtttttgtatttttagtagagatggggtttcaccgtgttagccaggatagtctcaatctcctgacctcatgatccgcctgccttggcctcccaaagtgctgggattacaggtgtgagccaccatgcccagccaaattttcaaataaataaataaatgtgtagcaaaagcaaatgggctggtttgttttggtttgtgtggtttttttaatgcctgtaatgagattgggctgggggtgcaggaagcagaccgagcgatagaggacccaggctcattatggctctgcaggaaatagcatgggtccagggactaatgtggaaaaggaaagcatctggagatggagtcaagagagatggtttctaaccaccaataagcatttgacaaggaaagccccataacctccctactcagcctaccctgtaaggattctgtgagaggcacctgtattcacggactctgtaaagctctagggaatcctcaggagaagcctatcttactggcatgtgagaatcctccaagatctcaccagccccaccagcttgagagtggcctagaaggaccttctgcctctgtcctcccaaagtgactcctattaaaggcaaaatgtgtccgagtcagcccatcttaaatggctgactagtgaaatttatttctgcatgcaacagaatacctttttttttcctcccttctgcctgggtctatgacttggttgtgctcagcagaaggaaggtaggaaaggcacattttgaaagtgtagcgagcatttgagcagactgaattcaattttggatacaaatgtcaaggaaagattctcttggctctgagctccttgctcactgaggcgcagtgtgatgctccattgaaagacctgctgatctggccagtgctgggctgatgataataaagggggagcgaggggcagaccactgagcaggaggaggaatgaccttccagaggatgtgttggaaagactctgccaggctctcctgcacacactggacagagggcaagaacctggagatctgcttcagtcccagctgtgccatgaatatgctgtgcatatagccccttccctcagcttaggcttgattttcctggcccataaaatgaaagaactggaacagataatctctaaggctttttctttccaatattttatgattctggcatttaaagcatctgcaggtgccggagaggaatgccagcaaagagtgtatgagaaaaattggcataactattgggagggtaatttgatattagctttcaaattttttattatttcgtttaatttttttgggggggacagcatcttgccctgccacccaggctagtgtgcagtggcatgatcatggttcactgcagcctctatctctgaggctcaagtgatcctcccacctcagcctcccaagtagctggcactacaagcatatgccaccaggcctggctagttttttttttttttttttttttgagacagagtctcactctgtcacccaggctggagtgcagtggctgatctcggctcactgcaagctctgcttcccaggttcacaccatt

SEQ ID NO: 183 - DNA, 3618 bp, Homo sapiens; identical to SEQ ID NO: 182

SEQ ID NO: 184 - DNA, 2421 bp, Homo sapiens
tgaggccacctaaacctttaacccttgacttcatataacccaacgataggtccgcagcctcttctaccgtctttcctgaaaacaaggaagggttgagaaacaacacacattactgaaaggaatctcatgggaaaatcacttgccatttgaaatgccaaagtgagctagcaaggatttttggtaaatgaacgcctgaatgcttaaaaggagggtcctcacctccttgccctgagacagcgccctagcatcagcctgagcagaggggtcttccctcccacatccaggctcaatgtctctctactgcccccttctcctgagatgtggaagataacagtactcaatgctctaccattccagacctaagggaaggcggagagtcaaaacaaggtgttaacggcctgaaagcaacatctgtagccaacaggaaagggtttcctacacttctccatgcgcttacttatcaaataccttctatgcacttatcttcacaaattattttacttgtcctgtggtctgtgtaccttgttctatgtggaacagggtgagtctagccaggttcaccttcaggatgctttccccatgccctgtggttgagacggctccgatgtcattgtcggcataacctccagctcctgctcaaaaagggtgattgttctgagcagtaacagtcaagaaattcaaatccatattagaagtcggacgctacatgaaagttaaatcgcgaagggtgctcaagtaccgacaaaggtcaggttagtagccatgatctgcggaggcaaaggtggactagaaagcgtcatgtagatgccccagaatttaggaggataaagggagcctcagaggggcaggcctgacctttcacagagcagctacagcaggacagcatctccttggccccaaagcacagccattcctttttgctcaatgaagccaccctctccctgtctcctcctcatgccccacacactatggaggaagaaacagcatgactgcattatatggatctctagcaaggccatcatgttccagtgatttggggaaaatgatacccacaacctaacatccatgcacactgtctaatggagggcagttatatttgttgagggtgggcataattggacctgagggaactattctgggctatccacttaagtgggggtctggagtgaaagctactttgataagatttcttccttattttgggcttggattaagcaaccttacagccttctctgagtcattcttgtatctgttcacacacagctaccagcctcagagtcctttagccttggaaggattcgcctttaccctcccacagttgatacagaagcacagaagattgacatttgccttacttattgatgctggacatggggcaaggactcaggagttgagatgctgcattggattgtcacaaggccccagaggttctcaaaggcagataatccctggctctggttctggagggagctgacactggacagccaatgaactgctgcagtgggaggaggcgcctttactttttcttataagcttctgctggggaattaactgaccgggttccatggtgtcaaagtgccctaatatttggaagcagccaagtctttgcttacttttcagttactctaggaccacagaaggccaggtgtctccaagggtggtcctggcacaggcatcgggcgtgtgaagctgtcctccccgccacatgcacttctcaggacaagtgcattgcctgaggtgaccactgctgagcctagtaccgtcccccatgactgtccaggcaggggcctggccagtggcagtgctccttggggaggctcctcagaaggccaggcagagcacacctggtgctcacagctggacagagagttctgagaatttagcttatgccttttcttgtcaagatttaccactgtaactcaagcttaaaattaatttctaggatctaacctggagtggccctgtggcctggtctgaacgcagctgaagcaagctgcactactgaccaggcacagtttggtgggatttttgccaaggagaaagaaaggtagactacttcacatctcttgggtgatataccaaggagaagaggagttaccaagcctctactctttttaaggaagcttccagtgtctctgagttcatgacagaaaaagggtatcaagaattgtcgagagtgtagattattactaaagactagagcaacacattaaaaagggaaggtagggctagttttcctctaaaagaataagctgctctttagggcagatggaacaatttagctgcttctcaaaacttcagtcacctgtgggggttcatgaggattcctgcatgacaagtgtgaaagtctgcacggagtgaaacatacagccccccagccctgcctctcacccactcctgggaatgagatggcgtgcttcc

SEQ ID NO: 185 - DNA, 2263 bp, Homo sapiens
ctcataagaagaggggattaggacatatagagacagatggcagggctgtgcacgtacagaggaaagaccatgtgaggacacagtgagaagatggccagctattacacaagccatggagagaggcctcgggagacaccaacgtggccgacaccttgatcttggacttttagcctccagagctgagaaaatattaataaatttctgttggttaagtcacttagtctgtggaatcgtgttgtggcaatcttcaactaatacacctcctaataaaatacttgtttctaaagggggagttgttgcatgttgaggtttttactgtgcacctctgtctggggtgaatgctggcaaactgcaggaagactgcgccataaaccctatcatggtttggcttcttccttgacccactcagaaaaagttcagttcttctgaaaaactcacgagtactccacaaggtggcacatatcaccctccacaccatcctcatctcgaggtctctgtagtacacctgagaccaaggggggagctcgtgtacattctggtctttgtcaacagtgactcccaaccacacccttattctttcaaaatatattttattagcggcacatggaatgtcaagttaagcaaattctttccagagagaaggtgagcctgacagactaaaacgttgagcacggatgatacagcagaaataacatttccagtgtaatgagagataaagaggaatactgcccaccgaggaaatgactttcttcaccatgctgaccacactgcacagcgcccgatccggctggtgaggatggggaggtgggaagaatctcaaagcactggacagggtgaggactcaggaagtcacggggtcagccctacagcatcagctcctctctgttgttggagaggccctgagccccattactcactatacgaggaccagagtgtctttggcaggtggaggctggctcacgggagaacaccaagtgagggggctcctctgtgaacccaagaaacttcaaggaaccccacagcgtctcccttatgacctcccatctccagattaggaagctatggattcccagagggtcctttggaagtatctagaaatgtccagctaccagcctcagagtcctttagccttggaaggattcgcctttaccctcccacagttgatacagaagcacagaagattgacatttgccttacttattgatgctggacatggggcaaggactcaggagttgagatgctgcattggattgtcacaaggccccagaggttctcaaaggcagataatccctggctctggttctggagggagctgacactggacagccaatgaactgctgcagtgggaggaggcgcctttactttttcttataagcttctgctggggaattaactgaccgggttccatggtgtcaaagtgccctaatatttggaagcagccaagtctttgcttacttttcagttactctaggaccacagaaggccaggtgtctccaagggtggtcctggcacaggcatcgggcgtgtgaagctgtcctccccgccacatgcacttctcaggacaagtgcattgcctgaggtgaccactgctgagcctagtaccgtcccccatgactgtccaggcaggggcctggccagtggcagtgctccttggggaggctcctcagaaggccaggcagagcacacctggtgctcacagctggacagagagttctgagaatttagcttatgccttttcttgtcaagatttaccactgtaactcaagcttaaaattaatttctaggatctaacctggagtggccctgtggcctggtctgaacgcagctgaagcaagctgcactactgaccaggcacagtttggtgggatttttgccaaggagaaagaaaggtagactacttcacatctcttgggtgatataccaaggagaagaggagttaccaagcctctactctttttaaggaagcttccagtgtctctgagttcatgacagaaaaagggtatcaagaattgtcgagagtgtagattattactaaagactagagcaacacattaaaaagggaaggtagggctagttttcctctaaaagaataagctgctctttagggcagatggaacaatttagctgcttctcaaaacttcagtcacctgtgggggttcatgaggattcctgcatgacaagtgtgaaagtctgcacggagtgaaacatacagccccccagccctgcctctcacccactcctgggaatgagatggcgtgcttcc

SEQ ID NO: 186 - DNA, 2263 bp, Homo sapiens; identical to SEQ ID NO: 185

SEQ ID NO: 187 - DNA, 2263 bp, Homo sapiens; identical to SEQ ID NO: 185

SEQ ID NO: 188 - DNA, 1287 bp, Homo sapiens
gagggcgctcacaatagtcagtcaaggaaacactgtccgccccatttcccaggagatggactcggccgcgcggaggatccggccccgcggcgcctgcacctgcctggacacggaacgcagacaaggaccgctctcgtcccagggtttttaagaggccacacatgtttattaggccggtcctgacacctgcctgcggggaaggaccaccgagaccagatcctgggtgccatggggtgcagggacagaccggtgcatggcagcggctgcgcctagccgcgctcgcagatgacctcaaccacactgggctccatgggcacagggtctgggcagcgcagggcagcagaggccaccacttcgtccagcagcaagtgcacgagttcttcgtcggccacaaaacgccacaggtagagctgcagaaagtggcagtccacttgcacctgctgcagcccgaagcgcccaaaggtgcgcagccgcacacactccagcagcgtcttcaggctgatcttgatgatgccggtcagcaccgacacctgcaggcagggacacagggatgcagcttggggactgcaggtgtgtgtgggggacacccaagttccaagcaggggcccgggagacatacgatggaagtagctgggatgaggcagaaagtctccggggccagataagaagggagggatacaatattagcgccgtcatctggagggcaggggacaggtagggcccagcaatcagaggcatccctgagcttggagtgaggcggggcagggaccatgggtgaacagaaaaccctggggaggacccaagactactgtggggataaggacaagggcaaacagtaatcccaggtcagcacccagactcaggctgggcatacaccaagactgggacaagggctgtgggatttggaggcagggcactctgtactacctaaaaacagccctagagacagagactggagggtcagggtcacccccagttggtcacagagtcctggggctccttgggcaggtgtggggctgctccagccaaccctccccgggatccctggaagtctgagtcacgttggaagtcggaccttgttgaactccacagggctgaacacatcaatacgttcagagaatagcttctggatattgctcaagaggttggtgtccatcggggcactggattggggaagacaaggaatcagagcccgccctgcaccctcgccctcttttgtcccttccccctggggctcccctgaccagccagacctgggggtatagctgggggcgtagcggccctgct

SEQ ID NO: 189 - DNA, 26332 bp, Homo sapiens
gggctcctgtgggaaatcccgggtacttcctgggactggtctgtctatatgtttggaaaccacagagctgacctggcttcagaacaagatgtggggctccaggcacccgggagaccagtgaccctgattggcaatagccgcaagaaagggcttggagacaggggccaggcgcggtggctacccctgtaatcgcagcactttgggaggtcaaggcaggtggatcacttgaggtcaggagttggagaccagcctggccaatgtggtaaaaccctgtctctactaaaaatacaaaaaaaaaaaaaaaaaattagccaatgtggtggtgtaagcctatagtcccagctactcgggaggctgaggcaggaaaatcacttgaacccaggagggagggtgcagtgagcagagatcacaccactgcactccagcctgggcaacagagtgagactccatcaaaaaaaaaaagaaaagaaagaaagggcttggagacagggccctaaccctggaatccagatgttgccaaagcagccccctcctgttcctctgtctgcctgggaagaagcaggagttggccacccacacaggcagggcgggcccttcaccacccagctccaccccggaatccaagggcctctgtttgctgctgttttctggaacaacttgttttgatctagagaaatctgctgacaccggccttcctgctctcaccctccagctgggcagaggtatttttagacttatttgtagaggaagagagcagaacccaggcccaatgtgtaccctccttactgtgggcacagctttggccccttaaggcaggacagagatatccatgtggttgtctaccctcagctcatctctccttaaatacattcctttcccgagaaaaacgagctgtgtggaacttggaggccagcaaagcttctacataaggaccctctgaaacagtgcccttttgtccttgaaaacccagggtggcaaaggcagctccagatacaagggcacaaaggagacttggttccctttgtgacagggaagcctatgctttacagaatcctatgttttgtatgtcagtaattgtccctacttaaaaaaaaatctatatatatatatgtattagaaagggtctcactcttgttggccagcctggagtgcagtggcacaatcatagctcactgcagcctcaaaatcctaggctcaagggatcctgctgcctcagtctccccagtagctgagactacaggcagtcatgtgcacctggcttttttttttttttttctttcattttttgtagagacagggtcttgctgtgtttcccaggctggtctcgaactcctggcctctaggcaatcctcccaccatggccttcaaaagcgaatggatcccactcttttttgaaaaataaaatctaccatagtttgtttctgggatttgggaatgatgtgtgtgaattagagagatttcgagacctgaaatagagaaaagcaagttaagacatcaactggggcccagaaacagcactacagcggggacgacccacctctcagatgcctggtgagataaagaaaggtctggctgactccactgcccagtactgtgaagcagcagtgaagactcctccattggtttcataagctgcccagctttctagaacattttgacagacaattccctctttccacacggttctttcaggccaaatcaccccaccccaacccacccctggagatacagtcaggaagagactgatggggcagatcctggaggaggccgcactgccggaatcttcccctggcagagaaacagggctaagcaggcgccagggagcaagcctgggcttgccacatcaccaccttctgtgctgaaggtcagatgacacacagtcaccagttttccgagaagcacagggaggggtgcatgtcaggcccagccctgcctgctgataccacctcacagacgcaggcgaaatgtcttcaccagcttcttctcggttgccaagggggcctgctttcaaggggttgttttgtatggggtgtgggtgttaaccagggagaggttcctggcaggagttcctgtcagatgccattttccattctggttacttgaaccggggtcctttttcatcctctacctcaggggccagagcttcctcatcaccctgcaccccctagcaagggaggtgcccgctacacggtccaaagtcctctccagacattcgggccctgcccgccttgctggagggctcaggagttcaccagggatgcgcattctcaggaaacacgtcccctcgccaggcccctgggaagagtcaaaaccacgatgcctgcccctgaagcgcccgcgcggctccacggggctccatgttgtcacccactagctcctggacgctatcagcccgcagcagggtttcctggccagagaaaccgcctgttggggtgcggagcgttccacgtcccctcgcagcaccccgctggccttctgggccgccccgcccccaacccgcgcccgggcgctgacgtcatcggccgagcccgactcggaaccaccgcccgaaagtcacgcgcgcctcccggcgggacgtgccctctgcagagatccctccgccgccgcctggaattttccagatgtcctgccggcccttctttcgggcctcggctgggcgtggtgacctcaagcgaccccggcggctcccgtcgcccactcaagagggcgcccccgcccgccacgcccccagcccctctcggggaagcgcgtcccccgcccgacctcaacaacatccgggaagaaaaggggtcttcttcctcatggcattcgcctcccaaatgtcaccttgagcgctgtccgcgatcccaaaaagcactgttaaagagaagcggggatacactggggtccttgcgtgggggccgcctgggagaccatgcaccgcccgggagtctctccgggcagggtcggggagggacttttttgccggtggccgtggaggaatcgtcccgttgagcaatgaccccggtgacgcggctgagggctataaaagcaaaagttgtggcaagtccagccggagttagcgacagggagggatgcgcgcctgggtgtagttgtgggggaggaagtggctagctcagggcttcaggggacagacagggagagatgactgagttagatgagacgagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatgtgagcattgctttgtctgctggtgactgaacatctctaccttgtgtcaattggccatttgtggtgtgtgtgtgtgtgcgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttgtcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctatgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtgtatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctagaattctcctggctattccaggctgcatgtttaccttaaccttccctgtgatgtcttcatgccgttgtcttcttatgcaagaataaggtacgtctttccatccactcacgtctatttaatttgactttgcattacacagaaagctggtcttggtctgtctacctcggcatctagttgtcctcactgccccctagccgaccccaccccatctgactgactaccccatcacagagtacttttatttacgttttgctctgcctaatggttacttgatactgtcacgccgacagtgtccagttcagtggtctttgcagttgaaatgctcccgtacacactgtcttgttaaaaatgccagtaagttcatacaaacccagcttgcacccaaggtcacattcagagagcgtagggctgggatgggttgttttccaagcttctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgtttgtctttttattactgagttgtaagagttctttatatattctggattctagacccttatcagatacatggtttgcaaatattttctcccattctgtgggttgtgttttcactttatcgataatgtccttagacatataataaatttgtattttaaaagtgacttgatttggctgtgcaaggtggctcacgcttgtaatcccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagactttgtttaaaaaaaaaaaaaagtgacttgatttaagggaaaaaatgactggctatattcagtcagatatggcaaaaagtctcaaggtgttaatgtgaatgattaaggtcttggggggggtgtcccctatcagactacaggtgtttagaggcacagaaaaaggtgcagttgggttcttaatgtgaaatgatgagaagcacaactccagtgtgtctctttgtgtagaatgtcagcagacaccccctgctagatgtgctggatcatgggaaagcatttccatttgttactagattgttcagaagttttaatttatgatgggtgtggtggctcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggtttttttttttccttttatcatctgatgatgaacttaatgtttccatttgtattaatggaatactaagtccctctgtgatttctgaaccaagctattcctaggcctgagttttattttgttgacacagaaataaattagaaggccaagcgtggtggcatgtgcctgtagtcctagttgctgaggtaagaggattgcttgagcccaggagttcaaggctgcagcaagctttgattgcgccactgcactccagccttggcgacagactaagacgctgtctcaaaaaaaaacaaaaacgacaaaaaaaaaacaaaacagaaaaaataaactaaggcaatgacagtccctggcaaatgctgggagggaggcagcagtggtcagggaaggtaaccctgaagcaggacttgtaaagcaaataagattgggaggccaaggtgggtggatcacgaggtcaggagttcgagaccagcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaaaaaaaaaaaaaaccaagaagaaaaggaatgaattagaacttcttctgcttggacttaagggcatcatcaggcaggttttgggtaggatagcaggggaggcagagacatagtcggggtcagtggtcatgagtgtggctttgagcccaaaaacttggtttctgttccctactttgccactcagtagtgcatgactttggccaaatttcttaaattcatgaagcaagtttccgggtgaatgaaatggggataaaaatagtgttcaaacctatccgttggtttgtgtgaaactgaaatgaatagtatcgtgcaggtacttgtgagcaaggggagctgctgtttcctgtccctttatgatgggaaatatctagacaagttcccaaccctctgcactgcaggctgcatggcacggagggtcttgtaacaccagctggggctggccttcttttaggagcttcagtggttctgaaaacttttatttgtttgtttgttttagtagatgtggggtctttctgtgttgcccggactggtctcaaacttctggactcaagtgatcctcccccgctcaacctcccaaagtgttgggattacaggtgtgagccactgtgcccagccttgaaaactttttcaggttcttccagggttactgggctattaaatatttctatttcattataagtcagtttttcaaagttatattatcttaattaccttttttatatgtattagtgtagagtagcattttatattttgatatcctccttatgcatagtttttcactttttattcctagtttttcgtttttaataagactttcaagaaatttattttattggccttttgaaaaaagcagctttagataaagtaagcagttctgctttcattttataatttatttctacttttgtttcattaatcttttcctccggcatgccttggattttgttgtgttactctttttctagaggctcgcattgtgtgtctggttcacttatgatcacgcttgcctacttttaagaatggaagaggggaggtggagggtggctgcacagtcgagggtgtgaggcagtcttgctctagccccaccatgccctcagcccgctgtggccacgctggttcctcaattgctggggcgtgcagtgtctgtaagggaggctactgatgccatccgaggaagatgtaaggtttcgtgtgggcagcgagagcctagcaggcatgtggggtgcccagcaaagggtaacagtggacagttgttgcctcattccacagagttttgattttttttttttttttaatggtcactccatcaacatcccccatggccagagcctgagctggtccccagagacacaggcattcagctgacagcctcgccttcacgctgctgctgttctcatgggggacaggcctcaggtggcaatgcacaaatcattagttaagggcagttgtgacagttaccaaggagtgtagtcccccgccccccgcccagtgaaaacagccctaaccaggggtggggacctttgggctctgacccgaagggtaggagaagctggaaggacagcattcctgtctgcgaaggcaggagcaaagctgccaggctatgaaggaaatggctggagcctgaagtcatgcaagctggggctggcagggacagggccaacttccaggcctgggggccaccatgaggattcaggacgtgacccccagggcacatgaaggccttccatctgtatttaagaaaagactttatcagacgagtatggtggctcacgcctgaatcttagcactttgggaggctgaggcaggtggatcacgaggtcaggagttcaataccagcctggccaatatggtaaaaccccatctctactaaaactacaaaaattagccaggcatggtggcgcacgcctgtagtcccagctactcgggaggctgaggcagaagaatcacttgaacccgggaggtggaggttacagtgagccaagatcgcgccactacactccagcctgggtgacagagtgagactccgtctcaaaaaaaccaaaagactttatcttatttcctatatgtttgtggtttcagtcctgatgtataatttgaccctagttagaatggttatctgaggaagtggcctgtacgatttctgcttttttaaatgtgtggctccctttcttcattgattaacgtatgattatttttataaatgttccatggcagtgggaagggattctctgtcacattccacatctggatcagttcctccccattttgttggtcaaatccgatctgccatatcctgtgtaatgacaagtgagttgcattctcaccgtcactcctggggtctctccgcttcccctgagctggctcagcagtctgctccatgtgttttgatgcagggtgacccattggtattcccgacactaacgcccccgtctgtggactgcttgctgcttgggcttcactgtgtctggtgttgacagtgcagacctaaaggtgtgcacacatgtgcacacacactccgctgtcttcttgtttgcactggacttaaatatctatgagggttattttcaactgctgaatttggaatgatttttatatcttttctgctttctgcccatgtacatgtgtttattttacactgttgtgattggtagttactatgtggggacacaattacttgggctgaaataatccacctgttgtggttggggtcctctggggcattccagggtgagaggttgtcactgccacctgggccatgtgggccggcaccagcattttgtggttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcctctcgagtttcctagactcactctggaaatttctgtatacacacagaagcttgtgcctctgctcgtgaaggcagagggagggagagctgaagggccagcaccttctcacctgtgggccccctcagtgctcggtcccagagcatgcaggactgtgcctcgtgttcagtttgctggtctgacttcatgctccttgggcaggatatgcatgtgccatgctaggagacatgtggatgtgaagctgggggacaatgtcccctggctatgcctttacaagggaagtaaggaaggtaggaggtgagcctgggagggagggagggaggcgcggagccgccgcaggtgtttcttttactgagtgcagcccatggccgcactcaggttttgcttttcaccttcccatctgtgaaagagtgagcaggaaaaagcaaaaggcgctggtggtggcacgtccagcacggctgggccggggttcgagtccccgcagtgttgctgcttccttccagctccctcctccaggcctctcctcccaccccaccagggatatcttgtctcctagaggggtagcattgggtggggcaccccaggcctctcccagaagccctcctgccctgctatcccctccctcatcctctggggccctgggaatacagcaggggacgtggggccacaggcagctgataacttagccccctcagccactcctgtgggagcgggagggggacagcttggcggctctgcacccaaagctgtggggcctacctggagtgtccccacccctcagggcatactccccactgccctcttcttcccaggatcaactcaccgctaccctcctctccacatctgaggaccagcgtggctcttccagggagggcttggggagatgaggtccaaggggagaggccagaaatcctgaggcctgggctggagatgggtgggcggacagggcccaacgaaccggcccttgtgcaggaaggccaacagctgggaccacaaggtgccgggtgggacagggaagtcagcctgtgctctccaggcacctgggacccaggagatccccccggctcagcaccagcagaggcagctgctgtgatcctgggcaggcagtgtcctcctccctcagtctctgccccctcccatccccaagagggaggccaggggctcacagtccatttcatgggccatgatactgatgctgtctgcagttggggcagcttgcctgaccacaaggctctccagggagcccctgccaatcactataataatctcctttaacgagtcaggccccataaggaacagccagaagcaggagagaggggtgagaagaggcagcgtgaagccgaggtcttggccggccatgcctgggtggtgaggccacaagtccacccctgcaactgcaagggcagcagggaggagctgcaggatctgctgtccttggatgtgatcagcctgccactggggaccaacaggcctagactcatacatgagccaaggcacagagcccaggactgaagacagagaggagccaccacacggcaaaagagcatggacatctgagtgccacctagcctgtgtgagactccgtttctctatctctaaaatggagtccgccaggcgcagtagctcatgcttgtagtcccagttactcaggaggctgaggtgggaggatcacataagcccaagaggttgaggctgcagtgagctatgactgcaccactgcactccagcctgggtgacagagtgagaccgtgtctcaaaaacaaaaacaaataaataaaatggagtcactgatagctacctcacagggttgttgagaaaattcgggataacatttactgcttgccacagggaaggtattaaaaagttacag

SEQ ID NO: 190 - DNA, 7744 bp, Homo sapiens
agtaatttaagtatttctgcatgtgtagtttgcattcaagttccataagctgttaagaaaaatctagaaaagtaaaactagaacctatttttaaccgaagaactactttttgcctccctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtaatagcctgcagctggtgttttgagaagccctactgctgaaaacttaacaattttgtgtaataaaaatggagaagctctaaattgttgtggttcttttgtgaataaaaaaatcttgattggggaaaaaagatgggtgttctgtgggcttgttctgttaaatctgtggtctataaacacagcacccataattacagcataatcttcaagtagggtacggactttgggggattggtgcgagggtagtgggtgagtggcctactaaaaagcccagtaacccccacaggaaaatagggaacttctttttaagtagcctcctttccactatttagtaattggctgtgagctgggctgggggagaaatggggcggggtgtgtgtgtcattggaaagctctcttttttgtttttttgagacagtctcactttgtcccccaggctggagtgtagtggcatgatctctgcaaactgcaacctccacttctggggtccaagtggttgtcctgcttcaccctccctgtagctgggactacaggtgcacaccaccacgcctggctaatttttgtattttcagttagagacgtggttttaccatattggccaggctggtctcaaactcctgacctcgtgtgatccacccgcctgggcctctgaaagtgctgggattacaggtgtgagccaccaagcctggccgatccttttaagtttttaaaccagttaagctctttggttccccctcagagtcccaaggtcctgggtcactcaggatcacattttcctttaatcagttgtcactggtccccttttgtccctttgaacgtgctgtgggattagtagcagcatctggctgttggaaggactggctgggatctcaggtgaaataccctccctggccctccttacccttaagatctccctgaaaagtcagaccttgcttattggagtttgagatgcattctagtaaacccagacctaccagagagagggacccacgtctgaagaatcttccagcctggggaacctgtgactggccacacccttagcctaatggaggggcctcagaagcagaactacctttttttttttttttaatggtattacattttgcaaatggagaggtagactctgattgggccccttttgacaacgcagcagagctgaggtttgaatcctagtcagtcaacacttcaacccctatgttgctgtttcttcaatgtctagaatgttctgatagatgaagcaatggcccggcaggtcagcagcacaccaacccccaacctacccagcctgtataggccttggccacaggagctttctcttcccttgaagtgatctaatgggggatggggtatctgtctcgctggttatgaaagaagctgagctaggtgctctcctaagttgcttaagtgtcttctgaattgatgcccagtcagtttcgtatggagaaaggtctctgtttttccaaagcagaaggttctgtggaagcacaaatactttactggagagcaaaggagtacgagtaggaattgggggccacgcacagtggctcacgcctataatcccaggact

SEQ ID NO: 191 - DNA, 7744 bp, Homo sapiens; identical to SEQ ID NO: 190

SEQ ID NO: 192 - DNA, 3975 bp, Homo sapiens
agtctggcacacagggaaccccactcctccagggcccgtgctctagcacggcctgagagctggtgagcgcgcccttgccctgttattacctctggcggcttcatttgtgctgctggtgacagggacacaagtccttccagtcctcctggtcttgcctgtccgctgtgcatggggagggaagcgctcaggcctgttacctgcctggagtcctcaacggggagaggcggagggagccggctggactggccctccaaggccgaggcggtgaggacaggatgagtttcttacccaccaagatcattactttggaaaattggaactgtagggaggagttcagggcatgtcggggatggacgtcgggagttccttccagagctcctgtgggtttggaatgtcctcgctcactccggatcccccagcatcttccttcctgcacttccgtcccacccttcctccaggtttgggacatttaagagacagctgtggctgcgacattagcaggagcaaacacacctgacaatggtttgactgcccttgtctagaaagtgacagtaacagtgccagcctctcagggttgctggaagattaaatgagatgccatgtgcaatatgccagacagatggcaggtataaaaataggactctccgttcatccttgataaggctgtctggctacatcccccagttctcctgtgtctcagaatcttgtatagttaccagttcttcctgacacctaggcgggactagaaaaatgcctacagtgtgactggctgaatgaagaggcatcggctttagtggaaacagggacgccttccaccccgctcctggcttcgctcatctcccctggtgtctgagcccactttccttccccgaaacacctcctcctctgttctactcacatcctcctgttcttccagcccagccgcagacccacctcttccaagaagcctttgttctttctgatgcaaaagactgcttttgggttccatagtgtttgtagtttggccacgccatttgttctgggttagataatctcctctctttttcccagtcagcagagccctgtacacttttcatttccctcacagctacaatccaacagagcctggagaatattctgggcctggaaatgtgactggccccgccctgctagggaagagctcttctgggtggcacagggcacggcacccacctgagctcatctgaggcatgggagggagtacagaggctcagagggagcctcttccacccctacactgcccctgcttcctggaggctgtcctgcctcctgaagttcatgtggtgggtagtcccctgggttcccaacagcgggatgcacgtcttgggataggaaatgggatttagttggcctttcacagagaggcctctctggataagagaaatccttcatggccagctatttagagacagaaaattggttggggccctttttagtcctgtgggcggctacagggagccttggaaaaggatgtcttccctcgcctcacagcgcctggtaccaacccttcccacgcctcctggaacaagaccagcgtcccagacctgtagctttcttatccatctggccaggccatggtggaaaacacgaattgggacccagggaccagggcccccaaagagatcagtctcccagagcaatcctggtaagcgatagggaaagccaggcaagctccaaatttcctagtttgaattgcctagagggaccctacgtcccttcctgctttctccatccatagcgtgagcagttaccgagcagaccctgggccaggccaggcgggtggcagcctagctccactgctggtcagttgtgagacactgtgtcagctacccaaattctgtctgccagggtgggggtggtcacagaacctgcctcagaagcgagttgagtcaagtgagccaatatacataacacacttctgagtgtgcatggcacagcacaagggttgtgcaggtgcagccgtccctcggtgcatggacacaggtgtggccgtccctgggtgcctggacacaggtgtggccatccctcggtgcatggacacaggtgtggctctccccaggtgcctggacagaggtgcggccatccctcggtgcgtggacacaggtgtggccatccttaggtgtgtggatacaggtgtggctgtccctcggtgcgtggacaaggtgtggccgtccctaggtgcgtggacacagagtgtggctgtccctaggtgcctggatgcagagtgtggctgtccctaggtgcgtgggcacaggtgtggccatccctaggtgcatggacacagcatatggctgtccctaggtgtgtggacacagagtgtggccgtccctaagtgtctgaccagaagtgatgtgagctttgcaccctctttttgggactgtggctccttctgtggtctaaccctgggagggtcctgggaggccaagactggatccccgggtgactacataaagcctggcggtctcggcctggcagaggtagatgcagggtagtatgaggctgatggatggagctcagggcgccccgctgctgccgctgctgagagcagagcatgctaaaccaggactcagcaggcagtgactgtctgaggccctgggcaggtcacttaagctatctgggccaggctcttgtcttgaccagggccccccagtgaccgtaacgaggaagggtttggataagaatgtgtcaattgtttccattacttctctgcatggggaaaaaggggcccataagacaaaaacatcggaaacacagaaaacattagatctctaattttaatagttgagaggaaggttataaaataaaacagacaacacagagcttcatgacggcctcggattggcagtcaacccagggatacagaaatgtaaacaaaaacagagcttccagataacattactgtgtgctatgtgactttcagaatacagcagcgtcccagacactctaaagtcaagtgaaacaagagattttagaatcaatctatacacatttcagagggcagtccaggaaggagccttcctctcaggtcagcccagggctgggcctgagcctgagcccggggacgtgtagacactacccattttgggcaggggaggccaaagtggttctgcttcaggtgaaaaagtcagaaaaaaggcaacagatacaatttggtagccatcaaatcctctcctccctctggaagtttctgaggtgctggtcatcattctgtcccattttttgccactgtgctaaggcttttgactcaaccaagaaaagggccggtcttccagcctggccctgcaagagtgtcctagtgcttcaggtagtggatgggcatcgtcattcgtcccaccttcctgccccctaaagccccaggaggacacactctcagcatcaggccagctctccgggtcactggggcttggctcaacaggatgtgcagggcagagccgggagggaagagcagaagatgccatgggctgttcgcaggagcagccgtccagggcgccgctggaggaagatcttctagtggctgtctcagcacgtacaaagaacgggggtgggttggggcagcccccgcccagagccaaggcacagaggaggtttgaaatgtccaggataaatagaagcgcacgggaatggagaaaagccagctccatcccactcttaaaaacatcgccattggcaccaaaaatatattaacatctgtacatttgtcatctttaaaaaataaaaggaaataaaaccttcttggcaccttgtagtttatttcttagaaatgaggtgatatgtggaaaggcttcctgtgcgtgcacacacacacagcagtgcacacacacaagcacacgcacacacacggctgggcacacatgtgtgcctctccttgccggaaggacagagccctccagaaccctgagcattagaagccctgccaggcagctgggaggcaatcctggatgctcttggggcttccag

SEQ ID NO: 193 - DNA, 3975 bp, Homo sapiens; identical to SEQ ID NO: 192

SEQ ID NO: 194 - DNA, 3975 bp, Homo sapiens; identical to SEQ ID NO: 192

SEQ ID NO: 195 - DNA, 3975 bp, Homo sapiens; identical to SEQ ID NO: 192

SEQ ID NO: 196 - DNA, 3975 bp, Homo sapiens; identical to SEQ ID NO: 192

SEQ ID NO: 197 - DNA, 3975 bp, Homo sapiens; identical to SEQ ID NO: 192

SEQ ID NO: 198 - DNA, 3975 bp, Homo sapiens; identical to SEQ ID NO: 192

SEQ ID NO: 199 - DNA, 3975 bp, Homo sapiens; identical to SEQ ID NO: 192

SEQ ID NO: 200 - DNA, 8904 bp, Homo sapiens
ccagccaccggcacagccgcactcggccccctcgggcgggcgctcagggcaaaggctgaagtgcgaggcacttgtcactgtcggagacggcagaagcacctggctgggacacacaatgacgccaggacaggggctgaatgggagcagtggggttttggggggcgctgaaggaggttgggccaggtgcagtgggggccctctcagcggctgcgcgaccccacacctctgccgtgtgccccgcgggagttggcggcggcacgccaggtatgagctgatggccgcctgcctctttccctgacagaacggtgctgggcttagaccacagaccacacttggccaccacaacttccttgcaaaaaccctcagctcacccgagggccaatggaaatttattaattttttttgtccttttccatctttccccaagtggcttttccttgcaaaatgcctgacatgacaccagaggggaacctgggagcggggggcaccccaagggggcagcccagggacttaaatacaagctggagggcagggcacaggtgggacaggcaagagacagcacgagggacatggcttctcagggagaccaaagacttgctttcttgcaggaagcagctgtgccagagggcaggggactaggatcctgggtgcagagtgggtgagcagagagggttaaggctggtgcccagcctctggcacggtgggccttccgcctccgcctgacatggggacaaaggggcacggtgggcaggcagcgcatgggtctgtctctggcagggcagagggcggcaggagcagactccctccaggctcaagacacaggcccagcactgctacccgcccacccgccctagatatactcagatcccaccgcagctggacggctcgagctgggagtgtaggaagggagaggaggcagtggggagaggaaagggtggaccctcagttcttgggcaggacagcaggaagaagaaggagagaacccagtgcagcatacatgggggtgggagggacaccgacagaagagccctcgttccaaagaaaggtgtgtaggggggcatcttggaaagtcacctagaggcaacagcacagcaggcctccgccctgcctggccacaggccctgagtgtcctcccttagggaccctgacagaaccggggctcagggcagcaggcagatgggccagaaggagatggggagcccaggacaccccaaagccacagactcaaatgccccaggagagggagagggaggtacctcctgccccctccagggacatcatctggagaaggtgccccctcctgtcccactccatgtgcccctcctagcaacagccaccgccagccggctttacaggggtgctgtcgatcttgagattgggccgctcgcccccagaggctgctccaggccccatccgctttttgatttcagcagccatggtcatgaacgcctgctcgacattggtggcattcttggcgctcgtctccaagaaggggatgcccagagagtctgcaaactcctgacaagggagaggagagaagaggaggggagagaagaggaggggagagcaggtgaggggcagcaggccccagcgccccgaccccgggcagaccggcccgtctgctaccttggctgtggtgttgtccaccaccttcttggtggtgaggtcgctcttgttgcccaccaggagcttattgacgttctcgctggcatagcggtcaatctcctgcagccactgcttcacgttggcgtaggattcctaaagggggccaggggccaaagttattttgctcccaactgtcacccctaccccaggcctggagaagaccttctctgaggggaacagtacagctccgggccccttaagtcctgggctcagcgatgcagagatgcagaggaagccctctgctccaggctgaaccttcctccctgccctcttccatccgagacccagaacagccccagcagcctgccagctgccccaacacctcaacagctgccccaacttgggcctgccagctctgctccctgcagctgtctctctccctgagacacttgcaggccctaaccacatgtgagaagcaaagagagagcggacgggagataggaacagagagtaacgggtccgcaagagccacagttcccaccgtggcctgaaaatccctttaaggtttgaagccttggagcacaggagttcgagggtcctctcagaggtggccctggcctgtggggagacaggaatcctgggaacagcctaaaattcatcctacttttggcaccaacagcctcattacttggcttcagactctcccagcacttgcgcccctaccccacacacaaaggacaggactttcaggaaagtgctcaagctagggccacttatactccttaggagccagaagcctggtcatatcacactggctcaaacttagacctcttgccatgttccaagttgggtcctgtgctaagtgctggggacaaagggggaaatcatacttgggccctgccctaacacattcacgggacagtagatgaatagaccaggccacacacaagggcaaaacaggttagaaggcaggggctggggagcccccagaccacctctgcttgaggtgggagcaacagtggacctaagcctgcaggtgggaactggccttgtgcaggagaggtgccagctggggagccagcatgtgccaggtcactgaacgggaggggcatggtgtgtctggggaatgggaggaaatggaatgttgctgggatgcagacactcaacagggaggggggacagggagggggaatgggggagtggggaggagaaaggcaagaggggagagggggaagaggggaggaaagaggggggattggggagaggccagagcacagactgtcttagcatggctaagtcttggacttagaccaggagccagtgggcgtttcttaggccagaagcaacaggatcacacctatgctagtcctgacaggaggcagagcccagatcagaatagcaagatagagaccaactgggaatggctggaataactcagggaagagaacgtgcactgagccagggaagcacacaggatttagtcagaccactgctgctgaaggcctggctcagccatttactgtgtgaccccaggtatgttacctgaccactctgagcctcagtttcctcatttctataaacagtacctcctagaagggctgattgtgagcatgaagagaatgaacacaggcttgtctcataacaagtgcttaattggcaagagctgctattatcctcatcactgctattattatgaggggacagatttcagaaagatgatggggagagaatagaggggactcgagactgactggatgggggagggaagagttttctggtcaggctgacaaggattgtgtcacaaagatggggatgcagctggggcatggtggtgtgtgtctatagtcccagtgacttaggagactgaagcaggaggatcccttaagcccaggaggttgaggttacaatgagctatgatcacaccactgcactgcagtctgggtgacagagtgagaccccatgtcttaaaataaataaaaatattaaaaatggggatagaggcgctggtttggggagagacagtgaggccagcgctggacatctgagttctgcagaggctgcttgagggtgggaaagggtgtgctcaaaagccaagagccctccaaaactggctttgcccttcccgtgagaccggtggcaagttacttaacacctctccaagcaagtttcctcatctagaaaacacaaacctcaccatttagtttactagagaagatcatgaagatcaggattaatacagacacaaagtgccagtgtagacatggacagaggagggaagccacagccacggctgttagatgcaggaatcacagaacacaaggcagaagcaaaccacagagtggccgcagccatgcacaagagtaaggaggagagtccagggcagtggggaagcaccaaacacagggtgatgggaggcagcactggacagaccagcaaatagacactgacaatagagaatcgagtgctgcaggagactgaggagcgggggatggtccacttttcaaggagagagaagagagcagtgtccaaagccacgagaggtcaatgtgctgaaataagatcactggatatatggcagtcaggtgggccctggtaacttgtctgggtggtatgtagcttccccacagctcgtccagagctggggacatcatgagtccctggtgagctaaagagcccggctgctcctcagacagggactcttcccggcccacggctgatttaagcttctccttatcttcagggattggccctgttaagcaacaacatttggtagaaaaaacaaagcaggtggaatgagccatccaggctttctgcctctgccaccggactagctgaaggaccctcggcaagtcacctcaccatcctgagcccagctccttacctgtgcgatgggaacacagacctcttctgagcatcagaggcaatctgagggctgggccaggttctgtaaactataaggtttcatggaaccatttccagcccttgctaccaccactgctagtcacatgggactaacgctgctgctggaggcagagcttctggatctctgctcacattgggcccagagctcaagcttccctgcttctttgtctaaggccctctaattgtccccctgcactgtgtcttcacacaggaagccacaggcccagcatagcagccaaccgcctgactaaactcccacaacacaaaggtgcccagaaggtctacaataaggtggcaagtttggcttggtggggagggaaggtgtgaggccttgtcctgccagaacctgcagcagggccttcagaggatccatttctgtggctgtttccctccttgtgaaatgagtccaagtacagtcacctattttttttctttttcctagttagttcctgtaagcagacaaatagtgtcctttccaggaagcatcaggaaagagaggatggaaggaggaaaaagaagagtcaaagacctaaggctaaggaggccaagctgaggatggctagtccaggagtacctggtcagtgacgtcatacaccacgatgatgccatgagccccccggtagtagctggaagtgatggtccggaaccgttcctggcccgctgtgtcccactaggagacagtaggcagaggagcaggtcagctgaggtccagagtcccagagtcccttccctcccaaggtggatacctctgtactggggattttgggaagagcgacactcacgatctgaagtttgatagttttgccatccagctcgatggttcggatcttgaagtccaccccgatggtgctgatgtagctctctgtgtacgtgtcatcctgaaagttcaggggccaatgaaatcatgggagttaatgaggtgaggcccacttggagagcctccctccagttccctgccccagctgggtctccgaaccaccaagccccaattcccagcactcagctggccagccctgtcttgttcagggcagatgtgctggtggcaggtcttacagcttcacccctggttcccagatcttgcaactactgtgctctgtgttgtcccttctccccccagctgccagtcaggaccccaggtggatggtatgggaggcttcttactcacagcaaaccgcaggagcaggcatgacttgcccacgcctgagtcgccaatcaaaagcagcttaaacaggtagtcactggagagagaagatgggaaggcgtgaagggaggcagggagcccacctaccatcatcctggagtcacaattacaggattcccccaccccatgaggcatcccttggtttatttttattttttttttagcaataaggtctcactctgtcacccaggctacagtgcactgaagtgatcacggctcattgcagcctctaccttgcgggctcaaagtgatcttcccacctcagcttcctgcgtagctgggacttcaggtgtccaccaccaccaccacttctagctaattttttttttttttttttttttttttgagactgagttttgctcttgttgcccaggctggagtgcaatggcgcgatcttggctcactgcaacctctgtctgccgggttcaagcaattctcctgcctcggcctcccgagtagctgggattacaggcacctgccaccatgcttgtctaagttttgtatttttagtagagacagggtttcaccatgttggccaggctggtctcgaactcctgacctcaggtgatccacctgccttggcctcccaaagtgctgggattacaggtgtgagccaccacacccggcccctggctaatcttttcattttttgtagagatggggtctcactatgttgcccaggctggtctcaaactcccgggttcaattgattcacctgccttggcctctgaaagtgctgggattacaggggtgagccactgcgcctggccatcccttggtttagaatactatggtgctcaccagatcttcccaacagtcccggtcagggagggctgatgcctccctccacaaacagctagcccaaagggctctcagcttgctgagtctaaattctcactttatggagaaagaaatcaagacacgtgacctgccaaggcaacagagctgggtatcctaacctgatttctgaaacttcatggtttggtccagtaggagctatttagggaatccccagtacatgccctgcgtgtgcctagcttggcagagaaggccccagaagtagaagccagggcccagcctagaacctattaagttgaaaacccacgtagagagactgatggctgggtgctgtggcgtgtgcctgtggttccagctactggggaggctgaaacaggaggaggatccttggagcctaggagtgtatgaccagcctgggtgatgcagcacaaccccgtctctcttttcttttgttttttcgagacagagtctcgctctctcaccaggctggagtgcagtggcacgatctcggctcactgcaacgtccgactccctggttcaagtgattctcctgtctcaccctccagagtggctgggattacaggcatgcgccaccatgactagctaatttttgtatttttagtagagacgggatttcaccatgttggccaggatggtctcgatctcctgacctcgtgatccacccacctcggcctcccaaagtcctgggattacaggcctgagccaccgcacccggctaaccccatctctttggagacaacaacaacaacaacaacaacaacaacaacaacaacaacaacaaaaacctgttatgaagtcaccaggaagaggtggtcaagttgcagtgaaaattgcacttaaggctgggtgcagtgactgacacctgtaatcccaacactttggaagcccgaggcacgagaatcatttaagcccaggagtttgagatcaggctgggaaacatatcgagaccctgtctttacaaaaaattaaaaaatgtgccaggtgtggtggtgtgcctctgtattcccagctactcaggaggacaaggcaggaggactgcttcagcccaagagttggagactgcagtgagccatcgtcacgccactgcactccagcctgggtgacagagagagaccctgtctcaaaataaaaaaaaaaaaaggcaaaaggtaatcacatttaatatacttgagttccaacctgtggacggaccctgtgtgaagtactttaaatgcatcatctcatttaatcttcacaacagttcaatgaagtcagttttgtcattgtcaactaatgaggaaaccagaggccagagaagggaagtgacttgccctaacttacacagtttatcgctttaagactcaaaccaggtttctcagactccaaagtcccttcgagagcctgctggttcccttctctgttcccctcccaatccagctcagagcttcacccttccccaaggaaatctgagacctggatgtggagtagaaaaaggaagtggcagaaaaggaagaagataactgatacttggggaaaactattagtcctgggcatgagatgtgggccacctacccgcagggggagtgaccaagagtgaggagagtttgaggaccagagaatcccacaggaagggggagagcaaattccatattcatctaaacttcacaggcagtgtgacagccaagggaaggggtgtgacggtggcgttgggggcctgagcaaaagcgaggagagggcgggaaaggacggaccggcgggagcgacaggacagcgcgacccaggcaaagggtaggaggcagccccggaagagaggacctgcgggagacgcgacccaagcggcgcttcggggcctcccgcgtagttggctagcttctgggccggccccaggagccgggcttcaggagaaagagaagggtagagggattcactgcccgacctaaagggcccaagcctgaacccgagaccagaaactatcaagacgggctccaaaactccgggacagttgtcaagcagcaggtggggaaactgaggcctgaagtgaccgggactgcggggtcatctgaccgataaggcctggtaggaccgatgtctcgagctccaagagctgcccctgggggtcgccacgtctgggccccgggtgcgagggctcggggttttgagccggggtcctggggcccctggggggaggggcagaacccggatgtgggggggggtcagcggaagagggacccggatgtgggggcgccgcacagtcctgacccgggccagacaaccccggtaagcgtacagccctgtattcgggatcgaggctgcgctggacggcgcgggcggggctcactcactattcggggttcatggcggcggcggcggcccgctcg

SEQ ID NO: 201 - DNA, 8904 bp, Homo sapiens; identical to SEQ ID NO: 200

SEQ ID NO: 202 - DNA, 8904 bp, Homo sapiens; identical to SEQ ID NO: 200

SEQ ID NO: 203 - DNA, 833 bp, Homo sapiens
ggcgcgggtgtcagggacttgggaatccccctcccccagtcccgatcccgctttcctttggggtttcacctcagaggacccgacagcactcttgcagtttcctcatcctcaagatggactgcaccttctggcatctcaagtggttcttgtgaagattaaatgaatccatcaggccgggtgcggtggctcacgcctgtaatcccagcactttgggaggccgagacgagcgcatcacctgaggtcaggagttccagaccagcctggccaacaaggtgaaaccccatctctactaaaaatacaaaaagttagccaggtgtggtggctcatgcttgtagtcccagctacgtgggaggctgaggcaggcgaatcacttgaacccaggaggcggaggttgcagtgagccaagattgtgccattgcactccagcctgggggatagagtgagactccatctcaaaaaaaataaataaataaataaataaatggatcaatcagtttaaaaacttagaacagtgcgtggcaaatagtgctcaagaagagtaggcttgtgaaacattcacatgcattgttttaacaaacaatgcttccccagacctccccacagagttgacgctctggaaagaaaagccaggcttttctctgaggttttgcatctccttggccaatgtgctcatgccagagaagagcagtgcatggccagtttgaggagcacggccatgtgaccttggacagcccctgcctctctctaggactcactcccggtccctaacctcagctctctgatctgtaccacaaggagctgccactaacacctgtgtcagaactactgtaagg

SEQ ID NO: 204 - DNA, 10628 bp, Homo sapiens
acaccatctgtggaaatgcttccgaggtcttctctctcagccactcaactgatggaaggaaaaggcgatggaaagtctaacttttctgaaacaggtaggtgacaccttttggaaccggaatcaatcattattcttgcgtgggttttccattttccctgaagcatcgcaccagcttttgcgcgatgcctcggcttaccattttgcatctatcttaaggaattaggaggattcagaggagggtttctacgggcctctgctcacttttcacctctagggagactcaagtttccaagcattctttctgcaaagcacctgcctttgctaccttattgccgtattaccagccatcattttgattcatcttgaatactacagattaaaaaatattccctgcataatggctttgtgcaaaaacaagggaaagaaaacagaaagaagaaaggaaaatgtcctatcagaaagtggtcctccatgtttgcagaaaacccaggacccaccgggccctggtgggagcgggaagccgcctgccctgggagagggtgcccatcggtcaggatgcccggctgtctgggcaggctttggtgttgtggtggttgcacggcggctcgtccttctgccgctccttctccatccaggtttccagcagctgctgcttgtcttgctcctcccgcatgaacagctccaccatgagcaccttctccttgtggatctgctggctgatgtccttggggatgtccgggatgacccagtccacaaagtcgctcatgaacatgaccaggttctggaaggagaggcaacgcgtggcagaagggaggatggcgcctggggaagtgctcctgacctctctgcctggcccccatctggtggagtgccaccccaccacctcctggcccattgacctccctgggcctcagttttccagaagctataaaggaggcatagaaccacccggcaggcctctgggaaatgttggccgactttctcgaacaaatctgaactcagtaattgggaaaatcatctgagtcattctgaattctttgatcaggagactcaggaagtgacctgatggatcacacatcgccaaatctaacgagcatcgagcctttggggaaaaacatgaaactggaaatagccacaaatggatcaaacttttacagtttgcaaagcgtcccagggtctccctgaacatctaccacctccacggagacatttctggtggatagaaggcaacataagtcagtttttatggaaaaacggaatcttcttgtttgctgaacatctgtccagcaagcacgtgtgagcacccccggctgagcaggttcccgccacgggcggtgctggtgccccctggattggtgtcttctcctggttggtgctcccagtccccagctggggctggggttggctgctcacgctcgcagctgcagaacttatgccccatcccatctccctcttcccagcctggtcagcccaaagcagtgactggtccatctaggggctgccttgcctccaggtgaggccaggtctggggtgccatgcctgctccggggctcccttgggataaggctgggctgtctctggccgagacccctccttgctgggctctcaggctctggtctgcggaacccagccccacacaccttttgcactgcttgctgtgaaaagctgatggatggggccactgagcttagaggagtggaagggcctgccctgtgacagaactgggacttgaacccagtcttggggattccagaatcagagcccttggcccactgccttcctagcatcgacttaatcgagactagagggacacctgcgagcagaatcttggcggtgcccacagcccaggatactgcctctctgggacctcagctgccggtgcacagctggcaccctagcctggggtcccgctccactgggagtccctctggcctcagagagttggcccagacccctccctagagactgggccagctggggctgggtcccctggctgctggctgcagctggggtcatctgacagcccactgccctcctgtctgtcctgactctgcctgctaccacagacatggtgtgagaatgagagggacagaggtggggtcccctttctccatgtctttcttccttccttccttccttccttccttccttccttccttccttcctccctccccctcctcgtcctcctcctcctcctctccttctccttcttttctctctctctcttttttgagatggagtttcactcttgttgctcaagctggagtgtagtggcacgatctcggctcactgcaacctctgcctcctgggttcaagtgattctcttgcctcagcctcctgagtagctgggattacaggtgtgcaccaccacacccggctaatttttgatatttttagtagagacagggtttcaccatgttggccaggctggtcttgaactcctgacctcaggtgatccacctgcctcggtctcccaaagtgctgggattacaggtgtgagccactgtgcctggcccctgtctctttcaataaagacacttctactggattaaacccaccagcgagtcagaacccttctgccggtgctcatccggcccctctattggccttcctctctcatgaggttgtcttgggccctgtcagtgcagggggcctggggtcggccaagtcccctcctcgggtgtcccagagcaagttctccaagcctctggaggagtctctgaacccctggctttagcagctcctgacttccagactgtaggcacaggatggtccctaaatgctcccatcttcaaaccggaaacaaagagggacccaccgcacctggaagacgatgacaaacgccagccgggctgccaggacggcccagaagtccttggagatgtcgtacttgttttccgaccacggcggctctcggtagtctttatacctgcaaaagaccgtggtggagtcgagggtgggacttcggtggggctcaggctctggctggagtcaggcagctcgagggacgcctgggagaggctcagcttggtgtgcggctgcctccgggagggcagccctctcttgggcgagcagcccatggccccgcacccacggagtctctctccacagtggagggggttggtcaggatcccccatgggccaggcaggacctgacgggcttcatgtaaaacacatgtggcaggaagtatccccaggcccagccgtgggctcacagaatcaagggtggggaccatgtggtccaggaggttgcaaacttttaaaagcagtggagcctttgttcccaaaaggtctcactggaaactccaataggccccaagagtgcagagcctacttggttgaagtcgggggggttccctaagcttgaacctcctgaacctcaacccaacgcccatgctccacagaacttcagaatgggttccatgaaacacccctccagtccatcccctctttgagggaatctaccaaagaaaaacctctgagcactttattagccaggtgtggtggctcgtgcctgtaacctcagcactgtaatctcaggctgaggagttagagatcagtctgggccacacagtaaaaccctgtctctgcaaaaaatacaaaaattagccgggcctggcagtgcacgcctgtattcccagctactcgggaggctgaggtgggaggatcacctgagcccgggaggttgaggttgcagtgagctttgatcacgccactgctcttcagcctgggccacaaagtgagaccgtctctaaaaaaagcaaaccaaacaacaaccaaaaaacacagcaaaacaataccctgaacattttatcaaagtaacttaagcagtttatcaaacatttgcgaaagaacgaagctaagcattccgctggtgcaggcagaggcgtgtcaggcagccggcctggcccgccctgccctacccgggtctggggctgcttttcctcctccagggttgctgcttggtcctcacctccttatcttgaaggaactgcccctggttctcattaccagctttagatgtagctgactgatctcctgcttggagagtcaagctcactcacacccctctccccaaggtcctgccactgaccttggctcttcgtggatatgattggagcctcaggaaggaggcttgccccattcatgaccactgcccgtgctccagttctccccagccccttcctcttttcacagagacccagagatgcccagggtctgtgggggcagggtgaggtctctgcctagggcctccctccctccacagctccctgaatctgggggatgccacacatcagctggaacatagcttgaatggagctgacgtccccaccctgcattggaaaagcttcccaaagctggacagaaaatgcccccatgaggggcaggatttccaggggctcaggggccgtttgtgcccctgttggtcactaaaacctgaggtcagtcggggaggctaggagaagggccacctggatttgcaggcacagccctggcctggacccacatccctggtgctcgcccactccgactaccaccttgctgtgtgtcccctgggcaatcacttgacctctctgggcctcagtctgggcattccctcacttacttatgtcacaagcatttattgaccaactactatgtgccagaccccaccccagggatggagaattccggggtggggggcggtgcacaacagatagggcccttgcctacggagcttgatttctggagggagctggatgggagtctccgagggcctattcagcactgagctgccaactcctgagataggatcaggctgggccacggctctggtgccagctgctgggccaggcagaagttgcacaacctgctttcccatgggaacaagcagccctgtcctcccagtgtcagaagccacacgcaccagctcgttcctctttattctgtgctcaaggctttgcctgctagcatctgtctcctcttcttcaagtcatagcaccccagttttccctaggacccccccattctctgtgacctcacaccctggcacatgacccaggccaagccaaggagagcccccctcctcatggcaatagtggttggttcaagaatggacatctgacccaagatggggcagtaagactcagtccctggattttcactgactattgggaaacagaaggtcttcccacaggggctgcagagcagaaaggattgaagccaggagctgctagggatccttttcatcagcaagagaacaatgcaacacagaggaaatcaaagtggagaggcagtgccagagtggagcctgatggcaaactgtagctcctggatccagccatgcctgaagctatcctgggcttcttagttacaggaactggtaaatcacctctaatttcctccccttaggcatttgtttatttctttatagatagggtctcactctgttgcccaggctggagtgcagtggtgcgatcatagctcactgcagcctcaaattcctaggctcaattgatcctcccacctcagcctcccgagtagctagaactacaggtgagtgccacaacgcccggctatttaaaaaattttttgtagagatgaggtctcactatgtggctcaggctggtctctaactcctgagctcaagtgatcctcctgcctggccctcccaaagtgctgggatgacgggtgtgagccactgcaccagcctttttttttttccttcttcttctttttaagcaagtttgcgttgtttcatgacttgctcctgatttgagccccgtccaaacccaggctctcccagaaacccaataaacgtggcttttcaaagaggggagcagagagcagtacctgcagatctgcacctcgtagcccaggtccagggggtcattgggggccgtgccgttctggaagtcactgacgttgaaggaggagagggtgtggttgacgaagccgtgcatggtcccgttcttactgtacatgtagaggtacaccaggcgcgggatgaagtcagacgtgaaggagatcacgaaggcctgtgcaggggacatggcagtgagggggacccccagcctgggcgcagaagggccggccgcaacagggggtgacccatccacagttacactggaccctggccatatgccactgcctctggcggggaccatagccgcacagcctcggcatgctgagtgaatggatgcagggtcgcgggtgttcctctcagccccctggcagctgaaggagagtgcctggtggccagaacagtgcacttctaggagagaaggcaccaggcagacgctggcagcctcttgctggctgtgtggccttgggcaaatcacccaacctctctgtgcctccattttcttcttgtcaaaacagggctaacaacacccacaccatgtatgcactgtgcctctgggcttgttggagaagggaatgaggcaggaagggaaagtgctttgcaagctctcaagtcctcacccggctcattctattatagcaccggctctggctggtgcccttacaagagaggaaaccaaggcccaacggctgcctctcacatggctgtgtggccttgggcaaatcacctaacctctctgtgcctctggtgtcttacctgtaagatggggccatggcagtcctcgccttcaagggctgtctgcagaccagtgggctagtgtgtggaaagagcttagaaggttctagaacattctaggtgcctcgtgaatgtttcctgctactactttttttttttttttcagagagagagacatggtctcactgtgtttcattatgttggccaggctggtcttgaattcctcgcctcaagcgatcctcctgccttggcctcccaaagtgctgggattacaggtgtgagccaccgggcccagcctgctgttattgttgttgctgctgttgtcctcaggagatgcccactgtgctccgcagctgctcacagcgccgcttgttgcaggcaggacgtacctctgttcccagctccacccactccagcacagcatgggccctgcctcagggccctgcgcgcctttgtctgggcgggataaggggccatcccggtgtgcacactctgcctgcagccttcctgtaatctggtgggagcgcatgcctggcagaaagcgttgcccaccgggaaagggcactgtcagagggctctgaggggcccttctccggggctgagtgtcaccccctgccctctgtggggactgagtcccagggcctgctgagaccctgacttggcatcacggccctgcaggggcgtcgaccgtcagctttggggagccaccccgtgtccctcatgtgcatggtgtcaacttttggcggggaggattgggctcagccagagggtggaagggacgagagccatgggcccctggcacagcagactccccatggctgcctcgggttttcatgtctaggatgcagccttgggcttgaagtatgtactggggacagctgggcacagctaaacccggggagatccaggccatgggcagagtcagacagaccccgatggggaaggctgagggccgggccatcctagcctgcaggcctggggataggagaggctggaaggggctgccatgctggggaggaggctgaggggcctggagccctgatccttagcagagccgtgtgtaaggctgatgagtgctcccttctcgccccatttcagcatctcccaaaccttctctacagagcagccatacgtttcagattaaggagaaaaatcaacttttttctttaaataagagaacagaaagattgccaataaggaatctctgtgtttctctccctctgtctctgtcttccctcctatctctgtctctgtcttccctcctatctctgtctctgtcttcccacctatctctgtctcttgtttattctcagtggacttaggggcgaaggtgggcatggtggagaattttgctcaaagcttgcagaaaggctgggcgcagtggctcgtgaatgtaatcccagcactttgggaggccgaggagggcgaatcacctgaggtcaggagtttgagaccagcctggtcaacatgtcaaaaccccgtctctactaaaaatataaaagttagccaggtgtggtggtgggtgcctgtaatcccggctacttgggagactgaggcacgagaatagcttgaacctgggaggcggaggttgtagggagctgagatcgtgccactgtactgcagcctggaccacagagtgaaactcagattcaaaaaaaaaaaacttgcagaaaaaggttgaagagaatttgttatgcctccccagagtgcaccctccccatgccatgcggtcaagggacatttataactagagaatccgggcagcctggggctgcaccatggctagaggcagaagacccatgcccagctccttctccacagggccccggccacctggcagttcagccgggacttccattctgccaaggtccctgatgtcacttacattgatgatgacagcaagcttcccaatgcctctgaggatattgtaccagattcctgggggaagaagaagtcacagttttaaagagccctacactctcagtcattccagctaccaggcagcagtctgagcgggtaccacccttgcaggggccaggctttctcacagcagtcagaggcttatggcaaccaagagtcatttgttcaggtcctgaggaagccaggccagtgccagggcctggtgtgtaccagccctttctgacaagctcaccagcttctaaaagaggtgcttaaagacagctgctccctcagtggttctgcacaatctccccatgcacctgtttaaatgctagttcgcttagatgaaaccttttttaattcctaaactgaccaagattcaattggggtgcagctcctaaagctctggcggaggatacctgtatttagggataggccagacatggctttgctgttgaggaacagtgccagggcccctggctggaggcactgagtccacagcagtgaaggttgaaccgttccctatctagacacacccttgttccctttactccaagacccaggggtgcaccaaatcacagatgaacaagaggatcacaacacagcgcccagggccatgctggtctctccattcgtcttcccagtggccatgagaactagcagggcccaggaaggaggccctcaatggcccaggaagcagggcctcagtgttgcaattcctagaaatggtccagtgtcccgggctgacccccgcctcaccctaactgcaccctatcatgcccagcaatgttgtgtgcagcggttcggctgggagcccaatcctggggcctgctctctgtgccctgagccagctctgagatgggtgataaccagcactcgtcagaaacggccaggatggagcaagtggacatcctacctgtgcaggaggctacagggagagctgtacatagcgcttctgccctagtagctgaggggagcctcccagtccccgtttttggggtgcatgctggtggtctgcaaaggcagcaagagctcaggcccctgtgtggccccgagctagaaaccacaggctcagatgaaacctctgagaccaagatctcttgctccctggccccagccagtgtcaattcaatgatagatcacagtcacaatcatcatcaatcagaaatgcccactgcgggctgggtgtggtggctcacgcctataatcccagcattttgggaggctgaggtgggcagatgacttgaagccaggagttcgagagcagcctcgccaatatggcaaaaccccatctctactaaaaatacaaaaattagccaggcgtcgtggcacatgcctgtaatcccagctactcagaaggctgaggcacgagaatagattgagccagggaggcggaggttatggggagccgagatcacgccactgcattccagcatgggcaacagagaaaggttctgtctcaaaaaaaaaaaaaaagagaaatacccactgcaacccattgctggtaggcaatttgagaagtgacagtcacacttccctgacccctgtctccagtcctcgggccatggggactatcgccttatcccagatgaggagtttattgtagctccgtttgatcttttgcacgagtgcagtggtcctcagtttatttttctgctggagcaggtggtggggcagtcacatgggctctgcacactagcagccctaaggccaccccatgctgaataaagcacctgggaatgcaggtgagggttggatggcacagccctacaaagtcagcactgaagcactcccttaggagtggaaacacttccgacccggcttctcctggctgggtgtcagggctgagggccctccgtggactccgagctcctaaggcagggtgctaattgcacatccctgtagattctgggtctagcttggtgtctggcacataaggtgggtgctgctgggtaaatgtttgctgagtgactgcacgagtgcagaaagccctttccaaccagattctggtgccggagcagaggctgcaaagcggtggcaggcaggccccatccaggcagcatggccatcttgttgtgcttgtctactgcttaaaaatgcagacggatgcttaaaaaccaggaaaatgtattttaaaaaatcaagaccgggc

SEQ ID NO: 205 - DNA, 10628 bp, Homo sapiens; identical to SEQ ID NO: 204

SEQ ID NO: 206 - DNA, 10628 bp, Homo sapiens; identical to SEQ ID NO: 204

SEQ ID NO: 207 - DNA, 10628 bp, Homo sapiens; identical to SEQ ID NO: 204

SEQ ID NO: 208 - DNA, 10628 bp, Homo sapiens; identical to SEQ ID NO: 204

SEQ ID NO: 209 - DNA, 10628 bp, Homo sapiens; identical to SEQ ID NO: 204

SEQ ID NO: 210 - DNA, 10628 bp, Homo sapiens; identical to SEQ ID NO: 204

SEQ ID NO: 211 - DNA, 8545 bp, Homo sapiens
gggagtcgcgctagaggaagcaggacccgggcaggagtgggggctgcagggatcccactgtgagtgggtgcatgggcaagcctgcatcagaaggatgtcttctgagctggggggcttggggtggatagtgaggaaggctgcagggagaggaaacagcaggggcaagggctgcgggggagggtgggagggggtgaggtgacagtcttgctgtggagggaacatggcactgggctgggctctgcacagttgtgtaccccgtcccatgcatgatgatgcatggattaagatttcatcctgggcaggcgcggtggctcactcctgtaatcccagcactttgggaggccgaggtgggtggatcatgaggtcaggagatcgagaccatcctggctaacatggtgaaaacccgtctctactaaaaatacaaaaaattagccgggtgtggtggcggatgcctgtagtcccagctactcgggaggctgaggcaggagaatgctgtgaacccgggaggcggagcttgtagtgagctgagatcacgccactgcactccagcctgggcgactgagcgagactccacctcaaaaaaaaaaaagatttcatcctgagggacatggggacattgtagctggggttctccagccagaaactgatttggaagtagtaaaacattgcccagactcccatgatgaccaggttttcatttcaataatgaaacatcaataggcacaaatatatagccagatgtggaatagaagcccatgtgtctagcccttggaaactataaatcgccaataaaattgcaaattggggagagagaagcctacaaaactcgtagaattcagattaataacatatttaacgtcaggtatgattactattttttcctttcttttctttcctctgttttttgagacagggtcttgctctgctgcccaggctggagtgcagtggcgcaacgatggctcactatagccctgaactcctgggctctagtgatcctcctgcctcccaagtagctggaactacaggaatataccactgtggccagctaatttattttattttttttaaattttattttgagaaagagttttgttctgttgcccaggctggagtgcagtggcgtgttctcagctcactgcaacctccccatcccaggttcaagcaattcttctgccccaacctcctgattagctgggtctacaggcatgtaccaacacacctagctaattttgtatttttagtagagatgggatttcaccatgttggccaggctgttcttgaactagtgacctcatgtgatctgcacgccttggcctcccaaaatgctcagattacaggcatgagccaccacaccggcctaatttatttattattattattatattttagagatggagtcttgctttgcagcccaggcttttgaactcttggcttcaagagatctcccacctcagcctcccaaagtgctgagattacaggcgtgaacgactgtgccgggctcagcatttttaattcattccaaacagaagtgcattctgtttaatcattaaacagtatgtatgatgctgttttgctgaaacaaaattgtagcttcatgtctacagactgtcatcaaggaggcgtgggagtttggaaggccttgtacttgccatgtgcctgggggtgactcaaatggtccacgatattctttttctatttgagccacacctcaaaaacttaaatcatatgtcatttggctttccatgaggaccccattcatgcattgaattggcctctgttccttggtgaccattactggggttggcatccatgattcttgccacggggtctcaacttagtaaatgattcaagaaactaagagcttctttgatggaagtatctttcaattgcaaatttccctgtaaaagagaagtcttgcctttatctcagcagacactgggggacgggtcactctggcatgagcacatgctaccccacgtcatgtttgcctgtctgattccaaatgcaattcacacaggatttgtgtggctagaaagcagtcagcaagatgactcagattaattatcacgggaataaaaatataaaacaaaaaaatatggacagagttcgtggcttctaagaagagtcaggggactgtgttatgactcagtttatttctggctgctgatgggagatgggctggatgggtggaaggcggggcagaggcggaagatgaattgcgaggtcactcactgtggttgtccagtggaaagggctgaggccccactgggagtgggggtggcggcaggtagcagaagaggtggatgggagagacacttgtgagttacaaagtataggacctggtgcttacttttatttttttttgagacagggtcttgctctgttacccaggctggattgcagtggtgtgatcatggctcaccgcagcctcatcctcctgggctcaagcaatcctcttgcctcagtctcccgagtagctgggagcacaggtgtacacaaccacatccagctacattttttttatttttattttttttagagatgaggtttccctatgttggcgaggctggcctcaaactcctgggttcaagtaatcctcccacctcagcctcccaaagtgcagggattacagatgagagccactgcacctggcctagcgcccagttttaattgagggaagagtgacagtggggagaggaaggagggtttgtggcttgggctactgactagatggtggtgtcaggcacggaacggggcgcaggttgcagggaggctgaatttggggtgtggcttgcatgactctgacagtgcccatgtgctaatccctgggatctgtgaatatgttcccctacctggcaaagaaattctgcagatgtgtttaaattgatgttgagatgggaagaggatcctgggttatccaggtggcccagtgtagtcactagagtttttgtaagagggaggcaggagaatcagtcagagagatgggaagatgctcatctgtgggcctgaagatggagggaggggccatgagttaaagaatgcaggcagcctctagaagatgcaaaaggcaagacacggattctcttctaggtcttccgggaggaaccagcttgctgacacctgatttgtagaccagggagagacattttggacctctgacctccagaaccataagataaacttgtgccgcttaaggcggtaagtacgtggtagtttgctatagcagccactgtgaggctgcccctaggcagttggggtctggggcaagagaaagatctgggctagagatacctggcaggtaccagggacctaggatgggtgaggctaagaaagggctgtgctccctagaggaggggtgaggctgaggctgggggagggtgtgagggacctgagaggaggacagcggagagggagaagagctcctggagagaatggtcacggaaggtgtcagaggccctagagattcaggtagaacaaaaatgctgcagcagcctgtgacttcagcaagaatagtttgtgtggggtgtggtctcaggagcaccagggagtgagtcctggagaggggtggctgtgagaatctgggagcgagtgtgagtgtggcgtggagggggcactgtgtaacagaaggcagaagggcaggcagctgggaggctgcgggaacctgaagaccagagggttgaccctttgttccaggaaacgcttgatcaaattcccctgaagtctcccgcaaagcacagacgtttggacttgtcttccctcttctgtcttaggggaaaaaggagtcagagagcaagagacggctgttacctccagctttcaattgctttaagaaatccatgtccaaggccgggcgcggtggctcacgcctatgtaatcccagcactttgggaggccgaggcaggtggatcacctgaggtcaggagttccagatcagccgggccaagatggtaaaaccctgtctctactaaaactacaaaaaactagccaggcttggtagtgcacatctgtagtcgcagctacttgggaggctgaggcaggagaatcctttcaacctgggaggtggaagtcgcagtgagccgagatcatgccactgtactccagcctgggcaacagagtgagactccatctcaaaaaaaaaaaaaaaaaagaatactttcccacgcaccccaagaaaatctcttccccaaagccaagctgctcacacttagggacagtgaggggcgatgtgtctattctctatagaactcaccctgacctgcgccttgagagcaggcatgcgccgggtcgggggtgtacagtgtgtaggtcaggccacgctgttttgggatagcaaccagctcagcgccacggcagcaccccaagctagtgatgaactggttaaagcttgtttctgctaggtttctgaggccaacagggcagggctacacttctgtcccattcactcctatggcctttgctcctagcaaggagtctggcacctggaagcgtcaggtgaaggtgtggaggggcttaaaggccggggtccacggcttactggggacagtgtcctgcggccttggctaagatcccacctatgggacggcacactggactttcccaaggtcatagctggtgaactgggacagagaatagccacttggctttgattctgatactgttggtggtgcaggcaaattctaagagcggcaaaagctaccctagcagaccactgtttgctaagggcagacactgctcatgagcagctagcgagctgtcaggaaatccagccacccctcccaggttggagcccttgacagggatcctcaaactggctgtactgggaatatccagcatatccaaaatgaaagaaccaccaacaggaatagaaaattttttgtagtatggaagttgtaaagctgtgttttaataggattaccttaggaataagaggactgctttttaaagatacgagatcccgctgccttggcaattctgttatcagaaagatagtgattttgatacaaaacagtaagaaactgtagaattgcaggacccataatcctcacaaggaagatttagagagtgctgtgtgtcaatcactcatcagcacctcacagatattatctcaattcgtcctggcaaccatcactgcccctacttagcagtctcagagaggagactcaactcacacaggggccaagagctggaccacggaaatgggacaaaacatcctttctgccaactgcaggggcagcagaacgccacagtggttgagcatgggctctggtgaaggatggcgggggttcaaatcccagttctccacctctctgcttcgctccgattcctgggcctctgagctggtctcctccgctgtggagtaacagtgtgactgctcatctgcacagattccttctgtgctggacacggttccaactttccaactactcccgcaggagctcatttagtggagacaagatcttgctcagtgtcatagtgaggaagaaatggaaatatctgtgcagggcccaagcccggcctggtgcgggagaggcattaataaacgcagcttgagttcagaagcaggtggtctgtggctcactcagcctggcttcctgctgggtcttcacagtgctgggctaccttcctggagagaaccaaagtccaggctgtgtagatgcctgtggtccaccagcgcaaagcagcggcccatcaggacgcttcggaggtagatgcgtctgagttccatgacatcggggacatggccccactcctgttctggaggtcacgggcctgctgaacctcttgtaccaggtcagccaccaggttcatctggcaggacctgagagcccccaccaggtgggccactgttgcgttctccttctctgtgttcttccagattctcagtgactcccgcacacgctctgtcaggttgcgggggtatctgtcctcgatgctgtcgatcttggtgtctgagactttgagctgacgagccagccttctccaatctttccccacattatcacatatgacgttaaatgctgcacacaggtctgggaaggaaagaacagaacggtttaccataggtttggagacaagcgaccccacaatcctccctagggcttttcagcacagacgccaagtgctgagtggacagaggtgcctacacgaggtcctctgtagaggctagagtcgcctggcagcaaaggggctgcaccaaatgcccaagagtggcctgattccacctcagccaaaccccctgctctctaatactgtcctaggaggcgtggcccactgaagactcaagtgccaaaggaagttgtagtggagctacctacttagagcaggagacactgagggaggggctggggagttgtgggagggaagaaaatagggttgatcccacatcctgccctacagcaggctgaacgatgtcaccccaaggtatgttcacgtgaaattgctgaaaccatgaatgttctttggaaaaagcatctttgcaaaggtaagctgagggtcttgagaggagatcatcctggatgacctggatgcaccaatgataggtatccttgcaggagacacacagggaaggccgtgtgagcctggagtgaagcggccacaagtcaaagaatgcctggagccaccacaaagcggacgagacccggaaggagcctccccaacagcattccgagggtgtgccggtctgtggcaccctgcttattcagatttctggcctccagattgagggggtagatttctattgcttcaggccaccagatttgtgatcatttgttatggcaatcacaggaaactagtaggcactccaattgttatttagaaagctgccccgagtgaccaccagtcttcagtccctggctaccatactcctcatctgctgacgtcaccactgagatcagggagctggtcacaagaccataaaaggccgcttctggaatgtgaagagaggaaaggagaggcaggacagggtgctgcttggactactggcaattctgagacaccgttggcaggtgtaccagctcccgcagctctgacagccctgtgggctgggcactgtgttaccatgactgtacagatgaggaaattgaggcacagggaagctaatggacattcctgagatcgtgtagctagacgatggcagagccatgttctgaaaccctaagagtgtggtgccagagtcgacccttaaccgctatgctgaacttctggggaggaaggcagagtcgcccgctaccaacctgtccatacccaccgctcaccttctggtgtacttttcccagcacacagtaactacatgacgatataaataaaaccaagcacacatacatctcaaatgtcagctatgtttcgtagaccgcctttaaaatgcaatttatcagtgtttttccagacattaaatatccataaaacccgatttttctacgtcctgttttgtttgttcagtactgattttttttaaaatctggacttgactgctctcaggcagagagctgttctgtccatcctgtccccaacaggcaccagtctttacagagtgaaacccatggtgacacatttaggccctatctgattggtgactgaatggctgattccaagctacagcttgaagcctctgagaggcgtccccagagcactcccaagcctctcccgactctgagaacaaggggggtagggctgagaaactctgctgtactcagggtttcttttttatcctggaagctgctgcaatccacaggcgagggtggagagggagtgaccgagagcaggacaggaagccactccacaatgaacttgaccagagaggcagtgtagtggctaacactacccatccggaggccggactgcttggctcaagcctagctccgtcagttatcggctgcgcatttcgacaaagccacttaacctgtgagccacagtcctgtcctctgtaaaatgggaacagtgatagctaacagtatctaagccacagggctactgcgaaaattgtatttggcagttacaagggtaagcggcacactgtaagcccctgggtaggagttactgaatgctagtattactctcagacagccgtgaaaagcatattccgagacagaaaggaaatgatgcgaggcaggctcacccaacctctgcccctcccccacaccttctctgactcatcttttcttcagtgagttttctaatttacccgggcagaagtgggtggaggaaaaaggactgtgcgtgtccacgccctgcaacctcgaataagttaacttttctgcgtttctggctctcccatctgcaaaaccagggctgtacggagaaaacccacgcaaatcaaacccggcaaaggggaggcgcctggaggccaaccggaggagcctcgcagcacctacagccgggcgaccaggccctggctcccccggcccggccccgcgcccaccttcttccccaggcgcggccccggccgccgcccccgcctcgaagtcgtcgacgcgccgcagcaggtcgttctgctccagcagcatggagaagaggtctaggccgctctgcacgcgctccagcttgcgct

SEQ ID NO: 212 - DNA, 8545 bp, Homo sapiens; identical to SEQ ID NO: 211

SEQ ID NO: 213 - DNA, 3095 bp, Homo sapiens
caggaatctgaaaccctggggcggaggcatcttttgctttcctgcttgcaaggaactcaggcccctgagagacgctagtgggcctttgatcgctgctgtttactcattcactcagcaaacacaaaataagccttcactcagaagccgctggaaagtgctggaagcagccctcagggagtcgcgctagaggaagcaggacccgggcaggagtgggggctgcagggatcccactgtcttccgggaggaaccagcttgctgacacctgatttgtagaccagggagagacattttggacctctgacctccagaaccataagataaacttgtgccgcttaaggcggggaaaaaggagtcagagagcaagagacggctgttacctccagctttcaattgctttaagaaatccatgtccaaggccgggcgcggtggctcacgcctatgtaatcccagcactttgggaggccgaggcaggtggatcacctgaggtcaggagttccagatcagccgggccaagatggtaaaaccctgtctctactaaaactacaaaaaactagccaggcttggtagtgcacatctgtagtcgcagctacttgggaggctgaggcaggagaatcctttcaacctgggaggtggaagtcgcagtgagccgagatcatgccactgtactccagcctgggcaacagagtgagactccatctcaaaaaaaaaaaaaaaaaagaatactttcccacgcaccccaagaaaatctcttccccaaagccaagctgctcacacttagggacagtgaggggcgatgtgtctattctctatagaactcaccctgacctgcgccttgagagcaggcatgcgccgggtcgggggtgtacagtgtgtaggtcaggccacgctgttttgggatagcaaccagctcagcgccacggcagcaccccaagctagtgatgaactggttaaagcttgtttctgctaggtttctgaggccaacagggcagggctacacttctgtcccattcactcctatggcctttgctcctagcaaggagtctggcacctggaagcgtcaggtgaaggtgtggaggggcttaaaggccggggtccacggcttactggggacagtgtcctgcggccttggctaagatcccacctatgggacggcacactggactttcccaaggtcatagctggtgaactgggacagagaatagccacttggctttgattctgatactgttggtggtgcaggcaaattctaagagcggcaaaagctaccctagcagaccactgtttgctaagggcagacactgctcatgagcagctagcgagctgtcaggaaatccagccacccctcccaggttggagcccttgacagggatcctcaaactggctgtactgggaatatccagcatatccaaaatgaaagaaccaccaacaggaatagaaaattttttgtagtatggaagttgtaaagctgtgttttaataggattaccttaggaataagaggactgctttttaaagatacgagatcccgctgccttggcaattctgttatcagaaagatagtgattttgatacaaaacagtaagaaactgtagaattgcaggacccataatcctcacaaggaagatttagagagtgctgtgtgtcaatcactcatcagcacctcacagatattatctcaattcgtcctggcaaccatcactgcccctacttagcagtctcagagaggagactcaactcacacaggggccaagagctggaccacggccaaccaggggcagcagaacgccacagtggttgagcatgggctctggtgaaggatggcgggggttcaaatcccagttctccacctctctgcttcgctccgattcctgggcctctgagctggtctcctccgctgtggagtaacagtgtgactgctcatctgcacagattccttctgtgctggacacggttccaactttccaactactcccgcaggagctcatttagtggagacaagatcttgctcagtgtcatagtgaggaagaaatggaaatatctgtgcagggcccaagcccggcctggtgcgggagaggcattaataaacgcagcttgagttcagaagcaggtggtctgtggctcactcagcctggcttcctgctgggtcttcacagtgctgggctaccttcctggagagaaccaaagtccaggctgtgtagatgcctgtggtccaccagcgcaaagcagcggcccatcaggacgcttcggaggtagatgcgtctgagttccatgacatcggggacatggccccactcctgttctggaggtcacgggcctgctgaacctcttgtaccaggtcagccaccaggttcatctggcaggacctgagagcccccaccaggtgggccactgttgcgttctccttctctgtgttcttccagattctcagtgactcccgcacacgctctgtcaggttgcgggggtatctgtcctcgatgctgtcgatcttggtgtctgagactttgagctgacgagccagccttctccaatctttccccacattatcacatatgacgttaaatgctgcacacaggtctgggaaggaaagaacagaacggtttaccataggtttggagacaagcgaccccacaatcctccctagggcttttcagcacagacgccaagtgctgagtggacagaggtgcctacacgaggtcctctgtagaggctagagtcgcctggcagcaaaggggctgcaccaaatgcccaagagtggcctgattccacctcagccaaaccccctgctctctaatactgtcctaggaggcgtggcccactgaagactcaagtgccaaaggaagttgtagtggagctacctacttagagcaggagacactgagggaggggctggggagttgtgggagggaagaaaatagggttgatcccacatcctgccctacagcaggctgaacgatgtcaccccaaggtatgttcacgtgaaattgctgaaaccatgaatgttctttggaaaaagcatctttgcaaaggtaagctgagggtcttgagaggagatcatcctggatgacctggatgcaccaatgataggtatccttgcag

SEQ ID NO: 214 - DNA, 3095 bp, Homo sapiens; identical to SEQ ID NO: 213

SEQ ID NO: 215 - DNA, 3095 bp, Homo sapiens; identical to SEQ ID NO: 213

SEQ ID NO: 216 - DNA, 3095 bp, Homo sapiens; identical to SEQ ID NO: 213

SEQ ID NO: 217 - DNA, 3095 bp, Homo sapiens; identical to SEQ ID NO: 213

SEQ ID NO: 218 - DNA, 4221 bp, Homo sapiens
cacggggtctcaacttagtaaatgattcaagaaactaagagcttctttgatggaagtatctttcaattgcaaatttccctgtaaaagagaagtcttgcctttatctcagcagacactgggggacgggtcactctggcatgagcacatgctaccccacgtcatgtttgcctgtctgattccaaatgcaattcacacaggatttgtgtggctagaaagcagtcagcaagatgactcagattaattatcacgggaataaaaatataaaacaaaaaaatatggacagagttcgtggcttctaagaagagtcaggggactgtgttatgactcagtttatttctggctgctgatgggagatgggctggatgggtggaaggcggggcagaggcggaagatgaattgcgaggtcactcactgtggttgtccagtggaaagggctgaggccccactgggagtgggggtggcggcaggtagcagaagaggtggatgggagagacacttgtgagttacaaagtataggacctggtgcttacttttatttttttttgagacagggtcttgctctgttacccaggctggattgcagtggtgtgatcatggctcaccgcagcctcatcctcctgggctcaagcaatcctcttgcctcagtctcccgagtagctgggagcacaggtgtacacaaccacatccagctacattttttttatttttattttttttagagatgaggtttccctatgttggcgaggctggcctcaaactcctgggttcaagtaatcctcccacctcagcctcccaaagtgcagggattacagatgagagccactgcacctggcctagcgcccagttttaattgagggaagagtgacagtggggagaggaaggagggtttgtggcttgggctactgactagatggtggtgtcaggcacggaacggggcgcaggttgcagggaggctgaatttggggtgtggcttgcatgactctgacagtgcccatgtgctaatccctgggatctgtgaatatgttcccctacctggcaaagaaattctgcagatgtgtttaaattgatgttgagatgggaagaggatcctgggttatccaggtggcccagtgtagtcactagagtttttgtaagagggaggcaggagaatcagtcagagagatgggaagatgctcatctgtgggcctgaagatggagggaggggccatgagttaaagaatgcaggcagcctctagaagatgcaaaaggcaagacacggattctcttctaggtcttccgggaggaaccagcttgctgacacctgatttgtagaccagggagagacattttggacctctgacctccagaaccataagataaacttgtgccgcttaaggcggggaaaaaggagtcagagagcaagagacggctgttacctccagctttcaagtaagcccaagatttgtgcgtaccttttccagaaacacaaattctacctgattgtaaaaaaaatgaacatagaatttgttttttcaagttgctttaagaaatccatgtccaaggccgggcgcggtggctcacgcctatgtaatcccagcactttgggaggccgaggcaggtggatcacctgaggtcaggagttccagatcagccgggccaagatggtaaaaccctgtctctactaaaactacaaaaaactagccaggcttggtagtgcacatctgtagtcgcagctacttgggaggctgaggcaggagaatcctttcaacctgggaggtggaagtcgcagtgagccgagatcatgccactgtactccagcctgggcaacagagtgagactccatctcaaaaaaaaaaaaaaaaaagaatactttcccacgcaccccaagaaaatctcttccccaaagccaagctgctcacacttagggacagtgaggggcgatgtgtctattctctatagaactcaccctgacctgcgccttgagagcaggcatgcgccgggtcgggggtgtacagtgtgtaggtcaggccacgctgttttgggatagcaaccagctcagcgccacggcagcaccccaagctagtgatgaactggttaaagcttgtttctgctaggtttctgaggccaacagggcagggctacacttctgtcccattcactcctatggcctttgctcctagcaaggagtctggcacctggaagcgtcaggtgaaggtgtggaggggcttaaaggccggggtccacggcttactggggacagtgtcctgcggccttggctaagatcccacctatgggacggcacactggactttcccaaggtcatagctggtgaactgggacagagaatagccacttggctttgattctgatactgttggtggtgcaggcaaattctaagagcggcaaaagctaccctagcagaccactgtttgctaagggcagacactgctcatgagcagctagcgagctgtcaggaaatccagccacccctcccaggttggagcccttgacagggatcctcaaactggctgtactgggaatatccagcatatccaaaatgaaagaaccaccaacaggaatagaaaattttttgtagtatggaagttgtaaagctgtgttttaataggattaccttaggaataagaggactgctttttaaagatacgagatcccgctgccttggcaattctgttatcagaaagatagtgattttgatacaaaacagtaagaaactgtagaattgcaggacccataatcctcacaaggaagatttagagagtgctgtgtgtcaatcactcatcagcacctcacagatattatctcaattcgtcctggcaaccatcactgcccctacttagcagtctcagagaggagactcaactcacacaggggccaagagctggaccacggccaaccaggggcagcagaacgccacagtggttgagcatgggctctggtgaaggatggcgggggttcaaatcccagttctccacctctctgcttcgctccgattcctgggcctctgagctggtctcctccgctgtggagtaacagtgtgactgctcatctgcacagattccttctgtgctggacacggttccaactttccaactactcccgcaggagctcatttagtggagacaagatcttgctcagtgtcatagtgaggaagaaatggaaatatctgtgcagggcccaagcccggcctggtgcgggagaggcattaataaacgcagcttgagttcagaagcaggtggtctgtggctcactcagcctggcttcctgctgggtcttcacagtgctgggctaccttcctggagagaaccaaagtccaggctgtgtagatgcctgtggtccaccagcgcaaagcagcggcccatcaggacgcttcggaggtagatgcgtctgagttccatgacatcggggacatggccccactcctgttctggaggtcacgggcctgctgaacctcttgtaccaggtcagccaccaggttcatctggcaggacctgagagcccccaccaggtgggccactgttgcgttctccttctctgtgttcttccagattctcagtgactcccgcacacgctctgtcaggttgcgggggtatctgtcctcgatgctgtcgatcttggtgtctgagactttgagctgacgagccagccttctccaatctttccccacattatcacatatgacgttaaatgctgcacacaggtctgggaaggaaagaacagaacggtttaccataggtttggagacaagcgaccccacaatcctccctagggcttttcagcacagacgccaagtgctgagtggacagaggtgcctacacgaggtcctctgtagaggctagagtcgcctggcagcaaaggggctgcaccaaatgcccaagagtggcctgattccacctcagccaaaccccctgctctctaatactgtcctaggaggcgtggcccactgaagactcaagtgccaaaggaagttgtagtggagctacctacttagagcaggagacactgagggaggggctggggagttgtgggagggaagaaaatagggttgatcccacatcctgccctacagcaggctgaacgatgtcaccccaaggtatgttcacgtgaaattgctgaaaccatgaatgttctttggaaaaagcatctttgcaaaggtaagctgagggtcttgagaggagatcatcctggatgacctggatgcaccaatgataggtatccttgcag

SEQ ID NO: 219 - DNA, 7090 bp, Homo sapiens
cctgaacaaggcctcctcaggacggccagacacccagccccaccctcccctcacgctggggtcagggggtgaagagatggcacacaggacacatgtctgggcacagggacgtgggatctgcctccctgtggcctggccatgaatctagtgcctcagggggtgactgactcagtggcgggaggaggtgcgtgtgggtatgtgagtgtttgcatgcgcacactcatctgcatgggtttttttaggcagggtctcacttgttgcccaggctggagtgcagtggggcgatcacagctcactgcagcatgaaaatcatggactcaagcaatcctcccgcctcagcctcccgagtagcaccaccacgcccggctaattttttatttttattttttgcagacagggtcttgctatgttgcccaagctggtctcaaagtgatcctcctgccttggcctcccaaagtgctgagattacaggcatgagccactgcacttggctggcatgaatctctttgaagggatggggacaggggacaggtcagtatgtgagtccccagcccccagctgtggctgccatctgcaggacactctctgccactcggaagcatggtgggcagaaacagccaggggagcggctgactgtgccctgctggagaccctttggctgcacgccctgccctgggctggaagaaggaccccactgcccccacatgaacactgcagaggctgctgggctccaactcactggcccctcccgcacatacccctgcaccagtcctagccccagtctgccactcaccatcacagccatgagtacccagaggtgcccaggaacatggttgacatggaacgcggggaaccccccaaggcccaaaccacctgcgaggagggaagataccactgaggcccagaagtttccccaaacactatccttaggagaggctggattccttcctaccaggcaccctccgtggtcctgccccatcccatttcacagatgggaagaatgaggcctgctcagggtacaataaggctggggccccaggatccagagtcctggtcacccagccaggagccctccccgcactccctttggcttacccaggccagcagtctccacagagtgtatctcgagttgccatgcccacctgggcctccagcctcctccaaaggctgcaacgggcatggggctggcatgggctggagccccatgcagctgagaaggtgcctggggggcagggcctgcataatgtgccctgccctgggtcctgtgggaggtaaagggtgagagcatggccaggagccaagcctgaggacccttgggggccaggcacaggactctgcccctggccctcagggccctcccaggacaggcaggagagcagggcaatgctcaccaggtcgggctcctccccaggtgggcactgccaaagggttgttgatgtcagggtggcgagaggccagggcagcagctagaagaacagtaggcattgaaagaggcagaaagtgctgggtgtggggtctctggggtcatctatcccccacctatttcctgaaaccccagtggtagggaccactgactaccccacccgggcttcagggacacactcttctaacctcaatccctcacactgaggaaaacctgtcctgtcccagacctgctgcaagaccagtacctgggcaaggagagagccacatctggctctggaaagtgctggaaagccccagataaggccacatcaggatctcaagcccttccagctaaccagaacgatgaggaggaaatgcttccgaatcctctctcgtattctgcccccacttcctcctactttgggtccatccctggccccatcacagctgggcatatcattaaccagcctcatttataatccctggagccaagtctgcaggtggcgcttcctattctgggctctcccttcagcgaaagtctccaggaccacatcctcctctgcaatcttccctcaaggcgaggctaccccattcacacccacacacccaaacagggagacgcatcccaaaagaaagctccatcttctcagtgtgtgtccccagcccatttcactaggagttctctctgcttcccattcttaggaatgaactgtctctcctgaatccctcctagagtcccccaatttggcctaggctggatgaggctaccatcagctgccctggagatggaatagggatctcctcagaccccagagcggctcccagcacctgctaaggctggaaggcctcctgtacatggagcaacccttagcaaggcccaaggccaagtctcaccctccctgagcttctagcgtcacagcagaaagatgggccccagggcagaccccaagatgctgcaagtctgtaatgtggacttgcctgcagctccgggcagctggcctgatcctgtgatcctgggacctggaatctgggatcccccagaccaatacagatcttgaaccccagcacctgaggtgctatggctctcagggtccaaatcccaggcctcttttgcccagtttcctcttggtgcccagcataccctctgggctgggctccgttctcatgcctgcgtgccaatgggcatcttgccctcagccatgcctgccttgcccataaatgccagcaagcccttcattctccatctccctgacaagcctgggtgggcccagaggtgcttcctagggtccagctgcctcagattcttgacgagctgagtaactgagccctgcccagcagggggttccccgggagtgtctgcaccctcttgctggagggctgcagggctgagggtgcggcttttctccttcccagggcccatccccagctcaccataaggaagcaggacaggggccggcacagcagacttggcttcatcctcaggcccctggtggtcgccggcctagggcagatggagaggaggctcggcagagcggcagggacaggcaggcagctgctgtcccctcagcaccacttccaggatgacaggactcatggggagcaggcaaggtgctgctgggcaggcagagcccggggaggccgcacaggcaggaaggcaggaagaaggctctgcaggctgggaggcttcccagaggaggaagggcttccttccccttccttaaactgccaggtgccccgaggcatcagcaggggaaggaagcgcgtgtggcggcctgtgtccgtgatgacagggttgcaaccaacacccaacaccccagcccggcctccacactccagcccagcgctccaggctcaggctccccccgcctcctcctcacaggtctgcaagcatgcccggcctctgccttcactcctgctggttctggtccaaggaaggccttttcctttacccttcaaagctcaacacgaaggcctctctttccagaagcttctctagaagctttccccaaagtgggtctggctcccacagctccccaccccatctaggtcctggtccttctgcatggccactgtccacacctcttccagggaggctgactcctcccttgaggctggaacatgtctggccacagctcttcccctggcagacctatggggctggggtggtcacggcagccagtgctctgtctttgtcatctctccagcacctactgcgtgcgggcactggagaaatcggtatgaacaagacagacaaggtccctgtctgcagggagctccatcccaggggagacccaactgcaaacagagaggtgcccctgccatttggtggtaagtgccaagaaacgaaataaagcagagtgggagtgcagtgtgtgatacttcagagaaatatccatggtggcgtcacggcccaccggtctgagactgaggcccccaggcccagacggtggcctgctctggagaagcctccggccagtggacgaggcggacacagcaggacaaaggattcacatcagacagcagaagggacaggtggcagagcaaggaagtccgctgtgtacttcctggaggcctggcttcaggggcacgaggctgaggaaagccgtgctcttcaggccacacgcagcctcttaagcccaggggcagcctgggaacccagccactggctcagggccgccgcggctgaggcccccgctgtgactccaaggccggtgaggtgagaaaagcgcctcctgtggtagtcccaaatcactcagagtcctctccctgcaggcagcccggccctcccacctagaatagcagcccaggaaaccgatctgtccacccgccctccctcttggcagatctcagaggggcccagggtttgagttacactcaggggagggagtgggcagcagttacatcatctcaggactctccaggtcactggcagccactctgggtcccaggccagctcaggggaaagccagggacaggagaaggtagggccacagtatagggtggaggccacacctggcagtcaacacccaacagatggcacccccaggctatttggggagggtcccctgtcactccttaaatttggtcacaagtcttccttccagtttctgccccaaagtgtcctgtgcccttgtcagggcccagctcccacctcgagcctgtctccccatggcccctcctctgtcctttgagggatctaacccacagacctgaccacgagccccaagtcctcaggcttcacttccccactaggcctgactacgcaagacagagcctgatgctgggggtgggggcaggctgtggcaggcatggtggctcacgcctgtaatcccagcactttgggaggcagaggcaggtggatcacgaggtcaggagttcaagaccagcctggccaagatgctgaaaccccgtctctagtaaaaatacaaaaattagcccagtgtggtggtacaacttgtaatcccagctactcgggaggctgaggcaggggaatcgcttgaacctgggaggtggaggttgcagtgagccgagattgtgccactgtactccagcctgggcgacagagcaagactccatctcaaaaaaaaaaaaaaaagacaaagccagggggaaccgtgaccaacccaacagcccagcccccagctctagcagccctccatgtccccaaggtaggcccagagggctgatgcgggggtgaaaagaggccaagcaaccacagcagagagccctagaaccaccccaaccctgggtggcacctgctaggtgacctgagcccacagggagcagctgtgcagctgctcatctgcagacagacgcagagctgtgtgatctagaaccttccaggaagaaagcggggtccaaaggcccagactcaaagccaacgagggcccactccagcacacgcatagacactgccacctagggccttgcaccttctaattacgcaccttctcattaccccaaaccagcacttactccagtctggctgcccggcccccacactcagcccagactgagcccccactggacttgcccggtcaggtagaaaggcctggtgcacacacatgtccacacctgctgctcagcacccctcacaccctgccccacaaggcctccactgtctaaaacggccctggaaccgtgaccaaaaaaacagttagatggaagccccctcggctgggaggggatatctgaaggtcccatatccgtctctgcctcatcctaaaggctgggcagtcagtgaggccccagagcctccgatgcctgacagaggagagccacacccagccacactggatggggaggaggggccccaggggggtagcagagaaggaacttggcttagaggccactcctcccatgtctcctagcctggggcccagtctccactgccaccaactccctttgggaccttcacatcactgggtctcagttttctcatctacagagatggggacgttcatcttgctggcatggctgtcgcgaagtttttggggaatttctgttttgttttttctgagacagtgtctcactctgccatccaggatggactgcagtagcacgatcacagctcactgcaactttgaacttttaagtgatcctcctgcttcagcctcctgagtaactaggactgcaggcatgccccaccatgcctggctaaatttttaaatttattttctgtagagacggggtctcattatgttgccctggctggtctccaactcttgggctcaagcgatcctctcgccttggcctcccaaagtactgggattccaggtgtgagccgctgtgcccagccagtcatggggtttaaaggaggtaatgaagctaaagtaggtcatgggatttccttctccacagcccttctcctctgccctgctggcagagggctgtgattaagtatttgtttgcttacttgtttattccttgctcccccaccagacagtggtgagggcagggacgtctgttttatttgccacaaaactccacacccagccccatgtctgaagcgggaggcctccaagcaggctcacgaggcggggagggtttcctcagactcagctctccaaaaaaatgcccgaacaatgagaaccagaaattccctggagaaaagccaactagcaaaggccacggccagacccccaagctgagggccccagaccacgattgaggccacagatggtggagccccagggaggtgcagcctggaggcctcagagaaagaggaagctgtgccaccagcccaggccacaggcagcttcccctttcccagaactgaagctcgctggggtcacccgggccctgccacgccactccccctcccctaggcagggccctccccttccctacagtccctaagctctcccaaggcctgcgcccattgctcttgcccccttgccctgtctctggcctccaggtcagtcccgccctgcagcctaggtgccctgacacccagttctggccctggccctgggccagctcccaccaccctcaggatggcgtcgtgacgcgcccccaccaacctcccccacccacacgcctgccacgctgagtgctttccaccctcacacacgctgcacctgctttctgctctcccctcatcgcttggccagcacccactcttccttagagctcagctcgaagtcacttcctcctggaagtaccctctcccccacctccccctcag

SEQ ID NO: 220 - DNA, 7090 bp, Homo sapiens; identical to SEQ ID NO: 219

SEQ ID NO: 221 - DNA, 7090 bp, Homo sapiens; identical to SEQ ID NO: 219

SEQ ID NO: 222 - DNA, 6255 bp, Homo sapiens
taggcgcctcctgtgtgccgggcattgtgttaagtgcggggatgcagcaggacacaggcagacaagggcatgctgtcgcagaggtcacagctggagtgtcaggacaacaagccccgtgctgcagggactggggaaaagatgggtgaccgccccctgcaaactgtggagcatggagctcacacacgtcagtaacttctccttcctctacagccaggaaacctgggttcccatgtgagccaagctctgtcactgtcctgctgggtggccttgagctggtcacttcccctctctgagccccagttttcttgtccataacatggagcagtaatagctactctggagggaagtctgaaaagtaaatgaaatcatacatggcagtgccaggcacacagtaggcactcaggagaaggctaatccgcatccacatctgggacccgcacaatccaacaggcttattatctcccaagactttaacaagcaccagggtgagaataacagggtaatccctccaatggcctccaggcagcaggaaagctccacacagggcagtgatggggcactggggggcagcaacactggctggaccaacctctagaccccaccccacccctaactcacccacctctgccacctgcactgccactcacacaccagcaactccagtcctcacggacgggtgtttgagatgcaacagcacagacctcttaccaccctccccacctgagtcaggatggaggagcgtggcctcaagaccccctttgggtcctctcggtggccccacacccgggcctggcttattttactgcccattcccacttggtgggggagctgtcacaggctgaacttcagggccaggaggcctgggttccagcccagtctctgccttctctgagctacaccttgtaaagttaggatgacttcccacctaacggggctattgcaaggattaagagagatggatacagatcgtatgcaagttaacatgccttcattactagaatctgtgctcagtgctgggttccaggcactgtgttaggggcctctcctgcccttcctatgtggcgaagcaactacccaaccgactaggatctagtcccagctcggcccccactgactgtagggcctcaggcagctcacttaactgctcagcctgttatctcacctgtaagatggggacaatccctacctaactagccaagctgttaggaagcttggataaaattgtacatattaagtatttggcacataggaagagcaaaacacaaaggcgtaccagctggttgcactcaaagcattattctgatccagaaatgcctactcaccctttaaagcagcccccatatcacctcctcctgggagccttcctcgatatgtgcatgatgctaaagctaggtgcaggatttgctgcaatagacaaacagccatggaccctctcttcatggagcttccattctaagaggggaggcaggcagggaagtcttaagtgggtaatttcatagtgctaaggagtcagtaaagtgagaaatcatggtagagaaactgaggtgggagagggactgcttgtgtagggtggtcagggaaggcctctctgagcagacgtttacgctgaatcctggatgacaaaaagcaaccctgcaaacatctacaagaaccgcctgccaggcagaaaggacagctagtgcaaagtccctgaggcagggggacaagcgtggcacacctggaacagaatgatccaggtgcctggaacacagtgagcactgagtaccctatccctaagtctccacctctagacaaagccccttgaggatagagatctgaatgattgagccgaagcacaggatggccctgggactctgagcagtcttgctgaaactctgtcgtggcaatgatgggagtgaatcagctggcccttctgcagacccatgtacatcttggtggctactgctggattgctcagccaggtaaggggtcccttcctgaaccaacaacccccaggtcacaatctttggcagaggaaagctggacgtgcccagagagaaaaatgacctgtcctaggttaaaaggccagcaggcagcagaaatgggcctccagcccaatatcctctgctcctctgcctccctggccactggctctgttccgtgcatccctctctctccctaaggtacggtgtcaggagccctaaggaccatgaggcatccaaccggaggactgtgtcaaaaaggaccgtgttgggtgcctcctcctcccctgctacaaatccaacacttcgggccacctaagggcaaggatccccacaatctccttccaaagcccagcccaaagccaggcaacttactaaatgtgtgcctgagtttgtacctgtagccctggatgtagcatgaggtcagcgtgcaaggaaaggctaggggagctgggcatagtggctcatgcccatagccctgcctgtagtcccagctactcaggaggctgaggaaggaggttcgctggaacccaggagtttgagtccagcctgggcaatatagcaagattcacatcttaaaaaaagggtaaagaaagaaaggcgaagaggctgaagactggctccaggtccagtgctctcattcaggtcctgcagctgctacttctccagggctgccagagccagaaccatttcccgggtcagcacggaatgcacctgccacttggcgctgtctgcacagtgatctgccagcgatctgccagcattccagggcctgatatgagccatcagtagcgagtctgccttaacaggagaccttgtcccctgggaagaatggtgtaagaatctcctgatccaatcttcttccacgctccaacaaaatgtcattggaaaagttttattgaaaaaaaaaatgtacaaataagttcttggattgatagcaacaaaggctcatgttcccccttccctccctatctttgaagaactaaaaaaggaagaaacaaaacaaaaagttcatccccacaacgccagacacgatgcttcttgaccagagtctgcccagaagcccctcctgggagctccttctcaatccgcctcactgcggccaggtcattctgggggtgcctggtcccaggggctgcagcacctagttttatagttgggagaggttgggatagagctggggaggcagctgaggtgttttagtgtcagaagagggctggctgacccccctagctcaatttggtctcacaggtgagaaggtacctggctataaatatgaatactgattgaggcaggcttgatctgggactttcagggcaggcagaatgactatggcccaggtcccacaggatgtggagtttccgggctcagcatcatggtatctggggcccatgtccaagtggagtgaattctagctgggaaggtccgctcaggcacacgggaaccccggtctgtttttccacccccaccccatggagtatccaaggctggtacctcacctcccccccaaccccaatagcacccatgtgtctcaggagcctttggatgcctcctgccatcctgtgtgcaccctgaggccctataactcgtctcgcatcttgtcacccttaggccggaccaggcgcccaatgaatagcagggagccgctttgggtgtcccgcactaggaagatgaaggggtggtcggcgtagaacagcttggggctgcgcagctcctcgcgcccgtagatgtcctggtcaaaggggttgccatctgtgtccaactcaaaggcggtggcgtggaacacgctggccaggtacaggtccttcttgcctgacatgcgtgacaagtcggccttgttcttgtcaatggcctcagtcaggcccagcccagccaggtgtttctgtgggaacaaggaggtgtgccaggtgaggccatggctgccaggctcctccaccctcaaaccctccaccccatactaccctgaccgctcctcagagaggagagaaccaccccctggtcaccttctgtatgccaggcatggcactggcacttcaaatcacagctttctcaattctcactgcaaccctacaagggcttctaattgccacttcacagatgaggaagctgagactcagaaaaacaagtgagaacgtatcccggcactgcccagctgcagttcagggacagacagcatgggcaccacccaggagcttatctcaaatgctcatgtcctgaccccagcccagaccccctgaatcagaatctctgggagtgggcatggattccttttcacaaactccccaagtgctttcttagcatactcaagtttgagaaagactgatctaaggacaactatgtccacatcactctggggctgaaaacctgtccagagtgataggatgcctggaatttgcttcagaataatcagatgcaggggggaattagtgggtataaatggatcactattggccatgagctgataatgcttgaagctgggcgacagacacttgaggtttcattacactaatctacttttatttttccaatgttcgatagtaaaaagttaaaacacatatacacacatacacacacacacacacacaaacatctttccatggccctgcacagctcttggaagccaaccataagctctttaacatatgacctgtgcctacgtggcagcctccagccacatcccttggcacgccccaccccactctccagacagcctcacagaacagcttatatcctggatggccatcctgtctcccattagggctctttagaaaccacttctttcaggaagccttcccgagcccacaggatgagtggtgcctccctggaccttcctgttatcagtctggtgctgcctgtctctcccacctggcttggagctccctgagggcggggcccatgtccagcgctctccctggctctcaatgcaggagagaggacagtaaatggctgtgggctgagtgaatggcagcatccgggtccaggattcttcaggataacatccacctccctggcaaggccacacaggaactaggcctgaggtcctgagagtcagggggtcatgagacaggcattcgaggtaggcccagctcttcccacccggatgaccttgcacacgtcatccgcctcaaatttcctaactcaatctaccccatatctggggggtggggtctccactgagggttccaggaagacaccagaggaacaaggggagaagggggtgggacaacagccactggagaaggggctggggaaggatcagggccaggaccaggagagagacagtgacccctctccaggaactcccagggtctacagcacagaccagtacgagctccacttgtccctggtttggagcctaagccccacttcatctccagctttatctctccaagctctctgggcagcaagtctggatcgattctgcaggtgagaaccatttgtggcatccaaggaaagaatgacacgaaagtttccttttttgggtaagtcaaaaatatctctcgattgacaaaaaggcggctattatgtttttaccttgaggtctaattgcaactccaccacttatgagcctggggaaccttagggagtcattgcttctctctgagcctctgcccactacccagggtggttgcaagggagaatcttgagaatgtgtgttaagtttctggccatcctagatgacccatagctaccagtctgattattggatggtagataatcctctagcttaaacaatctataactgggggcacttcagacctcagaggcagtgcagtgaccgagggttagctctggtgcaagatgtctgaattactagctgtgtgactttgcacaggttacttaacctttctgagcctcagtttcctcatctctaagatgaaacttatagtcctacctaataaagtcgttttgaggattaaaagagtttaatacgtataaaggctgggcacggtggctcacacctgtaatcccagcactttgggaggctgaggcaggaggatcacttgatgtcaggagtttgagaccagcctggccaacatggtgaaatcccgtctctattaaaaatacaaaaattagctgggggtggtggcacatgcctgtaatcccagctactcgggaggctgaggcaggagaatcgcttgaacccaggaagtggaggttgcagtgagtcgagatggcaccattgcactccagcctgggcaacagagtgagactccatctcaaaaaaaaaataataataatacatataaagtgcttagaagaacgcctagcatacaggaatgttccgttatat

SEQ ID NO: 223 - DNA, 6255 bp, Homo sapiens; identical to SEQ ID NO: 222

SEQ ID NO: 224 - DNA, 6255 bp, Homo sapiens; identical to SEQ ID NO: 222

SEQ ID NO: 225 - DNA, 6255 bp, Homo sapiens; identical to SEQ ID NO: 222

SEQ ID NO: 226 - DNA, 6255 bp, Homo sapiens; identical to SEQ ID NO: 222

SEQ ID NO: 227 - DNA, 6255 bp, Homo sapiens; identical to SEQ ID NO: 222

SEQ ID NO: 228 - DNA, 6255 bp, Homo sapiens; identical to SEQ ID NO: 222

SEQ ID NO: 229 - DNA, 6255 bp, Homo sapiens; identical to SEQ ID NO: 222

SEQ ID NO: 230 - DNA, 6255 bp, Homo sapiens; identical to SEQ ID NO: 222

SEQ ID NO: 231 - DNA, 1151 bp, Homo sapiens
aggcaagaaaggatgaagaggagggccccgggaagaaccctttctgagaatgtcttcccacattccaggtgaactatcctgagatttagaggcggttcctcctgccctgtctcagcaaggctggcagtgcatcagaatctccctgacaagctgtttttcattgtcctcacatccccaaagccccatcctcagaagttcctgcaggctctcctgagaaagaaccatcaaaacaggtcaaggaaatcaaggctaagtaagcgtggaggtcactgtgagaattgtacgggcaaggaacaatcattagtgcatctttgacagagaccacaccccacacccgaatcaggtgaatgatattctaggaggaaaagtctgaaaagcaaaatcttgcaaagaagtctgtggggtctcagcaatatgcatagcagcagagaaatgttgctccaggagtgaatggtcagttggggaacagactggatattgtcagacaatcagcagaagatggaagtgcataaggatatgagaaagacagtgaattgcaggcgtggctacctctggctaataggctattgccaatttctcgtgttggaagaaattaaaatttacatgaacaaatgagattcatttgcataaatttacatgtagatgtggtagtgtaagatcttgaccattagttgtaagtatacaaagtctactttcatggatggtgattaataaattcttttcaagtaattcctttatgtttcttacctcagtttaaaaacctagtcagattttggttgtatctggtgatgtcagcattagccacactcacagccaagttctataggcttggatggctacagcagcatggcagtgaggcaagggacaagcactgacatccaaaagctgctggtgagaagctgggttagccttttacttgcagctgtcctaaacctaggtcccaaggtacttgactgcacactgctcttgtccccaaaggcctggaaaatttgggggtttactcctctttgctcagtatccatttcttcaaccctctccctgtgtcttccattactctggtgcacacatgcacgtgcacatacacaaatttactaacatgcacacacatgggcctatctcatctctcttgctctcgctctctcgttaccact

SEQ ID NO: 232 - DNA, 1151 bp, Homo sapiens; identical to SEQ ID NO: 231

SEQ ID NO: 233 - DNA, 1151 bp, Homo sapiens; identical to SEQ ID NO: 231

SEQ ID NO: 234 - DNA, 1151 bp, Homo sapiens; identical to SEQ ID NO: 231

SEQ ID NO: 235 - DNA, 5627 bp, Homo sapiens
cctctactgcctcccggcccagggggaggctgccgaggttcctgagcgccctgcagtaggtggggaggtctgggcaggcggcatccagacacagtgtgctgagcacgcagtcagccgggggtaaggggacggcccccagtggctggctctgagtcacatcacacttcagcacctgcttgaccgcctgtctcaacttctcctccttctctggacccttgactctgaaaaacacaaacccacagacattgttttccactccagtcatggggaacccagatctcttgggtcaaggctaaaaatggccgtattgtcccagatgtgtgtccttagggccacctctatcgggaaaggagagaaagaagaactgaggggtcattttggcatttgaatgagaccatattaccctgagctatgttaaatctcttcataaagtgaatagtatgtgaaaacgataataatacctagcagcctgcttctaccgtggacttccctccatgaaattattcttccttcactgcttagtatagtactcacttatactatactggctcatttattagtatttataggttattattattatacttgatccatctgccaaactgtaagttagcggctacttgacccatacagaataagtattaataataaggggtttcaaatgctgaaacattatctttgcagtagttgctgatcaataagagtggtgaggtcttccatagatatttttaggaactattgatcattatcccacagctgtgaacagggcactcctggagagaagaaagctacatttcccattctcagattccaacaaatattgcagatagtatgttttctgacagagatcatgtttttggtagccttgccaggaaccctgtccttttctgccaaatcaatggcatgttttgggttttttgttttgttttgtttctagagacagggtcctgttctgttgcacaggatggagcgcagtggcgccatcacagctcactgcagcctcaaactcctgggctcaagggatcctccccacctcagcctcccaaagcactgggattacaggcttgcaccaccataccaggctaatttttttatgttttatagagacagggtctccctatgttgcccaggctggtctcgaacttctggcctcaagtgatcctcctgcctcagcctctcaaactgctggaattgcaggcatgagccaccaccacacctgacccagtggtgatttctcaagagaaaaatcagttaataaaagaatgaaagaagagaaggcaagggcaggagatgggacagagtggcttgtatcctatttgaatttgttaaaggaggaagaaaggaacaaacaaacaaatgatcaaaattaaataaacagagtgtacaagagaaaccagagagcaggggcggacaaaggagaaagaagtagcagaagatcagataagtgagaaaaggggaagaaacattgagtgtgttaagggcccaggccccagagcactaagagtaggagtgacccctgggtattgcactcttggaaggagttaaccagcaaagcattgtggagcagatccagtctcacactcaggaaacacacactctaccatctgatgcagactccaggagaaaatggccacttgggcatcaaggcttgacagacagcagagatggccccacattccagcaagtgagggagactttcactgggaccatttccagttatgaggaaaagtcaatggtttaaataaaacttgattcgagagagtggacactagtcatgggcatcttaaatattcacttaaaatcttaatcctagcgaatataatcacttctttgcaaacatgctttatgcttcctataattttccatttaaggagcttagcaattagcagatgaaaagatgctcaacattgtcagtcatcagagaaatgcaaatcaaaaccatgagataccacttcacatcactatgacggctataataaaaaagacagataataccaagtgttggcaaggatttgcagaaactggaacctacatacactgctgctgacaatgtaaaatagtccagttactttggaaaacagtctggcagttccttaaaaggttaaatatagagttaccacatgacccaggaaatctgtctaggtatatacccaagagaaatgaaaacatatatccatacaaaaacttgtaatgaatgtttataaacagctaaaaggtgcaaacaatgcaaccgtcaacttctgaataggtaaataaaatgtgatatatacatataatggaatattatttggcaacaaaaagaaatgaaattctgacacatgctacaacatggatggaccttctagacacaggctaaatgaaaaaagccagaaccaaaaggccacatattgtatgattccatttatatgaaatgtccagaaaaggcaaagctacagagactgaaagcagaccagtggttgccaggagctgagggatttggagagaaatgggagtggctgctaatgggtacaggatttcttttgagaattatgaaaatgttgtaaaattgattgtgatgaaggttgcacaactctgaaagtatactaaaaactactgaatttcgcaatttaaatgggtgcattaattgtatggtatgtgagttttatctcaataagctgtcatattaaaagagagagagagagagagatgagcttagcaaggtgttgatttgggggaattcctaccaaccactaaactggtatctacatagaaaacaaaaattatccttggttgggtctacctgctcctttatcaaggctagaaatggtagcagggtgaccactttgtcctgatttgtctcagacttttctagttttagcactgaaaaatcccatattctaagtcccccttgcagtcctggacaaagcagacagtcattctaaggtgggaaactagttacaaagctaccacccagccttgatacaacatggaagttttcatagaacactttaagaataacaacaaaaagaaaaacactgtagaagtgtgtgagaaacatgtatttgaatagacaaactaatctagaacagaaaaacttaagtaacctatctgcacataggaataataataaagtgtatatcaaaaggtagagtagtgacaacatagtgttctgggggatgtgtttcgggatgatcctgtataacgggaacattgtggaaatgtgtgtttgattccaacagaagcagaacgaacctccgtgccctattgcgtattaagctatttgaaacacttgagttaccacagaactagaacttaccagtcagatgatgatgcaaattgttcccaaactgtgagccacactgtgaagtctccaaagctcacagagaatgtgccaatttgagagggaaatttgctagaaacacccagtgtcatagatccctgcttgtccttggacacacagcaaacattggggaagtcagttgccaaggtagctgtgtaaagcctgcatacacctcggggcaacgcagggaaatggactcaccagagacccagccaattactactttgcctcatgtttagctcatggggtaggtaataaacacacaccgggaaagtgctatgctgttttgcagaaagctaacagcggtgtggtcatttctttagttctaaaggtctgccctttcaaaagaatcaatatgcaaaaaaaggtagccctgtcctctgtaaatatgcatctataaaagcctgaggggtatggggaggaagggagggaggcaagaaaggatgaagaggagggccccgggaagaaccctttctgagaatgtcttcccacattccaggtgaactatcctgagatttagaggcggttcctcctgccctgtctcagcaaggctggcagtgcatcagaatctccctgacaagctgtttttcattgtcctcacatccccaaagccccatcctcagaagttcctgcaggctctcctgagaaagaaccatcaaaacaggtcaaggaaatcaaggctaagtaagcgtggaggtcactgtgagaattgtacgggcaaggaacaatcattagtgcatctttgacagagaccacaccccacacccgaatcaggtgaatgatattctaggaggaaaagtctgaaaagcaaaatgtgagtattcatgtattttccaaatatgttttgaacctctactatgttcaggaaataggctgggcactggggacacaaggatgaacaaatgagaaacagattctaacctcatggagattgtagacgggtgggtggcgggagaaagcattaacccagtgatcactcataggagtggaaattaaaactgacaaatgcaaggaaggaaaggagcatggcactaatggggagatgttgggagctccccttgacctagaggatcaggaaaagctcctccaaaaaggagtcgggcaagcagagatatagaggataaatacgtaggagttaaccagactgaagcaagcagggagggcgggaggaaattccagtaagaggaaaccgcaagtgcaaaggccacgtggtggcaggaaacacaggaggagagagccaacgtggctggattgtggggaaataggttggcagagccagactaggcagggctttgtggaccatgacaggaattttgcttttcattccaaaagctctggagagtcactagggagcactaaggaggagagtgacatgatcagatttacattttgagagggtcacttgggctgcagaacagagaagaattgagtggaggggcaagagtggaagtgggaggccagtcaggagggagacaggggtagctgagaccaggtgatggtaaacacgggaagaaatgggttacagaggaagtcaggaagtaaaatggacagagcttgatgttaagttagatatggaacatgacagagagggaaaggacaaattgacttccaggttctggcttgtccaatttattatatgatggtgccattcaaggagctaagaataccagaaataaagcagatctggagcagatggtagctctgttttggacacactgagtttgaagtgctctgagacctgtgagtagaaatgtttacaattgaggaaatagctagttgaaggtttcttaacctgccctgtgaattttcctggggagataaggtggcaagagcacctatttaagagagaggcatccttgtaaaaggcgggaatgtttcctaggtatcactgaaacaatcatcatgatcatcaagatcctggttttgaaaaagcttatcaatatccttttgcaagctgtgaaagtccagagatgctttggaatagaagtggttcactagtttgtggaacacatttggcacaactgtgtctatttttggacaacatacaaacatctttttaaatagaaatggaggtctttgcacagagagcatttacctcagagaactgccacctcgacaggggcctaagctttcttctgtcaggtatgctgaggttaagaggagcacactacctgacttcaaactgtactacaaggctacagtaaccaaaacagcatggtactggtaccaaaacagaaatgtagaacaatggaacagaacagagccctcagaaataataccacacatctacaaccatctcatctttgac

SEQ ID NO: 236 - DNA, 5627 bp, Homo sapiens; identical to SEQ ID NO: 235

SEQ ID NO: 237 - DNA, 5627 bp, Homo sapiens; identical to SEQ ID NO: 235

SEQ ID NO: 238 - DNA, 637 bp, Homo sapiens
tgtcagagctgtcaagagaactttattcattggaaactgggccagagacccctcacgaagctgcaagcccctgggccctgggcccttctgtatttggaccctagtgaaatgtgcacagtctgccctctccatgccagggagagacagagaggaatgccatttttctgtgtgatgtgggagtgacaggggaaagagcagaaatccggttatccctcctgagactcccagtgagctggggtgccacagggcacgtggccccaaagtcaggtgttaatgctgtcctagcgtgagtgcctgcgtggagcatggaggggtgggcaggcagggaaggaggcttcagaggtagacattgagggtctgcaggatgccccggcggcagagcgggcaattgcggtggtagacggggtggcgcatcaggatttcagtgcaggcctggcacaggcacagatgccggcagggcaggagcaacactgtcttgctctggtcctggcagatgacacacttcttccgctcctcttgctccttcagcaatttccaagggtcttgcccacctggaggctcctcctcattgagcctctctcggcccctgacaggtgcccctccccggtttggccaactcgccagctgcagactgcgg

SEQ ID NO: 239 - DNA, 637 bp, Homo sapiens; identical to SEQ ID NO: 238

SEQ ID NO: 240 - DNA, 637 bp, Homo sapiens; identical to SEQ ID NO: 238

SEQ ID NO: 241 - DNA, 4806 bp, Homo sapiens
atcgtctccatcttgcttggaagataaaagtccatattcatctcgctcccagttcccgtcatcttgcaggacctcctactaatgggtcaagcccccagagcaagggccctggagggcatgatccgtactccatggtgactgcagttctgagaattcttccacatggctattgtcttttctcttccagtgagcagaggaagccgtccttgaaaatggatatttggggcatgaggagcagattgaggtgaagaaatgcagagctaggatggcggagggaagaagagggagactgagagcccaggggattcggaaatccggaggactgtgctggactttctaacaggagagagccactcaggaagactggatgactggggcatacttcgatgatggaagaaatgatggtgatgaaaaccctcaaggaaataattcacctccagtaacatcagagctgtcctttaggttctgaagttagcacaggcccttatgagtggaggggcagctgttcattatccttacctactccgcttcaccccaaggtggtcccctgtctcactggtgtcaatcaacagcaaagatcctgtcctctaactacctgcaaaaacactacttaaggtgtcgccccctcttcatgggagtagacatattctccttctctctcttcctctctccccactctccatcttgtgattgattcatctgacacctctgagatgatctttcactcacaaatacagatgttctttaaacttctaatttttccccttcatttggatcccttgcttagttgcttcaagaaatgtctccccccttttgtcttcctggcctctcaacttcttcttttcctccctgcctcaccctgtttctcttgctccctttctcaatcagaagggaaaagcaaaaaccaactttaattacgggggataagtagaagtagtgccagctatatacctgtatcaagcaaaagtcaaggcataagctttgaagtgaaatgaggtgcattcagcagcctgaaccatcagcctcaacagctcttgacataacctaaagcctccttcaagagcactgcaccgtctccactacctcctcattcctgtccagttaatcttactttcctcaagaatgaacttccgtgtgtgtgtatgtatgtgagagagacagagagagaaagagtgtgtgtgaaagagaaagagacagacagggagagggagagaaacatttttattgttctactgtttggtttaattatgggtattgaactgttgttttctacaaagtttccttgcaactccataataccagtagcacattttgagttagatgtgcatttgtgggctaggctagagcactatttataacatcgtttctatgggaaagtttattccaggtcccaagcaactaacttaaaaatgaactttttgattacaacttggaacaaagcatatacattggaaagtgcttgctcatgaatatgtaggctaggtttgtggggtaagttggtatacggttcagctagcacactggcattttctctacgttctcctacctgttctcagcaaacaaatggcaattggtcatgctctgggcaatttactgatgcagaaccactggtgacaaggtagatggacccctactttacttaaggggctcacattcaagtgcatagtcctaggatcctgtgaaaggtgagttccacggaaatggttattcttatagaaatacaatctacagaagggctctgaagtcaatttcttttctggtaggccttgggaggaagcgtcttataatagccaacacccaagtgctcttttgcgagcttatatgggtaatcttaaactagtcaatttaacttttcagactcttcacaaggaggtttatcatgagaaaaaagaaagcagacttttactgggaaagtgtaataagcatgatatgcatacacacacacctttcattttacaatccttgtgatttattggttgtactaaagttggtcaatggaggatattttcctgagctaacaggagtttgtgccacatggattggagactttaatcttccaagcatttacctccagtgatgatcatctggggaaaaaagaagttgccagggcaatgctgtcccagcccccagctcccagaatgagtcccctgtggagagccatttacacttaggaagaaatgtgatcacctcatgcttactgtggtgtttggggtgatttgaattgcaatgtggtgtatccaatccatagagtaaagaaaactgaaccagtatcattaaagcttgaagtgttgaaataagtggcctgggactggcttccacggtgataaaagattcatctggtagcaccagagtaaaagaagtctcactaaacactggccgggcagctgctgctcggtgtgagcatcccggggatgcaagcgtgggggaggcatccctttgtttcctgagtcctagaagcaggtccccgacgaggaacaacgatgcctggactcagcttcagcctctgttcttctaccgttcagaagccaccctccggcaaggtgaccccggctgctggatggggcaagcccaggaattctcggcttctgacacatgacgcattcatcttctccgacagtgttcccatgcacaacttgtggttcgggttggaaatgcaaagtggaaaaatgcatagcagtatcccctcctccaaggcctcagtctctgtgctcatattcactgagactagtgacccccgacttcccactcgccggcccctcctcctccccttccaacataatatgctgtttacttatttattgtgttcattttccgtctcacccaaatctattctagaaaaggttttgttttgttttgttatttttcagtgttctgtccactgttgtacccccagtacttagcttcccatttgctacgcagcagacactcagtagatattggttgagtgaagaaatgattgaggaccagtcatcatgcttttgtcctagcctcactgggaaccagctatacagctattgccctgtgtctcagtttccttattgggaaatggggataataatctctaaagaaacagatggatgcatatatgcaaactatttatatgtttgtatattcctatctgtaaagtgtttgtatattcacatatgtaaagtaaaaaatgtaaaacgttggataagtataatggatgcacactatttacagtgcatggacacctgtcatgataaacaaactggagaagcaatcactagcaaatagatcatatcgatatgtgtgtgcccccatgaaaacctccacattgttgaaagtgctacctgctctaatctcctgtttgtgaagattagccctatttctctatccaaaaagaagttatcttgggggcccagcaccccaaaaaattagatctcaggccattgcactatgtctaaggggtatgttgtataagatgtgcacgtagtggaaattggacaaagggcactatatatagaatgtgaaagtggagttttcaggacctgtgctttaaatatcaggcatgacatcgtcaccagcacctccaggagcggagccggaggcaggattctctggggagtgcatttcctccagttctgctgatgcaggagagaagggtgaatcagcagtaggcggctgaaagttttgataatcacaatttgctctgggtgatcaagtggggcctggatggagggaaacaattggatatctaactaggctaagcaagagggctcaggggactggcaggagaaggatacagtgcttttacctcctgatcaagcttttcccatctggtcattttatttgtcaatttttcccatttcatttaccaggctgttccctgactgttacctcctctggcaaatagctcagccaatcattctgccttgggaaggatgtctggctaaagtgcccaatgtggccccacctaggccttttcctatgagtacccctctctgtggcccaagatcctctccagctcccccatgatattaggtgtgggatccacaacttgcctgcggcagagaaacccagacactctcatcctgcccttttctttcgtcatgaaacagggttgtgggttgggtgggaaaggggctgagggggtgagtttagagagaggaggctggaaatgagattcccagctccatcattattagcaatgtgactttggggatattgccacacctctctgagccccatcttccttcataccaagatgataatctctctctcatagtctctggtgagaaccagagagcaggagacacaagtgctgacccatagtaggtgaggggtacacaactattgagtatacacaatggtctctcgagagctgtctctactgttgaatttttgaattcctaaaaccagaagggaagaaaaaccaacattgaataaaagtgctagactgtagtaggtgcctgtgtatgtcatcatatcactccccgccaacagacttataaactgaagagtagtagtccactgctctggtttacatatgtcccccaaaaaccgtgtgttggaaacataatcctcaaggcaacagtgttgagaggtggagcctgataagaagtgattagaccacaagggctgtatggttacgaatggattaataccattattacagaagtgggatctttaaaaaataatgagtttgccccccttttgtctctctctcactctctcttgccattctactttctgccatgatgatacatcaagaaggtccttgccagataccacctcttgatcttgggcttctcaacctccagaactctgagccaataaatttctgtt

SEQ ID NO: 242 - DNA, 3332 bp, Homo sapiens
gtgagggcggccctgggcctcccgcgggggaaggaagagatgaagccacgtgacagggcccaaagccgggccccgagcgcgccgcagaccggatgcgggaagtgggctcggggccccgctcccctgcccggctcgcccgcccgcgtcagctgacctggcttccgcgggccctgcgccctcgcgctcccgggccccggccgcccccacgccccacgccgcgcccgccggcccggccctccctccccagctggcccggccgccgcggcctcttccgcccggcgcccgcgcattcctgccattcccccgagtcggcccgcgggctacggccgcctgcggagcgcaggaaccttcacctcccgaggacaggcgccttcccctcgggacccggctcccctgctgcctgcgccgctctgtccccctgccgctgcccaagcctccagcaggggccaccgagggctccaggagcaccccaggcccgttcttctggcccacagcgcccctcctgtgaccctcagcgaccctcctgtcctgccctccggcggcgcggctgtctggagactctgcaccgtcgcggcctcgcagcctcgcagccccgcgccgggtggggaggggagggtggcgttcctgagtccgcggaggaaagggtcgcagctgcagtcgcgccagccctcgggcctacatccgctccgccgcgacgcggctcacaaactagggaggggagaagggaagaaagacccgattcgggaacacggctttgtccctggaactgtacctcatgtcccctcacttaatcctcccaagacctgtggggcgtgtcgtcattttagggctggagatgaggaaaccgaggctcggagagatgaagcgttgtacggccaccgagcggctgctttgcaacgaagccaaagccaacgttttgttcttagcggcggtcgtttgagccacgcctcaccgcaacgagtctgccatcagccaagaggtcacatcttttctggaactcgctcccccctcacatcatgggagcagtcagtctactcttccagtagaaactgttttgccacttttggggggaatcttgagctaccagctcatcgctcaggtcttagatgacactttccttgaccccaccgggtgctccagcgcctctgcttccggttttcatagcccttataatatcacctattgcaattgcccatttccttgtctgtctccctctgcagatggagtgaaggtacctgagcgcaggaaccatggtcttcattgctgcctcagcattagcggaagtgccacgggccggctcccagggggccagagtttcccaggaacaccattgagtaccactgaactagagtctgcaagttaaagtaaggcaagaaggaaaaccggaaacaactgtaaaaacctgacctttcgtcaccttaatactggccatcatttatcgagtgcttattatgtaacagacattgttctcagtgtgtgagtgcagtgttcctcaaacctaaatgtgggcctgaatcgcagcggatcttggtaaaatgcagtttctcattcagtacctctggggtgcggcctgagattctgcatttccaacaagctcccaggatactttgtatagaaaggctttggtgtattaactaactcgatcttcttaataatcctatgaaatactactgctattcccattttacagatgaggaaacagaggttaagcatatatgaacttacatcaaaataaatagactgcagggcaaggagggaggggagaatagtgtgggcagtgtacagtgcagaaacaaagttctaggcagaggaaaaaggatttacagaaagcctggcatacagggcagggggacggggcctgcacacggggctgtttcaccgttagacgttataagcacagtacttggggctatgggcttcctgaaggtcccaagtatttgagacctgaaaaaaatttattgacacctacataggaaaagtgaacttttaaattaataattccaaaattcaaatcacgaattgtttcaaaaattttacatgatagaattcatatttagtaagcgatacgggtatattttaatgcatttgattttaaaaacggggtagggcctactaagaacaggccaagccctggccccagtgggtttggatataatcctgagggcagctgggaaccactgagagaagcaggagaatgttctctgtggctacagtgaggagaatggattggagggaggccagactggaggcccagtggctagagaccagataggcagttacagtcttccagactgcgagacaatctctctttagtgccaagattagcataaaatcatagcattatataacccaattattctttgattcctgcatccccaatctgactcagcattctaaatttacttaagatctggggacaagggtttttggcaaatccttgaaggcaaatgatgttacagtcaatcagtatatgccttgagccagacagacatgggtacgggcctcagttctgctgcttgctagctatgtgactttgcacaagtgatttaacttctctgggccttggattccttactggtaacacgagcataatcgattcctcacagaattaagtgagaaaactatgtatgtaggacttcttatggagtgggtacttagaaataaatggtagccgttatcatttatgtgcctttgttctgaaatctgcttaagttttctctaggaagtaacagagggtagaataaattatttagtattttcatcaatcttctgagataaaaattattatcctcattttgcagataaggaaaagggctcagagattagatcacagctctgtgaagtaggggcacaaagtggtcaacctggaagagctggactttattttgcttgcacttctgtccatgcactctctccagcagttgacatttgccctctttgatggctccacgaccaatttcccttagtcatggcatgagtcagctgtgagggctgatggcacaccaccgaatactctgctgtggcgccactagcctccatttaccttcttctccaacgttttccagcctccctcataccttgccccccagttttatagcttctggattttccttattaaagagcttgtttctgagactcagaaccgcccccgactgggatgtcttccagagtacctccctttcaagggagcagataagtaggtcacatcgggatggcgagggaggaagctgacttcttatgggaggaggaaaaatactgcaggtcacatggagaatggaaaacaaaataacagggtttctctcttttcctaattctctcacacaatctcacag

SEQ ID NO: 243 - DNA, 3332 bp, Homo sapiens; identical to SEQ ID NO: 242

SEQ ID NO: 244 - DNA, 3332 bp, Homo sapiens; identical to SEQ ID NO: 242

SEQ ID NO: 245 - DNA, 3332 bp, Homo sapiens; identical to SEQ ID NO: 242

SEQ ID NO: 246 - DNA, 7157 bp, Homo sapiens
gttagttccccattgaatcatgagctccttgatgacaggagccacatctcattcatctctgtgtcatctctgggttagttgcatagatcctgtcatctaggagatagaggagatgattaataaatagttgttgagtgaggaatgaatgaatgaatgaatgaatgaatgaatgaaggggaggaggggagcagggttaaaggagaaagtgtgaccagtggtgagcacggagctgaggggaggaagatcagtaccaagtgtttcctgggagcctcttgcatcagtatgtctcagaatggtaggtccaaaactcatctgtgacaggtgtggggacagagagaaagcaatcacagaggcaacacagctgcagtaggactgcaatttcacagcaaatcacaggttccagaacagggaggctgtgtgggttgtagcacagcacatgtgccacacggcacagagaggatctgtgttctgctaccctgccatcttggagctagcgacgggagccaggcaaagacggaaaggggacttcggccagtgagcagcagaggaggactaaagagaagagggagaagaggctggccagagataaagggtggggttctggttgtacggtctcaagcaggtcattgtttctaagcttattctcctcctctgtaaaatgtaggatgattctgtaaaatgaggagattggaactaggtgatccgggatattccactggccttgaagaacaaaggcacagaggcgtgacatactggtgcacattctaggatgtactgggaagtcagcacttctagagcccaggctagatgcagggaaggactgaaggagaggctacagaggtggccagtcctgaaggctggtgagcccttcgcacacagagaggggacaagtataatggtgggtgctgcccccatggaaagcaggcacaagttccatcagcggtggagaaacacggatgggttttaaaacatagagcttcgaaaaaaaaaagtggtggggcacagtggctcacgcctgtaatcccaacactttgggaggctgagacaggtggatcagttgaagtcagaagtttgagaccagcctggccaacatggtgaaaccccgtctctaccaaaaatacaaaaattcgccaggcgtggtggtgggcacctattatctcagctagtcgggaggctgaggcagaagaatcgcttgaacttgggaggttgcagtgagctgagattgcaccactgcacactacagcgagactctgtctcaaaaaaaaaaatagtaagaggtgaaatgagatctataacacaataccatttatataaattaaatacagattttgcaaaaacacatagagatacacactaagcacattactatagtggcctatgagaatcagtataatgtgatggttaagagcacagactcagccaggcgcagtggctgacgcctgtaatcccagcactttgggaggccgaggcgggtggggtcacctgaggtcaggagtttgagaccagcctggccaacatggtgaaaccccatctctactaaaaatacaaaattagccgggcacggcggcacatgcctgtaatcccagctactcaggaagctgaggcaggagaatcacttgaacctgggaggtggaggttgtcatgagctgagattgcgccattgcactccagcctggccagtaagagtgaaactccgtctccaaaagaaaaaaaaagagcacagactccagaattaaattccttgtatttgaatcctggggctctaacaagtattagatgtgggaccaaacaagttacttacttaatctctctgtacctcagtttcctcagctgtaaaatggggataataaaaatatcaacctcacaggggtgttgagcatgaaattatgcttagaatggtgtctagccttagtaagagctgtattagctcactagtacgattacagggattcattaagatggctaaagtcaaaaagacagacaacagcatgaggaggaggtagagaatttagaaccttcatacattgctgttgggaatgttaaatggtgtgaccatttggaaaagtctggtagctcctcaaaatgttaaatatagagttaccacatgacccagcagttccactcataggtaaacacccaagagaaataaaaacatagatccatgtacaggatccacaaaaacatgtacaggaatgttcatagcagcattaatcataacagccaaaaagtagaaacaatccaaatgtccatcaactgagaatggataagcaaaaatgtgggccgggcgtggtggcttacacctataatcccagcactttgggaggccgaggcaggaggatggcttgagctcaggagttcgagatcagcctgggcaccatagtgagacctagtctctactaaaattaaaaaaaattagctgggcatggtggcatgagcctgtagtcccagctacttgggaggctgaatcaggaggatcgtttcagcccaggaaatcaaagctacagtgaggtctgattgtgccactgtactccagcctgggtaacagagtgagaacctgtctcaaaaaaaaaaaaaaaaaaaaggtggtgtatctacacaatatcatagtattcagccataaaaatgaagttctgatccatgctacaacatggataagctttgaaaacgttatgctaaatgaaagaggccactcacaaaagaccacatattgtatgattccacttatgtgaaatgtccaccacaggcaatccatagagacagaaagcagaagagtggctctcagggcttggaggaggggagaaaatggggaagaactgctaatgggtacagggtttctttttggggtaaggaaaatattctaaaaacaggtagtggtaatggttacacaactccaaatatattaaaaatcactaaattatacatattaaaagaatacatttatggtttgtaaattatatctcaataaaagtgttattaaaaaaagattatagggtgggggaaaagggtgtagttatcggggaggaaaggggtgagaaagccatgctaaggagtaccaacttgatgctggaggccgtgagagacactgaacgattttaaacaggaggatacagtttggatgtttgtcccctccaagtctcatgttgaaatgtgatcccccatgttggaggtgatcctagctgggaggtgtttgggtcacaggggtgggtccctcttgaatggcttggtgccctcctcacagtaatgagtgaatcctcacactattaattagttcacccgatagctggttgtttaaaagtgcctggtctctctctctcttgccccctctcctccccttctaccatgagtaaaagtttcctgaggcctccccagaagctgagcagatgctggtgccatgcttgtacaatctgcagaaccctgagccaattaaacctctttcctttataaattacccagactcagatattccttttttttttttttttttttttttcagatggagtcttgctctgtcgcccaggctggagtgcagtggtgcgatctcggctcactgcaacctccacctcttgggttcaagcaatcctcctgcctcagcctcctgagtagctggggccacagatgtgtgccaccacacccggctaatttttatatttccagtagagatggggtttcgccatgttggccaggctgatctctaactcctgacctcaggtgatccgcccatctcggtctcccaaagtgctgggattacaggcatgagccaccgtgcccggtgagatattcctttatagcaacacaaaatggactaacacacaggactaactggaatagttacatgtggtgacgtgaagtaaggttgaagtacaaaggttcctgtagttgcagaaggaagggaggatttggaggcaaaagaacgcagtagggtggagtggtgggtataacaacccaggcgagcaatgaggctctgagctgacctaagcgcctaagtgccaagataaagatgaaccatggactttctgttgagggggaggcaggcacacagagcaaagggaggcatcgggtgagggcatagggaaagcacaggtgtccaggtgacagttagaggaacttggtgacaggtgtgggcggactcaggcttaggtgttgctaccatcttacttcccagctggtagtttctgtcctcaaacaaatgcaaagactaaaaacagaacaaaatcgtgtactgggcagagtgtgtgtgaagggtaagaagtgacaccttgccctgtggccattcttcagcaacaggggagggaatgccccctgtagagtggagccaggcagaggcagggagatggctccggaaaataaacgagcaggaggagaaggcaggggaggagggggccagaggttacagaaggggacccccccctcgcctcagcctctcccagccctcagagaacctgcagctgctatgagctgcttgcaaggacattataacaggggtcctcacagaatgaatacccgaggggtagtggggtgggaagaatccttagccagggccggcccattcccaagggcaagtcacttcacctgtttgagtacaagagtaatgaaacccatcatttactgtggtctataaagtgccctcacgtttgtatctcacacacttggtacagctcttgagatgagtgttatcgtcatcatcttcgtcacttgagtaaaagtgccaaaggagcatggattatatagtttttcctttgatgtagtccaaatgcctagaacagtgactggcacatagcccagatagtcaaaactatttgttgaacgaacactgaatgaatctcattttttgttttacttccattttacaatctaagaaataggctctgaaggatgatgtgatacatccagagtcacctggccaggaagtgacagagctagagtgggaacttaggtttagtccctcaacccatgccactccacctcactactactgccagcctcagctcagggaacagagtatgagacagatgatctcctaggcccttttgagctttgatgctagggagaaaggggccttagaaagaccaagaccctggccaggcatggtggctcacgcctgtaatcccagcactttgggaggccaaggcaggcagatcacctgaggtcaggagttggagaccagcctgaccaacatggacgttgaccaacgtctctactaaaaataaaaaaattagccaggcgtggtggcgcatgactgtaatcccagctactcaggaggctgaggcaggagaattgcttgaccccaggaggtgaaggttgcagacagccgagatcgcgccattgcactccagcctgagcaacaagagcaaaactccatctcaaaaaaaagaaaaacaaaaaagaccaagatccatgcttccagcctttggtttctcaaagccccagtcttcccaaggcatcctgtgaggccacttccctcagatccagcagtgcagggagcagcaggagttcgtagggcgctctctggggcagggtgtgggcccaaagccagtgcttccccctggcctgctggcactggcatttttttagtcaacaagcatttcctgggccctgcccatgcagggcgtgaggctgacccagggaagcggaccccgcggagagcaaggagccaggcaggactgactcacgcctggttgcaggagacctggttgaagcggcaggcgaagatgaagttgcccagcgtgtcctcctccagggatggcagagtctctggcagcctcgacaggatgttgatgtagtggaagcggtaccactccctcaccgcatccacccctgatgagtatgtctggtagaagcagtccgatttgttctggttgcactggacacagagactagagtcagaggggacacgcagccggggataagccccttggcagggccaagggcaaagaatgagtgatctggggttctgaggactgacggacaggagtcggaagccaggagtggggaaagacagaagtggaagagaagcagaagtccctaggagcatggaccaggggagcatgggattaagggagttgcaggccaggaaaggagaccagtagctgcacacacacggttttggttcatttatacctcccctgcctagggtggaaggagcaagactttccctcccatttcactgatgggaagactgagggatcaagagatttgtcccagcaagagctgggactaggactccagtccccagcccactcttactaatgggaacttccctgtctcctttccttggctcctccctcattttcccttgctcctttctttctttttttttggcagacgagctcactctgtcactcaggctggagtacagtggtgtgatcaaggctcacagcagtctccatctcccgagttcaagcaattctcccatctcagcctcctaagtagctggaactacaggcttgtgccaccacatgggctaatttttgtattttttttttgtagagatggggtttcactatgttgaccaggctggtctaaaactcctgggctcaggtgatctgcacgcctaggcctcccaaagtgctgggattacaggcatgagccaccgcccccagctaagtttcctttttttactgtctccttattctctatcttgggctgttagcccagttctccatcacgctggagggtcctaactgagtcccactagtgggcactggaattcagaaagttgcattttccttcctgaatcaaggaccagaaacagtaaaacaataataataataataataataaaagttcattttccataataaatttgacttcctacccctgaaatgcttctacataggaccccagggaggaggccccaaaagcttgggcaccaagaggtgttattttaattatctagttattatttgtatttatttacttttttttttgcccgcgagcccacgaggccccgcgtggtgtcactgggctgcgcgggcgggtcaggaaaggagcggagcccatgggtgggcggggccaggggccggcgaggggcggggcgggcccctcggcgctgcgggcctcaccagctggaagccgatcttccagtccttccagtccacctgggggttgttgtcccgcaagctggaggccacgctacgggctcgacgggccccgtgagg

SEQ ID NO: 247 - DNA, 7157 bp, Homo sapiens; identical to SEQ ID NO: 246

SEQ ID NO: 248 - DNA, 7157 bp, Homo sapiens; identical to SEQ ID NO: 246

SEQ ID NO: 249 - DNA, 7157 bp, Homo sapiens; identical to SEQ ID NO: 246

SEQ ID NO: 250 - DNA, 2056 bp, Homo sapiens
gctgccccagccagcagtggcaacccgcttgggtccccttccacactgtggaagctttgttcttttgctctttgcaataaatcttgctactgctcactctttgggtccatgctgcttttatgagctgtaacactcaccacgaaggcctgcagcttcactcctgaagccagcgagaccacgagcccgccgggaggaacgaacaactccagatgtgccgccttaagagctgtaacactcaccgcaaaggtctgcagcttcactcctgagccagcgagaccacgaacccaccagaaggaagaaactccgaacacatccgaacatcagaaggaacaaactccagacgcaccaccttaagagctgtaacactcaccgcaagggtccgcagtttcattcttgaagtcagtgagaccaagaacccaccaattccggacacattttggcgacccagatgggactttcgcctatcaccaagcggtgagaccatcacctatagctgagcggtgagaccatcacctatagctgagcggcgagaccatcacctatcaccaagcaaatcaaggccatcaagctacagatgggcttacaaatggaacccaaaatgagttcaactaacaacttctaccaagggcccctggaccgacccactggcacttcccctggcctagagttcccctctgaaggacactacaactgcaaggccccttcttcaccccatccagcaggaagtagctagagcggtcatcggccaaattcccaacagcagttggggtgtcctgtttagaggggggattgagaggtgacagcatgctggcagtcctcagccctcactcactcttggcacctcctctgcccgggctcccactttggtggcacttgaggagcgcttcagcccaccgctgcactgtgggagcccctttctgggctggccaaggccagagccggctccctcagcttccagggaggtgtggagggagaggctcaagcgggaactggggctgcgtgcggcgcttgcgggccagctggagttccgggcgggcgtgggcttggcgggccctgcactcagagcagccagccggccctgccggccccgggcagtgaggggcttagtacctgggccagcagctgtgaagggtgtactgggtcccccagcagtgccagcccaccggcgctgcactcgatttctcaccgggccttagccgccttcccatggggcagggcttgggacctgcagcccgccatgcctgagcctcccacaccccctccatgggctcctgtgcggcccgagcctcctcgacgagcgccaccccctgctccacggcacccagtcccatcgaccacccaagggctgaggagtgcgggcgcacgcaggggactggcaggcagctccacctgcagccccggtgcgggattcaccgggtgaagccagctgggctcctgaatctggtggggctttggagaacctttacaatccctgagctagacataaatacaccaatcggcactctgtatctagctcaaggtttgtaaacacaccagtcagcaccctgtgtctagctcagggtttgtgagtgcaccaattgacactctgtatctagctgctctggtggggccgtgaagaacctttatgtctagctcagggattgtaaatacaccaatcggcactctgtatctagctcaaggtttgtaaacacaccaatcagcaccctgtgtctagctcagggtttgtgagtgcaccaatggacactctgtatctatctgctctggtggggccttggagaacctttgtgtggatactctgtatctaatctgatggggacgtggagaacctttgtatccagctcagggattgtaaacgcaccaatcagcgccctgtcaaaacagaccactgggctctaccaatcagcaggacgtgggtggggccagataagagaatgaaaccaggctgccccagccagcagtggcaacccgcttgggtccccttccacactgtggaagctttgttcttttgctctttgcaataaatcttgctactgctcactctttgggtccatgctgc

SEQ ID NO: 251 - DNA, 1006 bp, Homo sapiens
ggaccccccatcgcacgggggagagggaccccccgcgaggcagggacggagagcctgccgctcttccccccgtggctcataggacccccatcgcaggcgcttggcaccccacgcgaggcgggtactgagagccagctcctcttcaccccgggtctcttaggactgccatcgcaggggggtagaggtaccccatgcaaggcggggactgagagtcagcccctcttcacctctcgctcttaggcccccatcgcggggggggaggcaccccatgcgaggcggggattgagagccagccccacttcccccctgactcttgggaccaccatcgcagtgggggcaggtacacaccgcgaggcggggactgacagccagcaactcttctgccccgggctcttgggacccccatcgcaggggcgggaggcaccccatgcgaggcggggactgagagccagccccacttcccccctggctcttgggaccaccatcgcagtggggggaggtacacaccacgaggcggggacggagagtcagcccctcttcccccactggcttttgggacacccatcccgggggggaggcaccccccgtgaggcacggactgagagccagcccctcttcccccactggctaagacccccattgcggatcctaagatccttaggacccacctggaggactgtgggtattaggtgtccaagaagaaagctcagatctgccgacggcaggtaccttacttgggattttctatacgacaggggtccgaacgcagcccgggatcagaaagaaagcaggtcgtttgcaatctaccggagcctaagggcagaaggcaggaccgtgggaacaatatgccagggggatttccactttctgccatatatgtagtcacatcacccactctgctttggaatattattaaggaccatctaacacgagggtgtatacgtcctgcaatactacgagtaatatcaacttcttggcctctgaatatgaggaagaatatcacagg

SEQ ID NO: 252 - DNA, 2243 bp, Homo sapiens
tttcaaactgtaagctcctagaaagacaagtttgaaattgagctctcgcacagcatttccaattaccacatatttattacactatttgtccacttcccagtaaatagtagtagcttcattttagtgttatgttttacttcagtttatcttcccaaactacataggtaaatacacacacatacacatcctcatatatccagtttctttagaacctaattatcaaattttatttttctgctgaacatttaaatttccaaatacatcattcagaaataaatacaatgctttttttcctgacatttcttcttctgatgcattgtttaacttacctcgaccttgcttaaccctcgacctttttctttaatcatagaattacatgagaaagtccttgaggctactctgctactaaatagcttggaaactatattcacactgtatcactctacttttcaatttaagagaaatataaaggaggtaggccagatcacaccactatggtcaaatcctatctaccccaacagtgacacctgtgacttttgacatttcaatacactatcttcacagcattgcataaactaatttgaaaaaaataattagttgggctaagttttggctttacaaataaacagattaataaaaacattgtcctacattcaaaggccttcatttacagtgaggaaaataatgtaaacataatgttagaaaatattctactagacatggaaaagttatcagtgtgatcaatacaatgtgaaattggaatttacggaaaaaaatatgagtttttaagggaaactttgacacagtatgtgctctaagggaagagtagaatattccgtgtaaatgcagacggccaaggagaagagggtaattcatagtctagactcaggaaaggcttcaggagagagcttgactggtcttggtgacagagaactgggagatgtgtttcctagtcctgctctatgaaaaatgttaacattatttgctcaataaaagcttgccccattttagccccttgttagaagtgcaataattctaaataggtggaaatagatataaaaatattttgtaagacaaactttatctcatattattttgtaattaaaatgcacatttaaattaaactattttaaataatcgattacaattcttatgtaaatttcttctccactccacagacagctttacttcattctgtttgtcacttaaattttgccagtgtatgtagtatataatagtcatccatggtcttcaaaatatatcaggatattttatgatcagtattttttcttcatccaaacagtacaagcattcttccctgatacatttgaagatttctcttaagttcaaaactaattatttttatgtacttctggtcttcacattccatgatcctcactatttatttagtcaatctttgctgacaatattcctatagtggacacatttattttaatattgattgtctttacatttcttcatctttcattttattaacactcattatttttccatctcactgctagtttagctttctttcccccaagaggaactgtaaggaacagtcagagtgtttctcagaatgttcattttcaaaagtcttgcaaaattcagcagtgacgttattgactacagaagcccttcctatgatattaaacttgcaccttaattcttgatttgcagtatctactcctaatccatctagctttcaacattttactacctttttttcttgcaaaatagttttgtttcctttcactgacctataaattggctctgcctgattcacatgcatttaaattggaaccaatcttcaggcagattgagtaaataaactttgttcaccacacgggtaacacacaattgtcttttaacagtgttgactcttgtgctattctgcttttcattgaaacacttctcaacagcaaattatttgcaaaaaatatttttaatcaagttatattacctcttataatttcttttcattcttaaagagaccaaacaaaggtaagtatgtttacaatataaatgactaggggaaagaacaaatttcatgaatgtagaggtgcagtttttcaatcccttgttaaagttcttggagagcctctttactcatagagattttgtcatgtaaatcaaaatttattcaacaaggatccattagacttttcatttgtacctgctttgtgcataatgctaaggataaaatttcacagaagacatggtatctgctcactgaaaac

SEQ ID NO: 253 - DNA, 2243 bp, Homo sapiens; identical to SEQ ID NO: 252

SEQ ID NO: 254 - DNA, 2125 bp, Homo sapiens
ggggctgaccccccatctccgtcccagacggggtggctggccgggctgaggggctcctcacttcccagtaggggggggcgggcagaggcgcccctcacctcctggacggggcggctggccgggcagggggctgacccccccacctccctcccggacggcatggctggccaggcggggggctgaccccccacctccctcccggatggggcggctggccgggcggagggctaaccccccccacctccctcccggacggggtggctgctgggcggagacgctcctcacttcccagatggggtggctgccgggcggagaggctcctcacttctcagacggggcggctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggtggccaggcggagacactcctcacttcccagacggggtggcggccgggcagaggctgcaatctcggcactttgggaggccaagggtctgacagtttgatttttaaaggccaaatctctccagactccaaagaactctgtagccaaacagcagcacatactaatcaggcctgcctgtccttagagcagcagcatagaagcctggagacatggacttccatcccatattcacattcaacagcaaaataaatccaaatataaggcagtgctacaattcaaagactgtctgagatcagatgagattgggcatgttcagcgtgatacgggtagagatgttccctcactccactggcccacagccacatgcagaccaaccctgaagaatacacccaagcggtctgcactcagatcaaaccctgatctcccacaactacatcaacacacaaacaaccaccagaatacaatctaactgctgcaacaataagcaagtcccaagagagtccaaactgaaacagttgagttgctttctccctgtttgttgggctagttcaatctgcaaatggagattccttcggaatttctcaaattgagaaaagcagatcctgctgtctggacccacaaatgacactcacttatccagacacatactcaattactaacaagccccaagagtgtctgaactggaacagtcagggtgcttcctctctccgtcagttggccttgctgaacttgccaatggaaattccttcagaatttctcaaattgagaggagccattcccactgtcggtatccacaaaagacactcacctatccacatgcagaagtcaaatttgaaaggctgttcttcctaggcaatcagaaatgtggttggggctggcagcagcaatgctaaatagaaagactaaaacccacatcctgcctaaaacacataggctgctgcttagggttgcggaaattctcccaactggtgacagccaagccaagagcaatgtcttcctgatgagggaaccaaaatctgttactgaaatgccagaggttcagcctaggtcccgttactcattgcacagaatgccaatcactgaggcaagtatttccaggggagatgactttattcagttgctgcagctgagaagaactgcagatcagtctcaaattcatctccccaagtgactgaaattgggggtttacatagcagaggagggatgtagctacgtgcaggaaataatgtagctatgtgtgggaaaacagaatttgaatttcagggcaacaggagatttgatggggaatgaacaccccacagctctgtgcaggagtgcctggaagtgaggccagtcaagggaatgctgccagacaaccaactcagcttcagaccatcttcagatcgtaacccaccagggactgtgggctttgccagaccacatttttggttactgcaa

SEQ ID NO: 255 - DNA, 2125 bp, Homo sapiens; identical to SEQ ID NO: 254

SEQ ID NO: 256 - DNA, 1709 bp, Homo sapiens
ctttgcctcttttaaaaagttctaaattgctagccagtcgggacaaatacagaatgtgaggtcctgttccagtcaatggaaactggatacagcagtagggtggatgcggcaggttataaatgatgctgtctcctttgtttggtgtacactcgtggcaaaactgctgatgagtataccctttctgcaggaagtaaaaaaaaaaaatggccacactaaataaatctatgttcaagtgctatttttttatggcactggggaacaagcatttcaaacaatttggtggcagtctgtatggggatacattctcctccaggggtggtctccagtcctctctcatgagggagtgcactcccctacctcattgaaggggccctcaggaatgacaaattgagacaaataaacccagactctcagcaacacagagagaaaaaaaaaaaaaagaaactggccagcaacctagcttaaaggatcctcacatactgtggcgacaactttgtgcacaggccaagaaagaagaagctgtgggagccaataaagtatttccttggtgatcgggactaaaaaaaaaaaaaaaaaaaaagccacaggacggtaaagcattccttagttaggacgtaccaaggagagagaaactgcagggtcagtagattattccttagtcgggatgtcttggaggttaaaaataggtgagaaatccccatagaaggggtgttgaacctcagaaagaggtgagaaatccccatgaggcgggttgaacctcagaaagaggtgaggaatccccatgggaggggggcgttgaacctcacacaaactcccagtagtaagaaaaatattcagaacccccctttcctttcttcttgggggaagaaagaatagccccactgccaccagtcccttccctagggaaaggggaaggagggggaaaacagcagcataggtggctggcatggaacaggaattaaaataaattacagaatgtgtaagcaaaaactcagttgtatataagaaaacccaattcccccctgaggaagagaaagagccggagtcctttaaaaattaactgcctgttttctgtggctagtgagccttatctctccctttcccaggcattatgaagaccctatttctctagctgtgcagctgcaaggtcactagacagataaactcaagtcataaaacatgtttttccttgaaaagaaatgatgtcatgtatgtctcaattgaataactgtctttgtttcttgcttctgttatacgcttccccctgcacaaatcttcccccacccacgaaatgcttaaaaggtccccggggccaggagagacccggcatccaaggtgtgccacagctgagcttcacccggatatatagaccagctctccccacgtcccagcaccctgcctggcagcgcaatggaaccgaggatggggctgcaggacgataccagcacttcaggaactgtgacagaatcttgctccgctgccaaggctggagtgcactggttcaatctcggctcactgcaaactctgcctcccaagttcaagtgattctcctgtgtcagtttctttaggaatacagcactccatattgttaccataataatgaaacggattcccatggctacagcgatgaagcagcagaaaaaaaatggagatgctgtcaaagaaaaaagacacagatcagagaaagaagcataaaaggtttggaacag

SEQ ID NO: 257 - DNA, 2011 bp, Homo sapiens
cgcgaacacgcagcagcgagaatctacaggggcgtggtttgcgcacgcgggaactgggatctcaaccccagggctaggtgcctcctcccgctgctttccgccagctgcggggtgtgagattaatccccgccgattagcgccaggtgtactaagcgctggatggttccctgaccagatgaaacatcagccgatgttctaatgccggtcccctgggcgctgtccccgagagggaaaacctgttttctgaccccggctctagtcggcctctggaggtctgcagctgggttattttacctttgaaacggacgacacctgccccgtgcaccccagcggctcctccacacggagagatggtgtcagtcaaaggccgtctagatgacgagtttatgaaattgttcctggcccgtgccgggcacgaccttgcagagagcccagaagatgaaaccccagccctgccaggagctcacctgctaattaggaggacaacgaatcacctcacctccctagactttgcttctcctttattcagtgagggattggactagctggtccttgaggacttttcagaaagtctggttctgggagatgaccaatgggatcatcttatgctatgagctttcctggaatgacaggtaatggagagtgaggagattttacctgatatggtcctgtttgcaccatcagccagcaacctttctgggaagcgtgcttattatgtaccaacataaaagcttgaatataaggaatctcacatcttctgccagcatcctgaaactatggcagactcacttgttaactttgcaaataaggtcaaatttcagaaccttcacagctcctgatagtcaccgtgtaatagaagattaaaagacaagctcagctcttgttccagtcagcctcattcctctgcctacaatacaaaagtcactcaatcatattcttgtcttaaattgaacagtccttacatggttaagaaaaggagaaattcattgtaaggaatgtttacattttgtttataattcctgcaagtgtaatgtttcaaaaggttttcctgtggctgaagtacatttaccctgtgtagctctagagaaatgaacttacaaactgaaaaatttcagctcagtatataaagaaaaacagattttcacaattagatctatcccaaagagaataaattttgaggtgataagctcactgctggcttagatcatcacttatgggacctctaatggggcagggatcagactagatgtgtacaaagatctcttccaactgaagctgctactgtggaggacgttgttttcagtggactctctaatcagatttattttcataccaagaaatgaagaaggtgagctgggggatgcagctgggactcagaagactgcacgtgatagactcatgagctgaagatctcgtgcttagtctggagaagctcatcaagtctagctcactttggaataagttggtgctggagaatgaattcatgctaaccaaattcaccaagagcctgatttacaaatgagagagccaaggccttaagtttagagcaaaagacaaacttccaatgactttagttttcttgtccaatatctagggcaccttcccctctccacctgctgtgtacacaggagaaataatcactccacacccgactgaacattttctaaccttatcactgtggcagaaactggctactcttcctcctgggtagacagccaggctgtatttccccgctgcccctgcagtgagaggtagccattggagccggcgcaggccaatggactctgcactggagtgacacatgctgcttccaggcctgtccctcaaacctcccacatgtcctctgtctgctcttctcacttccaaggagtgtgaccatcgtggaagccccaggttagcaatggcagattgggaggcatcgatgggaggaacctgggtccctgacttaaagcatcatggatttggactttccgttattgagaaataaacttccattgtgtttaagccttta

SEQ ID NO: 258 - DNA, 2011 bp, Homo sapiens; identical to SEQ ID NO: 257

SEQ ID NO: 259 - DNA, 2011 bp, Homo sapiens; identical to SEQ ID NO: 257

SEQ ID NO: 260 - DNA, 3920 bp, Homo sapiens
catttttaaatacttttagttcacattttttaatgtttaaaaactatgttaacagagcagttatagaacagaacttcttatatttctttatttacaccacactctgaaaaaaaaaacccagttctatttgattaactatgaatagcaaagttttgtgacttgtgactcacttaaatcacccatctgaaattcatttacaaggtttttacattaataaaacagtagtgtggtacatgtattggactcagatgaagtctaaagtacactggactctagagagtggattacataccaacgaccaagattcaagtgtttggggaaaaaaataccttagacagtctatgttggcgtcaacactaaaataaaaggcaaacatgcaggactttcaaagcttgattagataatggttctttgttttctttccttcaaatttgtgctcataattaatattcaggttccctctccccgctttcatagatcccaaagtttgagaaatgcagcaattcaattgtgaaaaaaacattcttctccccagcttctgttttcatatgtactgtgtagtggtatcagtgttaaaaatggaagatcattatgaagaaacaatttgtcatttgggtatatctgtttctataggacaaggatttgtgtctaaatattccttacttgtatctcagaggactatctgttaaataattgatcttaatgccagcataagaaatcaagggaactatttctcagacatttctttctctaaattaagtagggtttcaggttccaagtttacattgagagaactatgttacctgggagagaatgtaaatttttctaattcccaaacaaaaccactaatttctaggaaacatttattgtttatatgcagatcctagagacttctatttcagtgcagatcaacaacttcaaaaatatacagcctcctatttatttacaataatatttacatacaaatgaagtatttcctgcaataagcctcagctgcatagattcttcctttaaaaacgtaaatttgagcctgtatacagatgggcccagtttcatagcccttccttagataaaagcctaaagaaggaaaatgtctgcaccttgtgaactttacatattttgcaagaactttctctttgagatttagtgatagtttttagttgttagacaccccaccttcagcttgtacctgaaagctttatctcgttataaataattcactgtaatttaggggaagtatgtcctgttgctaaaggattctcaaacctgccatccccaaggaaaatcatgtattagtattgctaaatgatggtctgtatattctttgttttgaaggtggctagatgtttgctgtaaacttgaatgggagaattatattcttaaagtttacaccccctataagcctaaagccatttaaattgataaactgagagagactaatagattttgctctaaggtataaaatccattatctgatcatattcctgacctccccccgactccaactaaatgtgccatagtccaacactgtgcctcactgaattggaactcagtatttcattcttttgagagcagtttgtagctccttaagcagagcagacctttcagtagagaattcgctttaaaaggaggacaggattatcaccacacgattaacacaaacactggagaacttctgacacaaattcagtatttcttctaagtctgcatttacaaagggtcttttattttaatttctttcacaactgcctcgccccaaccaaagcctcactttcatttcctcacagctttaaaaaataaaatattatcatgcctcagcccgaggtaacaccgagtgcaggcagcctgtgtttaggaatttgcacctgcgctgctattttcaacgagaaggggataaccaggtggcagcgctggattcactcactttcttgccattgcagagacccctgccgccaggctcctttcctcccctccctaaagcctggctcctgtatgttgcaccatgagtcctaggaatcatctggtgagggaggactaatgggaagtaaaagggagactcattggcttagggtggttctcaaacttgatgcgctttagaatcatttgctgagtccctccctgagagcttctgacttcaccatgtctgggagggggctgagaatctgcattctaatgaggtccccgatgatgctgatgctactggtctaggggccacactttgagaaccactggcttagaggcatgaatcaagctctagaaagcagtcagttccagggtaatagtcttaggtgctcgccgaagcactgaggaatcttaccacaaccctgtgtccaccacaagccctatcaccatcacccatctgggtgcttctttttctcaacagggtctgtaactgtaaaaaaggaaagtgggtggagaggtttttttttcccccttttttcttgttttctaacctcccagcttattcctggagagttaaaacacagttactagcactaaaaacattaaaagtgctgcgcgctggcctcaatgactggtacattggagaagctatgcagcagcatccttttctgtggtgggcagggcaggagatgaaccataggagccaaaagtcagacaaacagaagaaggcacaccaagcctgaaccctccggacaacagcagagttaccagctgagggatgtccctggaggtttctgacccatgagaggcccaaaaatatcactacacatcccagttaatgataaggttctaaattgactttgtgagggtaaaatgaattgctataaagtaacaaggaaaatagaaagtagcataatatagcttgcaaactaaattatgtatttttaaaggtacagtcatcccactacctggctatttcattacttggtgctctagacaagctcccaagaactgactggatcttggcttgttctgtttctgtcattgctaatataatatggaaaacattgctgaaaagaacagagatggccatggatatggctaggttaggtattcatatccaaatatctgaactctaacctaatgtggatatgattctgtagcattatattaaaagctatgatgatgcaatgcaggaaataacctttcattctcccccctagaggatcacgacaggtgcttcaatgcctgccttatctatgggacagtagtgtgattctcagtgagagtgaaggcctttggggatttgagtcaggaagggaacatggctaagtgcctggaaactctgccaacagtctgcggttagattctacttgtctctggataagaaatctgtgctcagtgaacttatgtgtttggaaaatttaaccagaatatagaggaagcataagtcctgtttcaagagaccagctcacggagcatgcacatttctcaccataggcaagctatggacaattcaatcacatgggatggccccacttaggggaatgcagttctgggtttccttgctatccctattctttttcagctacaaactctcttctttttcagtctcttcagtttccttgtgctccctttaggagagggacaagggtaagagtaccaggcaactctgtcctcctgcatggacagttgagacgggcagtaatggcacagtccttggttggggaagagaagaggagacagcacagacactgagacccccttgtcttcctcatctgggggaaggaaggtactcagtgattctgtcagaagctcttcacaaagactatctctgagggttttttttttttttttttcacaagactagatggagaattaatgaagaagaaatagaaatgaggcttatttaaggtacaaaattcttgtatttgtaataacctagatttatagatataaaacaagtcttttaaagacttccctaaaatactcaatataaaacaggagttacttatcct

SEQ ID NO: 261 - DNA, 3920 bp, Homo sapiens; identical to SEQ ID NO: 260

SEQ ID NO: 262 - DNA, 4652 bp, Homo sapiens
catttttaaatacttttagttcacattttttaatgtttaaaaactatgttaacagagcagttatagaacagaacttcttatatttctttatttacaccacactctgaaaaaaaaaacccagttctatttgattaactatgaatagcaaagttttgtgacttgtgactcacttaaatcacccatctgaaattcatttacaaggtttttacattaataaaacagtagtgtggtacatgtattggactcagatgaagtctaaagtacactggactctagagagtggattacataccaacgaccaagattcaagtgtttggggaaaaaaataccttagacagtctatgttggcgtcaacactaaaataaaaggcaaacatgcaggactttcaaagcttgattagataatggttctttgttttctttccttcaaatttgtgctcataattaatattcaggttccctctccccgctttcatagatcccaaagtttgagaaatgcagcaattcaattgtgaaaaaaacattcttctccccagcttctgttttcatctgggagagaatgtaaatttttctaattcccaaacaaaaccactaatttctaggaaacatttattgtttatatgcagatcctagagacttctatttcagtgcagatcaacaacttcaaaaatatacagcctcctatttatttacaataatatttacatacaaatgaagtatttcctgcaataagcctcagctgcatagattcttcctttaaaaacgtaaatttgagcctgtatacagatgggcccagtttcatagcccttccttagataaaagcctaaagaaggaaaatgtctgcaccttgtgaactttacatattttgcaagaactttctctttgagatttagtgatagtttttagttgttagacaccccaccttcagcttgtacctgaaagctttatctcgttataaataattcactgtaatttaggggaagtatgtcctgttgctaaaggattctcaaacctgccatccccaaggaaaatcatgtattagtattgctaaatgatggtctgtatattctttgttttgaaggtggctagatgtttgctgtaaacttgaatgggagaattatattcttaaagtttacaccccctataagcctaaagccatttaaattgataaactgagagagactaatagattttgctctaaggtataaaatccattatctgatcatattcctgacctccccccgactccaactaaatgtgccatagtccaacactgtgcctcactgaattggaactcagtatttcattcttttgagagcagtttgtagctccttaagcagagcagacctttcagtagagaattcgctttaaaaggaggacaggattatcaccacacgattaacacaaacactggagaacttctgacacaaattcagtatttcttctaagtctgcatttacaaagggtcttttattttaatttctttcacaactgcctcgccccaaccaaagcctcactttcatttcctcacagctttaaaaaataaaatattatcatgcctcagcccgaggtaacaccgagtgcaggcagcctgtgtttaggaatttgcacctgcgctgctattttcaacgagaaggggataaccaggtggcagcgctggattcactcactttcttgccattgcagagacccctgccgccaggctcctttcctcccctccctaaagcctggctcctgtatgttgcaccatgagtcctaggaatcatctggtgagggaggactaatgggaagtaaaagggagactcattggcttagggtggttctcaaacttgatgcgctttagaatcatttgctgagtccctccctgagagcttctgacttcaccatgtctgggagggggctgagaatctgcattctaatgaggtccccgatgatgctgatgctactggtctaggggccacactttgagaaccactggcttagaggcatgaatcaagctctagaaagcagtcagttccagggtaatagtcttaggtgctcgccgaagcactgaggaatcttaccacaaccctgtgtccaccacaagccctatcaccatcacccatctgggtgcttctttttctcaacagggtctgtaactgtaaaaaaggaaagtgggtggagaggtttttttttcccccttttttcttgttttctaacctcccagcttattcctggagagttaaaacacagttactagcactaaaaacattaaaagtgctgcgcgctggcctcaatgactggtacattggagaagctatgcagcagcatccttttctgtggtgggcagggcaggagatgaaccataggagccaaaagtcagacaaacagaagaaggcacaccaagcctgaaccctccggacaacagcagagttaccagctgagggatgtccctggaggtttctgacccatgagaggccccctcaccctccttcaccctcctcctaccaccaagctctccagcagtcatggacttattcctccccgtttttactggacaccatgtttcaggccaatctggtcacctgtagtctggtggcatctctacccctactgtccagtaggtgggatgtggctgggatggacagtccagattctactaacaggcaactctgaacaaacaccctccctggaaacaatattatatttgatggttagattctttagcaaacctattacattattcgatgtcagctaacctattggtttgatcatcttttccagctgctctaggggcctaaccaccatggataacctggtctctaaaggaaaatacattccaggttgcaaacaaccaactgacaaccttttggaatatgatctccttatacactggggctgcctgtgcctaaacacagtagatttccctcctgtgcgtatttcatcagccccacttccaataagtaacattaagtaaattagggattgacagtattctgtgttacaataactagagaacagttctaagtccaaagtgtggaactggcactgttcactagtatagagatcctacctaccaaaggaaaacgtgctgctccccatgcctagggtatagtattctttaatctactaatttagcagaaaaacttccatagcacttgactgtgctgtttaaattcgacctaacatctgtgatacatgtatttttggctaccaattaactattctgaataagaataagagcagtatactttacagctaatctcacacaaaggatgtaactaatcagtgatatttgacgaattatggtagggtctattatattcagtcaacaacaaatttagagaaacatacaaaggtttttaaaaatatgggtggtgtcacacagatcaacaacactgtgcctcctctaaataaatctattttaaataaatattccttgtattgacacatgaaacccagaggcccaaaaatatcactacacatcccagttaatgataaggttctaaattgactttgtgagggtaaaatgaattgctataaagtaacaaggaaaatagaaagtagcataatatagcttgcaaactaaattatgtatttttaaaggtacagtcatcccactacctggctatttcattacttggtgctctagacaagctcccaagaactgactggatcttggcttgttctgtttctgtcattgctaatataatatggaaaacattgctgaaaagaacagagatggccatggatatggctaggttaggtattcatatccaaatatctgaactctaacctaatgtggatatgattctgtagcattatattaaaagctatgatgatgcaatgcaggaaataacctttcattctcccccctagaggatcacgacaggtgcttcaatgcctgccttatctatgggacagtagtgtgattctcagtgagagtgaaggcctttggggatttgagtcaggaagggaacatggctaagtgcctggaaactctgccaacagtctgcggttagattctacttgtctctggataagaaatctgtgctcagtgaacttatgtgtttggaaaatttaaccagaatatagaggaagcataagtcctgtttcaagagaccagctcacggagcatgcacatttctcaccataggcaagctatggacaattcaatcacatgggatggccccacttaggggaatgcagttctgggtttccttgctatccctattctttttcagctacaaactctcttctttttcagtctcttcagtttccttgtgctccctttaggagagggacaagggtaagagtaccaggcaactctgtcctcctgcatggacagttgagacgggcagtaatggcacagtccttggttggggaagagaagaggagacagcacagacactgagacccccttgtcttcctcatctgggggaaggaaggtactcagtgattctgtcagaagctcttcacaaagactatctctgagggttttttttttttttttttcacaagactagatggagaattaatgaagaagaaatagaaatgaggcttatttaaggtacaaaattcttgtatttgtaataacctagatttatagatataaaacaagtcttttaaagacttccctaaaatactcaatataaaacaggagttacttatcct

SEQ ID NO: 263 - DNA, 2528 bp, Homo sapiens
ctcatgtgacgcggtaacagctgcggcctgagtcactgggcccggcgcggggtgggccgagccccccgcccggccagggccacgtggcccctacccggaagaaggcgcccacccccgcaaagggaaagccgcaagggcaagacctcggggcgcctggggcccccctctggcgctatacctccgtgccaactcggggtaggagagcggggcggagcgcagcctgggtcactctggttcagagaagcggacgagggatcctagtctgagaaaaggggaggaagcccttccccgaagccacgctacccagtcaatcaagacacgtccgcgtcgggtcccgccctctgggggaggattgacaaggtctgtgcttccagcctcccagacagctcctgcatccgtctgtgatagcgagggcttgggggaagacacgaaggcaggagaggcttacatcctctggatttccccgtcttatcccagaagacaaagccaggtgagggctggaagcgggctagggggatcaagctgcctccctcccttgtgtgccaggggtggtccccagaaggagctgatctgaacaggccggagagtaggaccggccgtcacacccccacacctccagcctcggccccactccttgggctcttaaggtcctgcctcaagaaccacttcctgagtcttagtgtatgtgtgtacacaaagaatgaaagaagtctctagagctaaaggaaggagatccgggctgggctgagaagcatcttccaggatcacggccttcccgcgggacacaccaagcccattccggatcttgctcttcctgaccatggctggcaggctgtggaggaggagcggagagcagaagaaaggagtattcatcaggttccttattgtgctgccactagatgccaggcatgtgctaggcttgggggctgcaaggagaggaagacagcggccctgccctctgctagcaggcagaaccgagttctggccacactgtgaagaaaggcagaagcctgcggtggcagctggttaagctcagagggagggaaagggagaggagaatggatttcacggagcagaaggatgtgctcaaggtgaccttggagaataaaggggagagctccagggacagagaagcagtcgactgtggaaaaaaaaggagcattttgtaaagtacatggcaggttggggttggctggctcaaagggcttgggacggatgtggtgagatgggctgaaggtggtctgaagatcaagattgagagactagatacataacaaccaactgcaatgtttggtccttcattgaatggttgaacaaaccagctgtgaaagacattttgggacatacagacatggactgagaattagacataagaaaattattttgttaactgttatcatggttaacaaaacggtcatataatatgattatgtagagaagttactctagtttttcctctttttttttctttattctcctatcagccaatgcatttgttacaggaaaggggtcccaatccagaccacaagagagggttcttggatctcatgcaagaaagattcagggcgagtcgcagtgcaaagtataagcaagtttattaagaaagtaaagtggtgaaacaacagctgctccatagacagagtaggatgttccccaaagtaagaggaggggctaggcgcagtggctcaccacacctgtaatcccagcattttgggaggcctaggcaggtggatcacctgaggtcaggagttcgagaccagcctggccaacacggtgaaaccccgtctctactaaaaatacaaaaagtagctgggcacaatgatgtgtgcctgtagtcccagctactcaggaggctgaggcaggagaatcacttgaacccaggaggcagaggttgcagtgagcagagatcgtgttgctgcatgccatcctgggcaacaagagtgaaactccgtctctcttttttttttttttttttttgagacggagtctcgctctgtcaccagggtggagtgcagtggtgccatcttggctcactgcaacctccgcctcccgtgttcaagtgattctcctgcctcagcctcccaagtagctgggactacaggcacgcaccactacgcccagctaatttttgtgtttttagtagagatggggtttcaccatattggccaggatggtctccatctattgacctcgtgatccgccccctcagccttccaaagtgctgggattacaggcgtgagccactgtgcccggcaaaactctgtctcaaaaaaaaaaagtaagaggaggaacacattcaccctcggtataatgcttgtatatatggagagatgtgctctgctacaaaagtttgtgataaaggattaattttcttaattactgtattttgtaagaatcgatattatcttttttattattattaatttgtttccttaaccataaacatctaggttttttgtttttgtttttgtttttgagatggagttttgctcttgttgcccaggctggagtgcagtggcacaactcac

SEQ ID NO: 264 - DNA, 2528 bp, Homo sapiens; identical to SEQ ID NO: 263

SEQ ID NO: 265 - DNA, 2528 bp, Homo sapiens; identical to SEQ ID NO: 263

SEQ ID NO: 266 - DNA, 1589 bp, Homo sapiens
cgctcacggagaaaggcacctggtctgggattggagccagaaaagaaagatcacgatggcaagcagtgaggaggatggattagaggctggcagagattggggatggggacagggaagacaaaattattgtaactgaccaagagaggtctgagaagaaaaggatatgctggacctccatctgccccacccaggtccaacaactatcaacaccttgccacatttgctttgtttatccttactagttgttgtttttgtttttgttttggctaaagtatgtaaaagcaaatcccagacatcgtgttattttaaccctacaaatttaaaatgtatgagtattttcttgcataagcacaatgtcatttcatgctagacaaaattatcaaactcagtccatataaaatttcatgaatatctggaaaaatgtcttatgatttttaaaatcaggatccaaaatataagtacagtctttttgttaagagccttaggtgggtgggtgtgaacagactctttccaggatacattaaggaatatagtaaaagaaaaagacttgaaactgcagcacagcgaggaaagtcacatcaaggagaacttcctagaaatctgtgacactaaacatctagggagaaagcagggctgggatataatgtatgtatttcagcacagcagaaactaccctcaccccatttttccctttcctgcagaaacctctctcccctccccttccctcccctctcctctcctttctgtatatagttcagcacagcaaaaactaccctcaccccatttttccctttcctgcagaaacttccttccctttcctttccctttcccctttcctttccttttgatacagggttttgctctctcaccctgcgtgcagtggcacgttcatcactcactgcagcctcaaactcctaggctgaagccatcttcctcattagcctcccaagtggctaggaccacaggtgctcaccaccaagcctggctaattttttttttttttttttttgagacagagtttcgctcttgttgcccaggctggaaggctggagtacaatggcacgatctcagcttactacaacctccgcctcccgggttcaagcgattctcctgcctcagcctcctgagtggctgggattacaggcatgcaccaccacgcccagctaattttgtatttttagtagagactgggtttctctatgttggtcaggctggtctcaaactcccaacttcagctgatccacctgccttggtctcgcaaagtgctgggattacaggcgtgagccaccaagcctggcctaggcctggctaatttttttacgtttcgtagagacaaggtctcactatgttgctcaggctggtcttgaactcctgggctcaagcaatcctatgaccacggcctcccaaagtgctgggattacaggtgtgagccactacacccggcctccttatctcttttcttttcttttctttttttatttttttgagacagagtcttgctgttgcccaggctggaatgcaatggtgtgatctcggctcactgcaacctctgcctcccaggttcaagcgattctcatgcctcggcctcc

SEQ ID NO: 267 - DNA, 1650 bp, Homo sapiens
accgcattcctttctcagacactctaattaggtgttaggaatctcaatctatatagacttatttcctcataaacaagtgcataagccaaggaaacttaatctaaggtccctgggtttcatttcgggggatcatggcttatctaaaagaaatatgaggccaaagttataaactgtaagagattttctgattcaaaccactagtatctcaaatactaaaaggcaccaaaaaccagggtacgatactaaatgtccactgtgatataaagcacaggtttgacttttggtatctcagttttggtgattctttgaaagctggtaaaactcagattttcacccacaggacgggaggcatcctaaatacctgttccccaccatctttgctgttaaaaccatttaaaagcacaatgacaagcagtttgtatctccctaactggaataaaatggaaaggctaactggaaagagagaaaagagaaagtggcatctgcctagagtgacaggcaactgctgagatcgtcagagcacacctggagtaaggatgacttgtgaaaatcctaaaatcagtcctcccttttccagtaatgttcacaagcttgcctagttgggataagacggagaccccaaaacatttgagttgtcaagtcactgagaacaacaaatgtgaatgctaactaagactatctgcacagattggaaaggtggtagtaatgagtaacttcaagaaaagccatatatatctccaagacttgcattagaagctccaggagtgctctccaacggtctccttagctggcccaaggtagaagggggcccccaccagggtaagagctgaagtaaagaaggaaaggctccagcaaagcacgtggtggggaagctggtggtggggaagctggtgtcagggacactagcggagtaagaagggggccagccatccgcaatgggacccagcaacacgtgccggcttggctcctgacgccccggagacgctacaaaaacagaggggcacttctgtcgccaatagctgggcgcttccttttcgaggtggcctcgccgctgccagaatcagaggaagcaataatcgggaatgaaggataggaacaagagaaaacacgtcttgcctcctaacaaacggcctcgggtcggagcctgccagggtcccctctctgcgctcatcctggtcgccgacccgcacctccatagacttcagcctgggcctgcccgctcaggtcccaggcgcgacaccgggtcttcccaccacgccgtgcccagcggaccggtgcgggcccctcagtagctcagtccgcatgacccctccgctccagccccttccgggccagcctgttacctttccctatcagccttgattccccgacccccgaggccgcactcactgttggcgatgtcgccccccatcttatacttggtcacgaccaggtcctcagcgatagtttgctcctgttgctcgtcctcgcccgacatcttcctactaccaccactgcagcctcgtttcccctgagccgccgccgcctctgtctcccttcccagccacaggctgtggtcagagtcccctcgatcctcgaggagagggcgagcgaaagcgcgagcaagcaagggagcgggcaggcaggcgagagcgagaagctgcgagcgcg

SEQ ID NO: 268 - DNA, 764 bp, Homo sapiens
cgcattgcacgccgggagacaaaatgtctcaagaagccttgagaggcgggattttggaacccgggcgctgacgagcttccgccattggtgtgatcgcggacctagaaacttggtccgtcccatacaggtgtagaagtcggatttggagaatgctgacgggtgtccggtcaaggttaggccccagcctgccgagtgcctgcgattgcaggcacgcgccgccacacctgactggtcttggtggagacggggtttcgctgtgttggccgggccggtctccagcccctgaccgcgagtgatccgccagccttggcctcccgaggtgccaggattgcagacggagtctcgttcactcagtgctcaatggtgcccagactggagtgcagtggcgtgatctcggctcgctacggcctacacctcccagccgcctgccttggcctcccacggtgccgagattgcagcctctgcccggccgccaccccgtctgggaagtgaggagcgtctctgcctggctgcccatcgtctgggatgtgaggagcctctctgcctggctgcccagtctggaaagtgaggagcgtctgcgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtga

SEQ ID NO: 269 - DNA, 3302 bp, Homo sapiens
gagtgagcaagaaggactgagaaagaacagtcagtgaggtaggatgtaaataaggaaaagccaagggattaaaaaactgctaaaagtatgaagcggttcactttgtcaaatgctgctgagatgaacaagatgatcactggaattagcactgaggaatcatgggagaaatcctggaggagcagtttcagctgggtgaggatagaagccagattagagagggttgaaaagacactgggaggtgaggtcatggagttggtaagtacagacatacttccccagaagtcttgctgtaaagggagcagagaatggagttgcagttggaggattatgtagggtcagtggagtatttgttgtaagatggaaggttactagggcagactgtagaatgatggaggtgatccagctaaaagggacaaactagggatgcaggaaacagcctgacttggagtagtgagagggatgggagggaaactgcatgtggagtcagtgctgttggcaggagcagaggctcttcatcctgataataggagggaaggaaggaaggatgggcctgtgggaaggtatgactgctgctttgggatgtagaagggaaagcttggtatgaagttgcttttgttttagaagtgtaatatgaggccaggttatctgctgagagcagaggagggtggaggataagggggcagaggaggaggctgaatgtgtgtcttgaggctttgaagagagaagaggaaaagtaaaatagtaacagtcattttggagactagggacataaaaatggaaggattgtagagaagtaactaaaatggtcaggcagacttgagggctcatttgagatttatggttatgaatttaaagtgagacctgtcagcatgcttgtgaatttttctccagcaatatctgactatttaagtgaggtaagtgacgatataagagatattaagagcaccaaatcatattttttcaaatatctgtattcttttcttcagagacactataggagtctaaataaaaacagacaaggcatgtgttgcaaagcctttaattagaatgtttgtattttttacatcatgcataacttcacatttgtgattaattagtaattatttcaatacttgtaagctcatctgcctcagatttaatcataatacatgaattaaattaatcaaattaaggaacagcaatttagaaagaaacacactttaagaaatcaaaattctcaattcaggcagtctgtttctatcatttggtattctactcctttaaaaatttcatattgcccaacaaaaagtggttatttttactgtttttggagatgactgaacagatgaaggcatcagatgccttcatcagctggtattttgcctaagatctatttaagataaccttttcttatattttttacttaatattgggcataatcgtatcattcaagattaagtctgggttatttctttgataagaactgaatgtggccgggcgcagtggctcacgcctgtaatcccagcactttgggaggctgaggcaggagaatggcgtgaacccgggaggtggaggttgcagtgagccgagattgcgccactgcactccagcctgggcgacagagcgagactgtaaattttcaccagtattagttctatttgcaaactgaaaaatgttgtaggcttaatgtaaaataaccacattagtgaacattatatctcttagaagaaaggccatattttgctcctgcttctgtaaaaatattatttgtttgaaggggaaataatggtagtgtgacctttcacttaattcctactcccttaatgtgagagagacaaaatgagctgaagaaggaaaattctggagttacactccacaaccttgaacatactgacggacatctctgttttgacaacgatttctccatgccaccctgtagaaaaagatgaagcaaatggtgaaaggttaaaacatatcttcattgtaatatacatacttcgcactccttggggaaacaaaatattttatcaatagataaaatagtaagatagacccagctattgctatttattaaatgaagatatgtatacaaaatacttcactcctacccaaatttctcagtagagcatagaatgccgaacataaagattgagtaatgtgcgttgtacagcagcaactgcaaagtgaattccacatttattttttatgtatttatttgagacagagtctcactctgtcgcccaggctgaagtacaatggcgcaatcctctgcaacctccacctcccgggttcaagcaagtctcctgcctcagcctcccgagtggctgggattacaggcacctgccaccacacccagctaattttttgtatttttagtggagatggggttttgccatgttaggcaggctggtctcgaactcctgacctcaggtgatccatctgcctcggtctcccaaagtgctgggattacaggcgtgagccactgtgcccggcccacacttacttattctaaaaagaatttcaagatatgacaaggaactgatagagtgtgaagcatcttaaaactctagaaatcccctaaaataaattgaggagtaaaagagtaagattctggatcagttaaagtagattgtttcttcaaggatgtaggtaatacatcatttagcataagccaaaagctgcaattttgaggtgtcattagcatactttggtctttaaaagtctgctctcattgtatatatcaacagtagagtaagatagttttcccttttaacacttaaaacataccatgctctaatgccttgtggatcacggacaaccctctttgcacaagctacagcatcagcgatgttatcttgcagcaaagctgaaagacaggtggtaaggaataaaaactttaatagatattttattttaaatttaggtttagccagcttttttctgttaggctgtggaaagaatggtaagatattattttctatgagtccatatatgtgtaattgttggggaaaactctcttcattctctcccattcagcatgaaatgaagcatttttttcttcatttaccaaagtcattggaagctctggaagtattaacaaaatgattaaaggtcttctttgcactagacactgtaaaaaaacacctagtgatattttactcagcagttctattattgaaaatttatccaaaagaaataagaaatgcacccaaagatgtatacaaaaagctattcatagcaatttatgagggaaaaatggaaacaacctaagtgctcaatagtaacaattggatcagtaaattatagaatattcatatattaaa

SEQ ID NO: 270 - DNA, 3302 bp, Homo sapiens; identical to SEQ ID NO: 269

SEQ ID NO: 271 - DNA, 3302 bp, Homo sapiens; identical to SEQ ID NO: 269

SEQ ID NO: 272 - DNA, 3302 bp, Homo sapiens; identical to SEQ ID NO: 269

SEQ ID NO: 273 - DNA, 3302 bp, Homo sapiens; identical to SEQ ID NO: 269

SEQ ID NO: 274 - DNA, 4645 bp, Homo sapiens
ggggattcaccatgttggtcaggttggtctcaaactcccaacctcaggtgatccacctgccttggactcccaaagtgctgggattacaggtgtgagccatcgcacctggccacctcctaaattttctaaaatgagcacatgttatgtttacaattcgtttaaaattataatacaaaatgcattttaggttcaacctgatcaagtgaaagtgcaagggggtaaaatgagacatctttaaataaaggatataatctttcaatacattcaaccgaggcaaagaaatcccaggtgacagtgaaaataaacattttgcaaaaataaaaataatagagaggaagcagacaggagagaaaaggctttctcctctgaaggcttctttctatgaacagtagatttcaaacaaaaaccacaatcctatggagtaacacaaaaggaaggttctgaagagctgcctttacacactctgtgccaatgcagcctggggggcctctcagctttgcactgcatgacacagctccatcaaaacccagccatctggggcaggtatgcaagacattttaatgcaagctgatgaacttgcataggaagcattcattggtgaactcaaacctgtgtagaaatcacaggtatatggttccattctccctagctttaggaatagttcacggccatagaaggtgtctgttctatggatggatttccttagaatccatctaagtggctaaacaagaccaaccttctccagaatccaggacacagagcagtgcctcagctgcctacacctcacgggctgcaaatttaggtcacggtgaaagctcctgtctggcgcctgattagtttaaactgggtccgtgtcacagttcaggaaggcaggaagtttccccaccagacagagccagagttattgaccaggcattcttggcaaggctagaagtgaccttcctgaaaaccagagaagtgggtctacttctggagtttaaccacttcatgcattcatccagcaaacattctattgagaacccactgttgtcagacaccgtgcaaaaaacatcgggattaaaatggagtctaaaacctggtccttgccctataaaatattcttaaggaagactattaactcagagtatcaaaaacttctaaatgtaactatcctactgacaaggcccacttctgctaaacccttgtgcaactgatgaccaattactcaaatttgcaaattaatcaattctatgaattagaaaagataatgggccccagattagaatcagagagagggacagccagccttgccagctgtctcctttttgtctcttttttttttttttttttgagacacagtttcactctgtcgcccaggctggagtgcagtggtgccatcttagctcacagcaacctctgcctcctgggttcatgctattctcatgcctcagcctccggagttcctgggattacaggcgtgtgccaccacacccagctaatttttgtatttttagtagagatgtggtttcgccatgttggccaggctggtctcgaactcctgagctcaagtgatgcacccgcctcagcctcccaaggtgctgggattccaggtatgagccaccgcgccctgccttcctttttttctttctctccctcctctcataccctccagccaccaacgaagcctggaacccattgcttttgcaatactatttttctatttcacatgtaggtatctggaacccctgccagaggcctccaaatttttagctacacaatccgtgccatgctgtggtcccttctgcctctcccagggtgatctggagagacagaaactgcagagccaggctgaaggatcagctctccttacccccaagatacttcagagaagcaaggatctttaacttttaaagaaattcaaaccagtgaaagagattccacatcagtggtcattaacagtgtagcttaataaaatgaacccctcaaaaagaaaatgtttaatgtagatttgaaagtatatttttatgccccgtgtaatgataaactgttgacacagagcttttgtggactgtaagtaatctgaaataaggaaggcctttcaactgaactatctgtaattctacattcaacacaatgttttgaaagtagtatttgctatggactggagggaaatatcagaaaagtatatttatagagatctaaataataaacaatgggagaaaataggactagagggggacataaaggatggggcaggatcatcgacagaggatctttttcagcacaagcttagaaaaggttctctgcctcttccaaaaggctaggctgaaaagatatgatgtcactttcaagtcaacttaagactaacaagggctggaaattttcacaaagtgacaattacaagttggaagtttctttctagtatctttggctagaaagttatttcccaattctcacaaagaattccatgacaattgtatttccctgggcaattaacaggtacacagaagctcaagcgcattcctgctgaaggctgacactcatccgtgttctgggcattcgtacagagcattactggcattcacggtcccagcgaaacctgaacacagctctagagtctagaccaaatcaccggccccttgtttaaactgtttgaacccgagtgtatctgtacaccaccagtcccctggcgctctggggtgagtctggcccggtctccggtgggccctggagcttggcactctgagatacccctggctgtctggccctgcccactgcaaccaaggcctgcctgccggaatgcaagccaggtccatttttaaattcctttataagtttcacaaccgcaggtttgggtgaggagacaaacaccgctgtagtttgctgacattaaactaaaaatacccagctgcaaacaaaagccatctttaacagggctggctcggacgtcctgaggttacatgtggtagagtcggaccatatccttggcagtgtggctgccttaacaactgctccagaccgagtggggcaaaggggccgtctgtccctgcgctgtcaaggaatctgcagcctgcagccctgcctgtttgatggaaagaacagctttattcctctgccatcgacccaaacgcaggcttgatgaattcgggactgcgtctgtttaaagtgttagatacacagtgaaaggagaaggcgggaggcaaaaatgaaaaacaccaaccccacttccctggaaggaaatgcgtttccacctccctcctccttgcaattagaaaagcaaattattgctgtgactacgctgagaaaggcaactcggaggcgtagaaaatggatttctgagccaacgtggcccggcagggggctgctaagggagggtaaaagggagcaggggagccacggcttggcggggagacccgcgttacccggaaggcttctcggaacgttctacctgttgggcttcgcagccgagctgctcacccccggccgccgcgctcgagggcgcccctccctctccagaacccaaactttccctcgcacccctaggaagcgacgagcctcgtccctcccccagtccagatttcggacgtggaactttgcctgagccacaagggaccggaggaatggggttcattcccacgccgcccgggggattcccgttgctcggatcccagaagtgggggatgcaaacggacggtcagcccaggacctggccaaagtttcctccaaaactgcagtggtcaaggcgtgacccaggagctcggagtttccagctcagggctgggggctggagcaggccccggggcaccagccgcaaggtcactgcggacccggaccccgggggcaaacggccggcgcgtggtggaggggcaacgctgggcacccgaccactctccacacctgctcagctctgcgcggagcccgggacacgtgggagcccagtcccgggctcccagcctgctgcagggactcgcaacctcgccggggcgtacacccttcgcccccggcccggcaaccaggaagaggcggctcgcccgggcgcagagcagccggctccgggtaactctttcatcctccgacctcggcagcagcagggagggagtttcgttctcctcaaaccagcccctcacccccggttgcttcccacacctctccgtttccctgctacctcgcagacagacagacaagggacacaaagaaaaaaagaagaagaaaaaaaaaaaaaaaaaaactaccgcccctcctggtcccatcctccagcccggagccggtaggaagaagagggcgaagcacaccttcccttctcctccccatcccgacgcggtgacccgggtagatctgggcagccaggagctctgggcagccaggagccccgaagaggccgaaggcggagaggtagggttggaagaggcagaaatcaggcggagcgagctagagcgcgagagagaagaaaatatccaacaaaaccacgctaacgcgccccctacctgggtgcaacatactttggaaatagaagatgaccaggataaaggatcccaagcaagtggccagcaccatccggcagattctgttcatcctcatcacttccagcagcgctggcttcatggctttgtcctggctgcggggaccggggtgtccgggaagcgcggggcagagctgagcaaggctc

SEQ ID NO: 275 - DNA, 4645 bp, Homo sapiens; identical to SEQ ID NO: 274

SEQ ID NO: 276 - DNA, 8304 bp, Homo sapiens
caagaaaagtagaatggactaaaggtcttttaaaaacacacctcaccaagctcagccaccaacttaaaaaggactggacaatacttttaccactttcccttctcagaattcaggcctgtcctcgtaatgctacagggtacagcccatttaaggtcctgtatagacactcctttttattacgccccagtctcattccagacaccagaccaacttagactgtgcctcaaaaaaaacaaaaaaacttgtcatccctactatcttctgtctactcatactcctattcaccgttctcaactactcatacatgccctgctcttgtttacactgccagtttacactgtttttccaagccatcacagctgatatctcctggtgctatccccaaactgccactcttaactcttgaagtaaataaataatctttgctggcaggactatgccaaatctccttaaacactctctaatcagacatcctgagtcgtcccaattcttagaccttttatacctgtttttctccttctgttattccatttagtttttcaattcatacaaaaccgtatccaggccatcaccaatcattctatacgacaaatgtttcttctaacaaccccacaatatcaccccttaccacaagacctcccttcagcttaatctctcccactctaggttcccacgccgcccctaatcccgctcgaagcagccctgagaaacatcacccattctctctccataccaccccccaaaaaattttcgccgccccaacacttcaacactattttgttttattcttcttattaatataagaaggcaggaatatcaggcctctgagcccaagccaagccatcgcatcccctgtgacttgcacgtatacgcccagatggcctgaagtaactgaagaatcacaaaagaagtgaatatgccttgccccaccgtaactgatgacattccaccacaaaagaagtgtaaatggccggtccttgccttaactgatgacattaccttgtgaaagtccttttcctggctcatcctggctcaaaaagcacccccactgagcaccttgcgacccccactcctacccgccagagaacaaaccccctttgactgtaattttcctttactgacccaaatcctataaaacggccccacccttatctctcttcgctgactctcttttcggactcagcccacctgtacccaggtgaaataaacagctttattgctcacacaaagcctgtttggtggtctcttcacacggacgtgcatgaaagttaccaaataatattatttaatagttgtcgatttatacagcataccattaatgttaaaaccgctgttgcaagagcatttagactctttcttcatatgctatgtggcaggaattcttgacctctattttccataaatattgtatatatacctagactaaaatgtccggtgttttccactgacagcactgaatggcatcctgctatcttcaggcatctcaaattgaagtcactacagttggctggtacatcaaggggccagcagggaccacagcaccaaatcttctctcaccattatcccagataaaaagagtgtgctgcctgtagctgctagcaccctttctttgataagggagcaccccataagctgtcctggaaaggaaggtgttagttaagttgtgttgcaggttggattctccggaggcagatgcctagaagtttagggcccgaggtttatttggcaccaacacctgtggaagagagaagaagcaggattgggcagtgaaagatgtccagcagtgatatgggcatgacaaagtcttggccagaggctgtctctgtaccacccacagtggggtatgtgcagtgcagtgacatgatgatagctcactgcagcctcaacctcccaggctcaggcaatcctcctgcctcagcctcctcaagtcctcctttgaagaggtagctggacatcacatcgttgtctaccacgtagtgtgtctagataaggctgggaaaagtgaggtgggttatccctgggcatcctctggtttaacaagagtaggaactcagttgactgctcttgtttcgtataccattagacaagtccacagcagaaagtgaaagcactgccaggtacagtgactcatgcctgtattcctagtgtttagggagactgaggcaggaggatcgcttgaggccaggtgtttgagaccagcctgggcaacatagcaagaccctgtctctacaaaaatttaaaaaattagccaggtgtggtggtacacacctgtagtgccatctactcagcaggttgagggaggaggatcacttaacccgggaggccgaggctgcagtgagctatgatcacaccaatgcacttcagcctgggcaacagattgagagcctgtctcaaaaaaaaaaaaaaaaaaaaaagtgaaggcaccaagtggcaattgtcagaggctgtggcctactcaggaagcagacttggagatggagagtggtggacaggaggtttgctagggagtggtcttgggatcaccacctctggaaggggaaaggaagaaggatggggcaggaagagaagttggctgatgcattagtcagggttcactagagggaaagaactaataggatagatgtatatatgaaggggagtttattaggaagaatcaactcacaagatcacaaggtgaagtcccacaataggctgtctgcaagctaaggagcaaggaagccagtctgagttccaaaacctcaaaagtagggaagccgacaatgtggccttcagtctgtggccgtaagctcgagagcccctggcaaaccactggtctaagtccaagagtccaaaagctgaagagcttggagtctgatgttcaagagcaggaaggattcagcaagagagaaagatggaaggccagaagactcagtaagtctgctctttctacctttttcagcctgctttattctagcagctgattagatggtgcccacccagactgcaggtgggtctgcctctcccagtccactgactcaaatgttaatctcctttgacaacaccctcccagacacacccaggaacaataccttgcatctttcaattcaatcaagttgacactcaatcttaaccatcacagcctatgattcagcctcaacagagagcaaccacatggccagctctagacaaagtgggggccagacctttatatctccttataaaccagttcttggctgtgggcaccctgggaagagggcatggtggtgggtgagatgacactcttcatttgaagcaattccgatgagggctgacagctggggatctctgccagaagccctcgctgcagctggtggagtagcccttcagtcttgaggagactctgggatgacatcacagcatctgctccagaagtctgctgaacccatcctggctaactgtaatgcaactattaaccataatactttcctttaaaaatctcagacaaatgctgaaagagataagatactgagacaggaagtgtaagctgggactgtcctaagcgaatcaggaaaaagttatcctgtctataatgaagttcagggagaaagaacagcttacattaacagccttgaagaggccaggctaacagggactgctgatggggaaataaagaaataatcaaggatgaatcctatatctggggcttgagcaaatacgttcaagtcctgacactggtacctgtgaatgtgatcttatctggaaagagagactttttggcctatgagatgtgggggccccaaatccaatgactgaagtcaatggaagaagatgagaggatgcacagagagacacacaaagagaagagcaccatgtgtagatggaggcacaggttggagcgatgcagctacaagccaaggaacaccaaggaactagaaagaggcattaagaatccttccttagagccttcagagggtagctggccctgctgacaccttaattttggacttctagcctctagaattatgagtgaatacatttctgttattttaagccacagaagtggtaatttgttatagcaatgcttgggaacaaatacatataccaatatggttctattagctagtatactctaattttatagtcggtaatatcaagggagtaacacaaggtatctgcactacagaagcagatgtctgattactaggttctgtgatgaaactttgtatttcaaaaaatggatccccttcattctctccttgtttctatgtctgctgtcctgaagccagatgtgttaccatgatgtctttatactaatatactaacacagcagttctcaaagcactgttcatggacactttgagctccctgagactcttccagggggaggccaaatctattctcatactttcccttttcactgtgttgacatttgcagtgatagtgcagaagcaacgataggcaaaactgctgacaccttaggacaaatggcagtaccagcaattgcactagtagacatcttattcttcgtcttcatgactggcagaaaacaaacaaacataaaaagaatttgacttaagaatgaccttgatgaagcagcaacatgatttattaaatctttatccttcagtacaagtctttttaatattgtgtgtgatgttatggggagtacaaataaagcacttctgtgacatacagaagtacaaaaaaatagtacttgtgtaattgagttctagctaaactagcagcttttcccatgaacaccagttttacttgacaaacagacttgggctattcaggttattcagacttgggtatttggcaaacatgtccctccatgctcagagattctccttcagaggcaaccatcttagactctgttttctttactgagaatgacatttcttgtaaaagcttaaacacaggtaaggccaaggtattttgcctaaggacagaaagcataatgttgtagaggtgggttcccttccagcccattacacttcccattccactaaacgagacaggtggttttccacatttcatgcatctcctccttgagacagtgaatcaatgctgcaagagaaagaaatgccaggtggaaaagctgacaagtcagatattacacagccacttaatttttattttgtagttttcacaatttgagcaaccaagtagaatacattaaaaagatactaaaaatgcgctgtgataaaattcatttgaccaggaaatataggctttcatgtttttgtctccagctcagccttttctcatttttaatggcaactgttttctggatttggcacttattttgacaaaagctatgttgagttgcaaattgaaacatggtgcatagcttctatgattaagaaatccagaatctatccaacctaaggccttaaaggcagaaagaaatgctcagagaaaaatttctcaactttgccatgtaccgataaatgcctgatataaatattaactgttatttctgcaaacgttcccactgttttatatacttcatttcccccatttgtgagacggcaatgtattctggaaatttgatggatagaaactcgtgattgagtcttctcagcatgggataggtcagtatttgtgactcagctggctggtgccagagtggagaactcgtctgatttgtttccaccccaggcactgaaggattttcaagattttcctcttaatatttggttttacttgataatcctagagcatgctgggaaatctcagcaagagaaaaaatttagtaaccacagggaggcctgctcagagggctgtgggtaagtatgaaagcttatgtgtatgcctactaataactcttgaatattttgcttttcacaaggttttccttcaacaaaaagtatgtaggcttgtaaggacagtgggcctttagaaaactcagccattcccagaaagacaaatgcacatttgagtcatttcccaagagagatgtcactagtcaggaaggtatgtggaaccacacggttcagcttgcaatttagaatttcaaaagcaggagttggccaaaagttgcctagggtttttaacctcacgtttttaccataaattttctttcttatttgttgagtgctgacctcacccttgtcataggtgggatagaagagatgctagctgcctctgatcaacattggagaaaatgcccaattaagaaataggcttcatagccaaggtgactaaatcccaaaggcttgtttgttttctttgtgcaacccaacttcttatgggcttgcttttggattctgttgtttcctttgtttttgtttggttggttgtttatatgttgttactaagactctgtcttggagatgttggacaataggctagtgtctcattggatctaggtgttccagatgtgagctaggtcctagaaggaggtggtaagaaggctttgcactatgccctggggagggctgttttgctggcgggtgaccaggttctgagggagtctgtacctagtagattttctcaacattcagcaggtgtgtgagacacctgacatggctgatcttggtacagaaggaatccagctggaagtgatctgtgtgtagcatgtctcatagaaatacaaggagccttgtcttgtgaccctgtacctgtaaggcctcaaaggacctcactcataacagctaggatgactctatgaacccctatatgctggaaatagccccagcttaatttagtttaattcagttcacacttattaggttcctactaagaaaaataatttgcttgaacataattattttttgtgatttagtttatcctcattttaattggaagaaactggggattagagagggtaagtggcttatccaagttcatacgactggttcttcctgccacatggcttcattttgataagaaatatgactttctcttctgtgataaaaataagatcttgtgccctggtgagttggacagtctgggagttctgcctgttctgattttttttcctggtgggatattggatgaaacattctaatactcaattctaaattcatggtaactttgggaaatgtatgtgcttgtgtacatgtgtgcgcatgtgtgtgtatgtgaaatagaatgtatgatagttgtcccagggtagatttcctgaaacaaactcatgtctattggggcactcatcataccttccctttactctgtgtctaatgctggtctcccttaggctcatcaattaggaaagcctatagctgttgccacataactgtctggaactctcaatgttgatatatcatttttatctgtttatagacaaatgaaaatttagccactttttttattacttaaattgaagacagctcaagcctgtctcaacaatgtgagaatgtcttctttttataatctcaagtccttatgatgcttatgcaaacctttttaaagaataaatataaaaggaatattgcccctgattatgtaaagctgatgtggcagacatggtagattgtcttgtttgacatctgtactatctcattctcgtctgctcttccatatagcgtttgtcaggaatccttgttttgaaggatcttgatatgttttggatacaaattttagtggcagcagtgctgaaggcaccattcactcttttgagtctagcagaagcaaagccacattaaagcccatagttcttagcagctttccaattcccagattgcagagagtgcagataagttactgtattcctgaagtggtttcctgattccctcatatatcagtcaagaatctccaaagaaacagaaaaaatagaagatatatatgttaaagaattggcttgagtgattttggggactggcaagtccaaaatttgtaggacaggccagctggctggaaactgagataggaagtgatatagtcttgggtgtgaaacctgtaggacaggctggcaggctggaagctcaggaaggatttacattaaaatgttgaggcaaaaagtaaaataaataaaatggtgaggtggaattctccattctctagaaaatcccaatttttgctcttaacaccttcaactgattagataatgtgtgcccacattatctttaaaagtaatgttctttaaagtcaactgattgtagatattaatcccatctacaaaatacctttatagcaatatctagattagtgtttgaccaaacaactgggcaccatagctgagccaaactgacacataaaattaaccgtcacatctagtttcctgactgtggcagagataacgatgaacttgatgggccacttaagcaggattcttctagaaatctgtcctggagtttcatcctagaatctgctatgacaaccagctcatctaagaaattt

SEQ ID NO: 277 - DNA, 7622 bp, Homo sapiens
caagaaaagtagaatggactaaaggtcttttaaaaacacacctcaccaagctcagccaccaacttaaaaaggactggacaatacttttaccactttcccttctcagaattcaggcctgtcctcgtaatgctacagggtacagcccatttaaggtcctgtatagacactcctttttattacgccccagtctcattccagacaccagaccaacttagactgtgcctcaaaaaaaacaaaaaaacttgtcatccctactatcttctgtctactcatactcctattcaccgttctcaactactcatacatgccctgctcttgtttacactgccagtttacactgtttttccaagccatcacagctgatatctcctggtgctatccccaaactgccactcttaactcttgaagtaaataaataatctttgctggcaggactatgccaaatctccttaaacactctctaatcagacatcctgagtcgtcccaattcttagaccttttatacctgtttttctccttctgttattccatttagtttttcaattcatacaaaaccgtatccaggccatcaccaatcattctatacgacaaatgtttcttctaacaaccccacaatatcaccccttaccacaagacctcccttcagcttaatctctcccactctaggttcccacgccgcccctaatcccgctcgaagcagccctgagaaacatcacccattctctctccataccaccccccaaaaaattttcgccgccccaacacttcaacactattttgttttattcttcttattaatataagaaggcaggaatatcaggcctctgagcccaagccaagccatcgcatcccctgtgacttgcacgtatacgcccagatggcctgaagtaactgaagaatcacaaaagaagtgaatatgccttgccccaccgtaactgatgacattccaccacaaaagaagtgtaaatggccggtccttgccttaactgatgacattaccttgtgaaagtccttttcctggctcatcctggctcaaaaagcacccccactgagcaccttgcgacccccactcctacccgccagagaacaaaccccctttgactgtaattttcctttactgacccaaatcctataaaacggccccacccttatctctcttcgctgactctcttttcggactcagcccacctgtacccaggtgaaataaacagctttattgctcacacaaagcctgtttggtggtctcttcacacggacgtgcatgaaagttaccaaataatattatttaatagttgtcgatttatacagcataccattaatgttaaaaccgctgttgcaagagcatttagactctttcttcatatgctatgtggcaggaattcttgacctctattttccataaatattgtatatatacctagactaaaatgtccggtgttttccactgacagcactgaatggcatcctgctatcttcaggcatctcaaattgaagtcactacagttggctggtacatcaaggggccagcagggaccacagcaccaaatcttctctcaccattatcccagataaaaagagtgtgctgcctgtagctgctagcaccctttctttgataagggagcaccccataagctgtcctggaaaggaaggtgttagttaagttgtgttgcaggttggattctccggaggcagatgcctagaagtttagggcccgaggtttatttggcaccaacacctgtggaagagagaagaagcaggattgggcagtgaaagatgtccagcagtgatatgggcatgacaaagtcttggccagaggctgtctctgtaccacccacagtggggtatgtgcagtgcagtgacatgatgatagctcactgcagcctcaacctcccaggctcaggcaatcctcctgcctcagcctcctcaagtcctcctttgaagaggtagctggacatcacatcgttgtctaccacgtagtgtgtctagataaggctgggaaaagtgaggtgggttatccctgggcatcctctggtttaacaagagtaggaactcagttgactgctcttgtttcgtataccattagacaagtccacagcagaaagtgaaagcactgccaggtacagtgactcatgcctgtattcctagtgtttagggagactgaggcaggaggatcgcttgaggccaggtgtttgagaccagcctgggcaacatagcaagaccctgtctctacaaaaatttaaaaaattagccaggtgtggtggtacacacctgtagtgccatctactcagcaggttgagggaggaggatcacttaacccgggaggccgaggctgcagtgagctatgatcacaccaatgcacttcagcctgggcaacagattgagagcctgtctcaaaaaaaaaaaaaaaaaaaaaagtgaaggcaccaagtggcaattgtcagaggctgtggcctactcaggaagcagacttggagatggagagtggtggacaggaggtttgctagggagtggtcttgggatcaccacctctggaaggggaaaggaagaaggatggggcaggaagagaagttggctgatgcattagtcagggttcactagagggaaagaactaataggatagatgtatatatgaaggggagtttattaggaagaatcaactcacaagatcacaaggtgaagtcccacaataggctgtctgcaagctaaggagcaaggaagccagtctgagttccaaaacctcaaaagtagggaagccgacaatgtggccttcagtctgtggccgtaagctcgagagcccctggcaaaccactggtctaagtccaagagtccaaaagctgaagagcttggagtctgatgttcaagagcaggaaggattcagcaagagagaaagatggaaggccagaagactcaaggccaggctaacagggactgctgatggggaaataaagaaataatcaaggatgaatcctatatctggggcttgagcaaatacgttcaagtcctgacactggtacctgtgaatgtgatcttatctggaaagagagactttttggcctatgagatgtgggggccccaaatccaatgactgaagtcaatggaagaagatgagaggatgcacagagagacacacaaagagaagagcaccatgtgtagatggaggcacaggttggagcgatgcagctacaagccaaggaacaccaaggaactagaaagaggcattaagaatccttccttagagccttcagagggtagctggccctgctgacaccttaattttggacttctagcctctagaattatgagtgaatacatttctgttattttaagccacagaagtggtaatttgttatagcaatgcttgggaacaaatacatataccaatatggttctattagctagtatactctaattttatagtcggtaatatcaagggagtaacacaaggtatctgcactacagaagcagatgtctgattactaggttctgtgatgaaactttgtatttcaaaaaatggatccccttcattctctccttgtttctatgtctgctgtcctgaagccagatgtgttaccatgatgtctttatactaatatactaacacagcagttctcaaagcactgttcatggacactttgagctccctgagactcttccagggggaggccaaatctattctcatactttcccttttcactgtgttgacatttgcagtgatagtgcagaagcaacgataggcaaaactgctgacaccttaggacaaatggcagtaccagcaattgcactagtagacatcttattcttcgtcttcatgactggcagaaaacaaacaaacataaaaagaatttgacttaagaatgaccttgatgaagcagcaacatgatttattaaatctttatccttcagtacaagtctttttaatattgtgtgtgatgttatggggagtacaaataaagcacttctgtgacatacagaagtacaaaaaaatagtacttgtgtaattgagttctagctaaactagcagcttttcccatgaacaccagttttacttgacaaacagacttgggctattcaggttattcagacttgggtatttggcaaacatgtccctccatgctcagagattctccttcagaggcaaccatcttagactctgttttctttactgagaatgacatttcttgtaaaagcttaaacacaggtaaggccaaggtattttgcctaaggacagaaagcataatgttgtagaggtgggttcccttccagcccattacacttcccattccactaaacgagacaggtggttttccacatttcatgcatctcctccttgagacagtgaatcaatgctgcaagagaaagaaatgccaggtggaaaagctgacaagtcagatattacacagccacttaatttttattttgtagttttcacaatttgagcaaccaagtagaatacattaaaaagatactaaaaatgcgctgtgataaaattcatttgaccaggaaatataggctttcatgtttttgtctccagctcagccttttctcatttttaatggcaactgttttctggatttggcacttattttgacaaaagctatgttgagttgcaaattgaaacatggtgcatagcttctatgattaagaaatccagaatctatccaacctaaggccttaaaggcagaaagaaatgctcagagaaaaatttctcaactttgccatgtaccgataaatgcctgatataaatattaactgttatttctgcaaacgttcccactgttttatatacttcatttcccccatttgtgagacggcaatgtattctggaaatttgatggatagaaactcgtgattgagtcttctcagcatgggataggtcagtatttgtgactcagctggctggtgccagagtggagaactcgtctgatttgtttccaccccaggcactgaaggattttcaagattttcctcttaatatttggttttacttgataatcctagagcatgctgggaaatctcagcaagagaaaaaatttagtaaccacagggaggcctgctcagagggctgtgggtaagtatgaaagcttatgtgtatgcctactaataactcttgaatattttgcttttcacaaggttttccttcaacaaaaagtatgtaggcttgtaaggacagtgggcctttagaaaactcagccattcccagaaagacaaatgcacatttgagtcatttcccaagagagatgtcactagtcaggaaggtatgtggaaccacacggttcagcttgcaatttagaatttcaaaagcaggagttggccaaaagttgcctagggtttttaacctcacgtttttaccataaattttctttcttatttgttgagtgctgacctcacccttgtcataggtgggatagaagagatgctagctgcctctgatcaacattggagaaaatgcccaattaagaaataggcttcatagccaaggtgactaaatcccaaaggcttgtttgttttctttgtgcaacccaacttcttatgggcttgcttttggattctgttgtttcctttgtttttgtttggttggttgtttatatgttgttactaagactctgtcttggagatgttggacaataggctagtgtctcattggatctaggtgttccagatgtgagctaggtcctagaaggaggtggtaagaaggctttgcactatgccctggggagggctgttttgctggcgggtgaccaggttctgagggagtctgtacctagtagattttctcaacattcagcaggtgtgtgagacacctgacatggctgatcttggtacagaaggaatccagctggaagtgatctgtgtgtagcatgtctcatagaaatacaaggagccttgtcttgtgaccctgtacctgtaaggcctcaaaggacctcactcataacagctaggatgactctatgaacccctatatgctggaaatagccccagcttaatttagtttaattcagttcacacttattaggttcctactaagaaaaataatttgcttgaacataattattttttgtgatttagtttatcctcattttaattggaagaaactggggattagagagggtaagtggcttatccaagttcatacgactggttcttcctgccacatggcttcattttgataagaaatatgactttctcttctgtgataaaaataagatcttgtgccctggtgagttggacagtctgggagttctgcctgttctgattttttttcctggtgggatattggatgaaacattctaatactcaattctaaattcatggtaactttgggaaatgtatgtgcttgtgtacatgtgtgcgcatgtgtgtgtatgtgaaatagaatgtatgatagttgtcccagggtagatttcctgaaacaaactcatgtctattggggcactcatcataccttccctttactctgtgtctaatgctggtctcccttaggctcatcaattaggaaagcctatagctgttgccacataactgtctggaactctcaatgttgatatatcatttttatctgtttatagacaaatgaaaatttagccactttttttattacttaaattgaagacagctcaagcctgtctcaacaatgtgagaatgtcttctttttataatctcaagtccttatgatgcttatgcaaacctttttaaagaataaatataaaaggaatattgcccctgattatgtaaagctgatgtggcagacatggtagattgtcttgtttgacatctgtactatctcattctcgtctgctcttccatatagcgtttgtcaggaatccttgttttgaaggatcttgatatgttttggatacaaattttagtggcagcagtgctgaaggcaccattcactcttttgagtctagcagaagcaaagccacattaaagcccatagttcttagcagctttccaattcccagattgcagagagtgcagataagttactgtattcctgaagtggtttcctgattccctcatatatcagtcaagaatctccaaagaaacagaaaaaatagaagatatatatgttaaagaattggcttgagtgattttggggactggcaagtccaaaatttgtaggacaggccagctggctggaaactgagataggaagtgatatagtcttgggtgtgaaacctgtaggacaggctggcaggctggaagctcaggaaggatttacattaaaatgttgaggcaaaaagtaaaataaataaaatggtgaggtggaattctccattctctagaaaatcccaatttttgctcttaacaccttcaactgattagataatgtgtgcccacattatctttaaaagtaatgttctttaaagtcaactgattgtagatattaatcccatctacaaaatacctttatagcaatatctagattagtgtttgaccaaacaactgggcaccatagctgagccaaactgacacataaaattaaccgtcacatctagtttcctgactgtggcagagataacgatgaacttgatgggccacttaagcaggattcttctagaaatctgtcctggagtttcatcctagaatctgctatgacaaccagctcatctaagaaattt

SEQ ID NO: 278 - DNA, 7755 bp, Homo sapiens
caagaaaagtagaatggactaaaggtcttttaaaaacacacctcaccaagctcagccaccaacttaaaaaggactggacaatacttttaccactttcccttctcagaattcaggcctgtcctcgtaatgctacagggtacagcccatttaaggtcctgtatagacactcctttttattacgccccagtctcattccagacaccagaccaacttagactgtgcctcaaaaaaaacaaaaaaacttgtcatccctactatcttctgtctactcatactcctattcaccgttctcaactactcatacatgccctgctcttgtttacactgccagtttacactgtttttccaagccatcacagctgatatctcctggtgctatccccaaactgccactcttaactcttgaagtaaataaataatctttgctggcaggactatgccaaatctccttaaacactctctaatcagacatcctgagtcgtcccaattcttagaccttttatacctgtttttctccttctgttattccatttagtttttcaattcatacaaaaccgtatccaggccatcaccaatcattctatacgacaaatgtttcttctaacaaccccacaatatcaccccttaccacaagacctcccttcagcttaatctctcccactctaggttcccacgccgcccctaatcccgctcgaagcagccctgagaaacatcacccattctctctccataccaccccccaaaaaattttcgccgccccaacacttcaacactattttgttttattcttcttattaatataagaaggcaggaatatcaggcctctgagcccaagccaagccatcgcatcccctgtgacttgcacgtatacgcccagatggcctgaagtaactgaagaatcacaaaagaagtgaatatgccttgccccaccgtaactgatgacattccaccacaaaagaagtgtaaatggccggtccttgccttaactgatgacattaccttgtgaaagtccttttcctggctcatcctggctcaaaaagcacccccactgagcaccttgcgacccccactcctacccgccagagaacaaaccccctttgactgtaattttcctttactgacccaaatcctataaaacggccccacccttatctctcttcgctgactctcttttcggactcagcccacctgtacccaggtgaaataaacagctttattgctcacacaaagcctgtttggtggtctcttcacacggacgtgcatgaaagttaccaaataatattatttaatagttgtcgatttatacagcataccattaatgttaaaaccgctgttgcaagagcatttagactctttcttcatatgctatgtggcaggaattcttgacctctattttccataaatattgtatatatacctagactaaaatgtccggtgttttccactgacagcactgaatggcatcctgctatcttcaggcatctcaaattgaagtcactacagttggctggtacatcaaggggccagcagggaccacagcaccaaatcttctctcaccattatcccagataaaaagagtgtgctgcctgtagctgctagcaccctttctttgataagggagcaccccataagctgtcctggaaaggaaggtgttagttaagttgtgttgcaggttggattctccggaggcagatgcctagaagtttagggcccgaggtttatttggcaccaacacctgtggaagagagaagaagcaggattgggcagtgaaagatgtccagcagtgatatgggcatgacaaagtcttggccagaggctgtctctgtaccacccacagtggggtatgtgcagtgcagtgacatgatgatagctcactgcagcctcaacctcccaggctcaggcaatcctcctgcctcagcctcctcaagtcctcctttgaagaggtagctggacatcacatcgttgtctaccacgtagtgtgtctagataaggctgggaaaagtgaggtgggttatccctgggcatcctctggtttaacaagagtaggaactcagttgactgctcttgtttcgtataccattagacaagtccacagcagaaagtgaaagcactgccaggtacagtgactcatgcctgtattcctagtgtttagggagactgaggcaggaggatcgcttgaggccaggtgtttgagaccagcctgggcaacatagcaagaccctgtctctacaaaaatttaaaaaattagccaggtgtggtggtacacacctgtagtgccatctactcagcaggttgagggaggaggatcacttaacccgggaggccgaggctgcagtgagctatgatcacaccaatgcacttcagcctgggcaacagattgagagcctgtctcaaaaaaaaaaaaaaaaaaaaaagtgaaggcaccaagtggcaattgtcagaggctgtggcctactcaggaagcagacttggagatggagagtggtggacaggaggtttgctagggagtggtcttgggatcaccacctctggaaggggaaaggaagaaggatggggcaggaagagaagttggctgatgcattagtcagggttcactagagggaaagaactaataggatagatgtatatatgaaggggagtttattaggaagaatcaactcacaagatcacaaggtgaagtcccacaataggctgtctgcaagctaaggagcaaggaagccagtctgagttccaaaacctcaaaagtagggaagccgacaatgtggccttcagtctgtggccgtaagctcgagagcccctggcaaaccactggtctaagtccaagagtccaaaagctgaagagcttggagtctgatgttcaagagcaggaaggattcagcaagagagaaagatggaaggccagaagactcaacaaatgctgaaagagataagatactgagacaggaagtgtaagctgggactgtcctaagcgaatcaggaaaaagttatcctgtctataatgaagttcagggagaaagaacagcttacattaacagccttgaagaggccaggctaacagggactgctgatggggaaataaagaaataatcaaggatgaatcctatatctggggcttgagcaaatacgttcaagtcctgacactggtacctgtgaatgtgatcttatctggaaagagagactttttggcctatgagatgtgggggccccaaatccaatgactgaagtcaatggaagaagatgagaggatgcacagagagacacacaaagagaagagcaccatgtgtagatggaggcacaggttggagcgatgcagctacaagccaaggaacaccaaggaactagaaagaggcattaagaatccttccttagagccttcagagggtagctggccctgctgacaccttaattttggacttctagcctctagaattatgagtgaatacatttctgttattttaagccacagaagtggtaatttgttatagcaatgcttgggaacaaatacatataccaatatggttctattagctagtatactctaattttatagtcggtaatatcaagggagtaacacaaggtatctgcactacagaagcagatgtctgattactaggttctgtgatgaaactttgtatttcaaaaaatggatccccttcattctctccttgtttctatgtctgctgtcctgaagccagatgtgttaccatgatgtctttatactaatatactaacacagcagttctcaaagcactgttcatggacactttgagctccctgagactcttccagggggaggccaaatctattctcatactttcccttttcactgtgttgacatttgcagtgatagtgcagaagcaacgataggcaaaactgctgacaccttaggacaaatggcagtaccagcaattgcactagtagacatcttattcttcgtcttcatgactggcagaaaacaaacaaacataaaaagaatttgacttaagaatgaccttgatgaagcagcaacatgatttattaaatctttatccttcagtacaagtctttttaatattgtgtgtgatgttatggggagtacaaataaagcacttctgtgacatacagaagtacaaaaaaatagtacttgtgtaattgagttctagctaaactagcagcttttcccatgaacaccagttttacttgacaaacagacttgggctattcaggttattcagacttgggtatttggcaaacatgtccctccatgctcagagattctccttcagaggcaaccatcttagactctgttttctttactgagaatgacatttcttgtaaaagcttaaacacaggtaaggccaaggtattttgcctaaggacagaaagcataatgttgtagaggtgggttcccttccagcccattacacttcccattccactaaacgagacaggtggttttccacatttcatgcatctcctccttgagacagtgaatcaatgctgcaagagaaagaaatgccaggtggaaaagctgacaagtcagatattacacagccacttaatttttattttgtagttttcacaatttgagcaaccaagtagaatacattaaaaagatactaaaaatgcgctgtgataaaattcatttgaccaggaaatataggctttcatgtttttgtctccagctcagccttttctcatttttaatggcaactgttttctggatttggcacttattttgacaaaagctatgttgagttgcaaattgaaacatggtgcatagcttctatgattaagaaatccagaatctatccaacctaaggccttaaaggcagaaagaaatgctcagagaaaaatttctcaactttgccatgtaccgataaatgcctgatataaatattaactgttatttctgcaaacgttcccactgttttatatacttcatttcccccatttgtgagacggcaatgtattctggaaatttgatggatagaaactcgtgattgagtcttctcagcatgggataggtcagtatttgtgactcagctggctggtgccagagtggagaactcgtctgatttgtttccaccccaggcactgaaggattttcaagattttcctcttaatatttggttttacttgataatcctagagcatgctgggaaatctcagcaagagaaaaaatttagtaaccacagggaggcctgctcagagggctgtgggtaagtatgaaagcttatgtgtatgcctactaataactcttgaatattttgcttttcacaaggttttccttcaacaaaaagtatgtaggcttgtaaggacagtgggcctttagaaaactcagccattcccagaaagacaaatgcacatttgagtcatttcccaagagagatgtcactagtcaggaaggtatgtggaaccacacggttcagcttgcaatttagaatttcaaaagcaggagttggccaaaagttgcctagggtttttaacctcacgtttttaccataaattttctttcttatttgttgagtgctgacctcacccttgtcataggtgggatagaagagatgctagctgcctctgatcaacattggagaaaatgcccaattaagaaataggcttcatagccaaggtgactaaatcccaaaggcttgtttgttttctttgtgcaacccaacttcttatgggcttgcttttggattctgttgtttcctttgtttttgtttggttggttgtttatatgttgttactaagactctgtcttggagatgttggacaataggctagtgtctcattggatctaggtgttccagatgtgagctaggtcctagaaggaggtggtaagaaggctttgcactatgccctggggagggctgttttgctggcgggtgaccaggttctgagggagtctgtacctagtagattttctcaacattcagcaggtgtgtgagacacctgacatggctgatcttggtacagaaggaatccagctggaagtgatctgtgtgtagcatgtctcatagaaatacaaggagccttgtcttgtgaccctgtacctgtaaggcctcaaaggacctcactcataacagctaggatgactctatgaacccctatatgctggaaatagccccagcttaatttagtttaattcagttcacacttattaggttcctactaagaaaaataatttgcttgaacataattattttttgtgatttagtttatcctcattttaattggaagaaactggggattagagagggtaagtggcttatccaagttcatacgactggttcttcctgccacatggcttcattttgataagaaatatgactttctcttctgtgataaaaataagatcttgtgccctggtgagttggacagtctgggagttctgcctgttctgattttttttcctggtgggatattggatgaaacattctaatactcaattctaaattcatggtaactttgggaaatgtatgtgcttgtgtacatgtgtgcgcatgtgtgtgtatgtgaaatagaatgtatgatagttgtcccagggtagatttcctgaaacaaactcatgtctattggggcactcatcataccttccctttactctgtgtctaatgctggtctcccttaggctcatcaattaggaaagcctatagctgttgccacataactgtctggaactctcaatgttgatatatcatttttatctgtttatagacaaatgaaaatttagccactttttttattacttaaattgaagacagctcaagcctgtctcaacaatgtgagaatgtcttctttttataatctcaagtccttatgatgcttatgcaaacctttttaaagaataaatataaaaggaatattgcccctgattatgtaaagctgatgtggcagacatggtagattgtcttgtttgacatctgtactatctcattctcgtctgctcttccatatagcgtttgtcaggaatccttgttttgaaggatcttgatatgttttggatacaaattttagtggcagcagtgctgaaggcaccattcactcttttgagtctagcagaagcaaagccacattaaagcccatagttcttagcagctttccaattcccagattgcagagagtgcagataagttactgtattcctgaagtggtttcctgattccctcatatatcagtcaagaatctccaaagaaacagaaaaaatagaagatatatatgttaaagaattggcttgagtgattttggggactggcaagtccaaaatttgtaggacaggccagctggctggaaactgagataggaagtgatatagtcttgggtgtgaaacctgtaggacaggctggcaggctggaagctcaggaaggatttacattaaaatgttgaggcaaaaagtaaaataaataaaatggtgaggtggaattctccattctctagaaaatcccaatttttgctcttaacaccttcaactgattagataatgtgtgcccacattatctttaaaagtaatgttctttaaagtcaactgattgtagatattaatcccatctacaaaatacctttatagcaatatctagattagtgtttgaccaaacaactgggcaccatagctgagccaaactgacacataaaattaaccgtcacatctagtttcctgactgtggcagagataacgatgaacttgatgggccacttaagcaggattcttctagaaatctgtcctggagtttcatcctagaatctgctatgacaaccagctcatctaagaaattt

SEQ ID NO: 279 - DNA, 7715 bp, Homo sapiens
gtcaggcctctgagcccaagccaagccatcgcatcccccgtgacttgcacgtatacgcccagatggcctgaagtaactgaagaatcacaaaagaagtgaatatgccttgccccaccgtaactgatgacattccaccacaaaagaagtgtaaatggctggtccttgccttaactgatgacattaccttgtgaaagtccttttcctggctcatcctggctcaaaaagcacccccactgagcaccttgcgacccccactcctacccgccagagaacaaaccccctttgactgtaattttcctttacctacccaaatcctataaaacggccccacgcttatttcccttcgctgactctcttttcggactcagcccacctgcacccaggtgaaataaacagctttactgctctcacacaaagcctgtttggtggtctcttcacacggacgcgcatgaaatttggtgctgtgactcggattgggggacctcccttgggagatcaatcccctgtcctcctgttctttgctccatgagaaagatccacctacgacctcaggtcctcagaccgaccagcccaagaaacatctcaccaatttcaaatccggtaagcggcctctttttactctcttctccaacctccctcactatccctcaacctctttctcctttcaatcgtggcgccacacttcaatctctcccttctcttaatttcaattcctttcattttctggtagagacaaaagagacatgttttatccgtgaacccaaaactccggcgccggtcacggactgggaaggcagccttcccttggtgtttgatcattgcagggacgcctctctgagtatacactcacgtttcaagggtgtcagaccatgcagggacgcctgccttggtccttcacccttagcggcaagtcccgctttcctggggcaggggcaagtacccctcaaccccttccccttcacccttagcagcaagtgctgctttcctggggcaggggcaagtacccctcaaccccttctccttcacccttagcggcaagtcccgctttcctagggggcaagaaccccccaatcgcttatttccgccgcaccccaacctcttatctctgtgccccaatcacttatttctgcaccctgacctcttatctctgtgccccaatcccttatttccctgccccaaccccttctctgctttcctggagggcaagaaccctccgccccttctccctgtctctactcttttctctgggcttgcctccttcactatgggtaagcttccaccttccattcctccttcttctcccttagcctgtgttctcaaaaacttaaaacctcttcaactcacatctgacctaaaacctaaatgccttattttcttctgcaatgctgcttgaccccaatacaaactcgacagtagttccaaatagccagaaaatggcactttgaatttttccatcctgcaaaattcaataattcttgtcgtaaaataggcaaacagtctgaggtgcctgacgtccaggcattcttttacacatcagtcccttcctagtctctgtgaccagtgcaactcgtcccaaatcttccttctttccctcccgcctgtcccctcagtaccaaccccaagtgtcgctgagtctttctaatcttccttttctgcagacccatctgacctctcccttcctccccaggttgttcctcgccaggccgagctaggtcccaattcttcctcagcctctgctcctccaccctataatctttttatcgcctcccctcctcacacctggtcgggcttacagtttcgttccgtgactagccctccccctcctgcccagcaatttactcttaaaaaggtggctggagctaaaggcatagtcaaggttaatgctcctttttctttatcccaaatcagaagcgtttaggctctttttcatcaaatataaaaatccagcccagttcatgacttgtttggcagcaaccccgagacgctttacagccctagaccctaaaaggtcaaaaggccgtcttattctcaaaatacattttattacccaatctgctccagacattaaaactccaaaaattaaattccggccctcaaaccccacaacaggatttagttaacctcgccttcaaggtgtacaataatagaaaaaagttgcaattccttgcctccactgtgagacaaaccccagccacatctccagcacacaagaacttccaaatgcctgaacggcagcggccaggcgttcctccagaacctcctcccacaggagcttgctacatgtgccgggaatctggccactgggccaaggaatgcccgcagcctgggattcctcctaagccgtgtcctatctgtgtgggaccccactgaaaatcggactgttctactcacctggcagccactcccagagcccctggaactctggcccaaggctctctgactgactccttcccagatcttctcggcttagcggctgaagactgacaccggccgatcgcctcggaagccccctagaccatcacggatgccgagcttcgggtaactctaacagtggaagcactgaatggcatcctgctatcttcaggcatctcaaattgaagtcactacagttggctggtacatcaaggggccagcagggaccacagcaccaaatcttctctcaccattatcccagataaaaagagtgtgctgcctgtagctgctagcaccctttctttgataagggagcaccccataagctgtcctggaaaggaaggtgttagttaagttgtgttgcaggttggattctccggaggcagatgcctagaagtttagggcccgaggtttatttggcaccaacacctgtggaagagagaagaagcaggattgggcagtgaaagatgtccagcagtgatatgggcatgacaaagtcttggccagaggctgtctctgtaccacccacagtggggtatgtgcagtgcagtgacatgatgatagctcactgcagcctcaacctcccaggctcaggcaatcctcctgcctcagcctcctcaagtcctcctttgaagaggtagctggacatcacatcgttgtctaccacgtagtgtgtctagataaggctgggaaaagtgaggtgggttatccctgggcatcctctggtttaacaagagtaggaactcagttgactgctcttgtttcgtataccattagacaagtccacagcagaaagtgaaagcactgccaggtacagtgactcatgcctgtattcctagtgtttagggagactgaggcaggaggatcgcttgaggccaggtgtttgagaccagcctgggcaacatagcaagaccctgtctctacaaaaatttaaaaaattagccaggtgtggtggtacacacctgtagtgccatctactcagcaggttgagggaggaggatcacttaacccgggaggccgaggctgcagtgagctatgatcacaccaatgcacttcagcctgggcaacagattgagagcctgtctcaaaaaaaaaaaaaaaaaaaaaagtgaaggcaccaagtggcaattgtcagaggctgtggcctactcaggaagcagacttggagatggagagtggtggacaggaggtttgctagggagtggtcttgggatcaccacctctggaaggggaaaggaagaaggatggggcaggaagagaagttggctgatgcattagtcagggttcactagagggaaagaactaataggatagatgtatatatgaaggggagtttattaggaagaatcaactcacaagatcacaaggtgaagtcccacaataggctgtctgcaagctaaggagcaaggaagccagtctgagttccaaaacctcaaaagtagggaagccgacaatgtggccttcagtctgtggccgtaagctcgagagcccctggcaaaccactggtctaagtccaagagtccaaaagctgaagagcttggagtctgatgttcaagagcaggaaggattcagcaagagagaaagatggaaggccagaagactcagtaagtctgctctttctacctttttcagcctgctttattctagcagctgattagatggtgcccacccagactgcaggtgggtctgcctctcccagtccactgactcaaatgttaatctcctttgacaacaccctcccagacacacccaggaacaataccttgcatctttcaattcaatcaagttgacactcaatcttaaccatcacagcctatgattcagcctcaacagagagcaaccacatggccagctctagacaaagtgggggccagacctttatatctccttataaaccagttcttggctgtgggcaccctgggaagagggcatggtggtgggtgagatgacactcttcatttgaagcaattccgatgagggctgacagctggggatctctgccagaagccctcgctgcagctggtggagtagcccttcagtcttgaggagactctgggatgacatcacagcatctgctccagaagtctgctgaacccatcctggctaactgtaatgcaactattaaccataatactttcctttaaaaatctcagacaaatgctgaaagagataagatactgagacaggaagtgtaagctgggactgtcctaagcgaatcaggaaaaagttatcctgtctataatgaagttcagggagaaagaacagcttacattaacagccttgaaggtaagttgctggtccagaaaccttttgagttaatttacttggtttcacttgggtttcacccagatgcaaaaggatttaagtcgattatttaatccattattttctgtggtgtagcatggcagtgcttttgcatgttgcagcgttttctttcattttcagcagcccctcctctccatttaatcactgtgtctgctgccctgtcctaatcgctcagcagacacccccctggcatcccagacactctggctgcgtgtcccgtgcatgattatttggccctcaccctgtactccacttcacactcccttaggctatgagcagaggatttttgtcacaattgtaaaacatagaaactcatctccaccaatcctttcaaagagcccagggagtctgagctgttccaaatgagaagcttctgctacaagagcatggccagagactctggctaccagagggaggctggtgcatttcatttcattgtgaactccaaccagggtgtctcgaaggttaaaatacctttacttagcgctcaatcactgtcgcacctggtacacagtgctgtaaaattaggagggaagaagagagcaggagaagccctggattcaacatcaggagacctggggtccagcccttcccagcctctggcactcaggttctccatggatcaggtcttattcaggttatcattcccaccgcctaggaaagtgtctggttgagtgggtgctaagaaaaaatgttttcctttctccctggacatagcttgcataaggaatgaagacaatgagtgtgtgtagggggaaaacgctaaggagctagaaaagtttttcattccatggtgcagtgttcctttctctagccccaccaccgaaagcacaagaccctttccctgactttatatcttaccacacagttcagcaacccagtgaaaagatccttattaaaattttatttattaattttttttaagaatagagacaggatctcactatattgcccaggttggtcttaaactcttagcctcaagtgatcgtcccacctcggcttcccaaagtgctgggattacaggtgtgaggccactgagcctggccaagtgaaaagatcttaacgctcccaacatcacataactctcctgggagatggtggtgggaggattttatatggacttgtttggatatgtgttcacccttggaccaaaccttatgtccaggattgcagagtactgtgattaggcagacctaaatactgtactgttttttttttttttttttttttttgagacggagtctcgctctctctcccagtctggagtgcagtggtgcgatctcggctcactgcaagctctgcctcccgggttcacgccattctcctgcctcagcctcccgagtagctgggactacaggcaccggccaccacgcccagctaattttttgtatttttagtagagaccaggtttcaccgtgttagccaggatggtctcggtctcccgacctcgtgatccacctgcctccgcctcccaaagtgctgggattacaggcatgagccaccgcgcccggctgatactgcagttttttttgttgttgttttgttttttctttactattctctacttcttgctatattctgttgaatacatgtcgaattttttcttctattcttccccttccttaatcccccttgcctatttcatatttctttgtattggattgtactgcattttgtgttacttcctcaaatatatcttgtagtttactaattctctctagagctggttttcatttgctacttaacctactcattgagtttttacattttaataaagttttaatgttaattacctacagtcacgtgttttgtttttatttttgacttgcctctcctttattcatagcccagctctttcattttagtttccgtacttattttataatctctttcgattgttttatcagctactttggaaatcagtgttgcgcctcctgattgatgtgtctgctgattttccttcagaggccaggctaacagggactgctgatggggaaataaagaaataatcaaggatgaatcctatatctggggcttgagcaaatagagagtctatcatctacgtagaactgaagatgacagaagacaccaaaggaggacgggggcttccaggaagagccagtaagatgtgctgagtaggaagatgtgaagaaaattgttgaacatgtctgacaatagaagacctaaggcctaagaagtccatttcaatgaatcacaaaagaaatcaaagaacagaatttctctcttttgaagagagaataattgctttattaagtcacagcagcagatttctagacccagtgtcatgtctccttgtccaaactgtggccccttcatgttttggaggctggaagtcccaaaatcgattccactgggccaaaattgagatgtcagcagagctgtgctcccctggaagctctggaagagatcatgtttgtggctgcaccatgccaacgtttgccgccatgcctttgtgtgtgtgtgtgtatgtataaactctccctctactttcctcttataagaatacacttaggccccaacagataatccagaatgatctcttatctcaagatccgtaacttaatcacatctgcaaagacccttttcctgataaagtaacatttacaggttctagtgcttaggacctgatatatctggaaggctattattctgcctaccacatctgatctctcctagcctcagttaccttacctgtaagttgggaataataataccttccttacaggtattgtgaggattaattccataacatatgtgaaaatgcctcattaatgttaatatgttatgcaaatagttgttgaaaaaatctttgaaaatctgtcgagatgaatgtaactgcagtatgcatccatggcgaagtagagcatacagcctacattttctgaaatggtgttaggataatctaatgttgaaaatcacaataagctgtcaggttttgttcaccataaacattacag

SEQ ID NO: 280 - DNA, 2657 bp, Homo sapiens
tgaaattccttctcctggttcatcctggctcaaaagctcccctactgagcgccttttgacccccacacctgctccccctttgactgtaattttcctttacctacccaaatcttataagacggccctatccctgtctcccttggctgactctcttttcggactcagcccgcctgcacccaggtgaaataaacagccttgttgctcacacaaagcctgtttggtggtctcttcacacaaacgcgcatgaaatttggtgccatgactcggatcggggtacctcccttgggagatcaatccccagtcctcctgctctttgctccgtgagaaagatctacctaggacctcaggtcctcagactgaccagcccaaggaacatctcaccaatttcaaatctggtaagtggcctctttttactctcttctccaacctccctcactatccctcaacctctttctcctttctatcttggcgccacacttcaatctctcccttctcttaatttcaattcctttcattttctggtagagacaaaggagacacattttatccgtggacccaaaactccggcgccagtcacggactcggggaggcagccttcccttggtgtttaataattgcgggggtgcctctctgattattcacccacgaccccactgaaaatcggactgttcaactcatctggcagccactcccagagcccctggaactctggcccaagcctctctgactgactccttcccagatcttctcggcttagcagctgaagactgacactgcccaatcgccttggaagccccctagaccatcacggatgccgagcttcgagtaactctcacagtggagggaacgcgcatgaaaaaaccaaacaaacaaaaaaatttcttttggtagcagaataaaaaaacaaaaaaaaggactttttcttctggactgaactatatttaaatctcaaaggatggacatctcacaaccttcctacagcaagtactgtgagagctgcatcttgtcccactggatggtcttcagagacaataatacataatggagctgtcatctcctatgataacaatgccttcttctggatacctcctgaaggacctgcctgaggctctttcactgttagtttttttttaataagtagaaggattacactctaaaataataagtgtagtatagtaaatgtataaaccagtaacataatggtttattatcattatcaagtattacatactgtacaaaattatatgtgctacaattttatgtgactggcagcacagtaggtttgtttataccagcatcaccacaaacacgtgagtaatatgacacaccatgatattctgacaaccatgacatcactaggccagggaattttttaggtccattatcatcataggcgaccacagttgtatatgtgatgtggtctgtcattgactaaaatctcattatgactgtacttagtctctaaaccttattctatttctttcttttcttatggctttttcctctataagaactcaaagggggagagaaaaagacgaaaaatatcttcaaagaggagaacaaatctgatctttctctacgtctgcttagttggcgtaactttaggatgtccataagttgtagctttcctgggaaaatttgattttacactggttatcccaacataatattaatggtatcctcttagactctcaatagtgtccggtttggatgacaaattctgtggtctttttagccaactgctactgaagtggtcagatttattgcacaaaatatatttttaaaaataagtagcacaagatgaaatatggcctcaaatttcttggttagtttccactagaaagttttaaacattaaaaagtacaaaattcattacatttattgaatgataaagtataacattgtatgaagttgatgactattaaaactatttgagtgtttaagttttgtcaggttctctttggtgatgtcagttaagtgtctttcattaattcttatatgcctcacttttcctgtaaataacttattaaccacccactactttttttctgactgattaaatggtataaatgtcgagaaaaacaacatgaatgacataaatgccaagaatcagttgaaatgtaaaaatatatttaatacagaggttctgtttatgactccttaaaacatacttaaggaagcacacagttaactaataacagcaattaactaggattggtagaaaacctttattttcttattctatagtccatttgtgaggagcttaatataagaaagttagtaggtcaaactaataatagggcaaagtactgttccaagaacttgtctaatgatgttccagtgccaaaaatgctctgaaaaattgagataattgaagtctttgatcagaagggtgtaaaataatgttggaaataatcaagtgaagatgtaaagctatgactcggtttcccatgctgagcatgttaacattcttcactgtttcttcttgcatgctgtacatggccgacatttttcaaagtaatgagaaacactatttggtgaagttcttttcatctttgctgtccacatgtatcactcccatccaaaagttgcagttgcatttagcagttgcaaaggaaaggattttctcacgtaggcatggatacttgaaggggctg

SEQ ID NO: 281 - DNA, 1021 bp, Homo sapiens
tgaaattccttctcctggttcatcctggctcaaaagctcccctactgagcgccttttgacccccacacctgctccccctttgactgtaattttcctttacctacccaaatcttataagacggccctatccctgtctcccttggctgactctcttttcggactcagcccgcctgcacccaggtgaaataaacagccttgttgctcacacaaagcctgtttggtggtctcttcacacaaacgcgcatgaaatttggtgccatgactcggatcggggtacctcccttgggagatcaatccccagtcctcctgctctttgctccgtgagaaagatctacctaggacctcaggtcctcagactgaccagcccaaggaacatctcaccaatttcaaatctggtaagtggcctctttttactctcttctccaacctccctcactatccctcaacctctttctcctttctatcttggcgccacacttcaatctctcccttctcttaatttcaattcctttcattttctggtagagacaaaggagacacattttatccgtggacccaaaactccggcgccagtcacggactcggggaggcagccttcccttggtgtttaataattgcgggggtgcctctctgattattcacccacgaccccactgaaaatcggactgttcaactcatctggcagccactcccagagcccctggaactctggcccaagcctctctgactgactccttcccagatcttctcggcttagcagctgaagactgacactgcccaatcgccttggaagccccctagaccatcacggatgccgagcttcgagtaactctcacagtggagggaacgcgcatgaaaaaaccaaacaaacaaaaaaatttcttttggtagcagaataaaaaaacaaaaaaaaggactttttcttctggactgaactatatttaaatctcaaaggatggacatctcacaaccttcctacagcaagtactgtgagccatgtaaaggtgtgctgctttccctt

SEQ ID NO: 282 - DNA, 1747 bp, Homo sapiens
gctgactctcttttcggactcagcccgcctgcacccaggtgaaataaacagccttgttgctcacacaaagcctgtttggtggtctcttcacacaaacgcgcatgaaatttggtgccatgactcggatcggggtacctcccttgggagatcaatccccagtcctcctgctctttgctccgtgagaaagatctacctaggacctcaggtcctcagactgaccagcccaaggaacatctcaccaatttcaaatctggaccccactgaaaatcggactgttcaactcatctggcagccactcccagagcccctggaactctggcccaagcctctctgactgactccttcccagatcttctcggcttagcagctgaagactgacactgcccaatcgccttggaagccccctagaccatcacggatgccgagcttcgagtaactctcacagtggagggaacgcgcatgaaaaaaccaaacaaacaaaaaaatttcttttggtagcagaataaaaaaacaaaaaaaaggactttttcttctggactgaactatatttaaatctcaaaggatggacatctcacaaccttcctacagcaagtactgtgagaactcaaagggggagagaaaaagacgaaaaatatcttcaaagaggagaacaaatctgatctttctctacgtctgcttagttggcgtaactttaggatgtccataagttgtagctttcctgggaaaatttgattttacactggttatcccaacataatattaatggtatcctcttagactctcaatagtgtccggtttggatgacaaattctgtggtctttttagccaactgctactgaagtggtcagatttattgcacaaaatatatttttaaaaataagtagcacaagatgaaatatggcctcaaatttcttggttagtttccactagaaagttttaaacattaaaaagtacaaaattcattacatttattgaatgataaagtataacattgtatgaagttgatgactattaaaactatttgagtgtttaagttttgtcaggttctctttggtgatgtcagttaagtgtctttcattaattcttatatgcctcacttttcctgtaaataacttattaaccacccactactttttttctgactgattaaatggtataaatgtcgagaaaaacaacatgaatgacataaatgccaagaatcagttgaaatgtaaaaatatatttaatacagaggttctgtttatgactccttaaaacatacttaaggaagcacacagttaactaataacagcaattaactaggattggtagaaaacctttattttcttattctatagtccatttgtgaggagcttaatataagaaagttagtaggtcaaactaataatagggcaaagtactgttccaagaacttgtctaatgatgttccagtgccaaaaatgctctgaaaaattgagataattgaagtctttgatcagaagggtgtaaaataatgttggaaataatcaagtgaagatgtaaagctatgactcggtttcccatgctgagcatgttaacattcttcactgtttcttcttgcatgctgtacatggccgacatttttcaaagtaatgagaaacactatttggtgaagttcttttcatctttgctgtccacatgtatcactcccatccaaaagttgcagttgcatttagcagttgcaaaggaaaggattttctcacgtaggcatggatacttgaaggggctg

SEQ ID NO: 283 - DNA, 2948 bp, Homo sapiens
gctgactctcttttcggactcagcccgcctgcacccaggtgaaataaacagccttgttgctcacacaaagcctgtttggtggtctcttcacacaaacgcgcatgaaatttggtgccatgactcggatcggggtacctcccttgggagatcaatccccagtcctcctgctctttgctccgtgagaaagatctacctaggacctcaggtcctcagactgaccagcccaaggaacatctcaccaatttcaaatctggaccccactgaaaatcggactgttcaactcatctggcagccactcccagagcccctggaactctggcccaagcctctctgactgactccttcccagatcttctcggcttagcagctgaagactgacactgcccaatcgccttggaagccccctagaccatcacggatgccgagcttcgagtaactctcacagtggagggaacgcgcatgaaaaaaccaaacaaacaaaaaaatttcttttggtagcagaataaaaaaacaaaaaaaaggactttttcttctggactgaactatatttaaatctcaaaggatggacatctcacaaccttcctacagcaagtactgtgagaaaagatactagcgccagtctggcaggggccttttctagtctcaagcacgctgagcagtcctacaccttgccttctgagagagaagaggacagtcctcagcctcctgaagcctggcaagggtgccttagtgaggacatcacctgcaactcccagatggatagacgaggccatggagagaggagaacaccaacccatgagtgacaagtgcctgtcattgtcaatgatgctgcaagcaccacgatgccccttcttagcagggacccagtgggccttaccagcttcattattttctaggcatgatcgcatcctgtctcccatttttgctaaaattctatctagagaaagagctcatttttagctaaaaaaaaaaaaatcctgttttatctgctaaaaaatcacataaaataactattggactgtttgaaatggcgtggcctctgctctgacttattaactgtgatcttgactaagttaagcagtcactctgaccttacgttactccctcaaatttgaataaaaatagcaacttcctctacttataaattacttctaaaaattagattcttgagattcaaagataggtaatacctgccttcaagaaactaactctcaaggctgctgtatggaaatcctgcctcctaactagattgcactcttctaaatgctgtactactgctatacacattctccaaatcaagttaatttcaaagtcttgctgaatctactttttagaaatatctaagtcatgtgtacgtctttccattcctgcatcccaggggattgcagccatcagctcacctcctctcctaatccaaaatgttcctaactggtctcctgccttgcctttctcctgatcacttcctacaacagagtgatcgtgacttgaaatgcaaattatattgtatgagttatctcccaaaaacattcagctgcctagctcccttaacatgaagtccaaattgccctaacatggagtccaaatttcgttagcatggtttaagagtctcttcatgaacaaaaggcttctgtcttctccagtcatacccaaatctttcctaatcaaaagccatttttatcagtttaagaacagagacagttgttccagatataaggaagagcattggcaaagttgcagataataatttaggtgagtgtgattcagagatctcattagtgatgcctcagaatgactaggagacatggataaaaggataacaagaaagaaaaggagaccacaaaaccacagtccagattgtaggaggcttgggttgtggtaatgagctgggacttctctgctggctatcaggagtcctcatctatgatctgctagaagaatatcatgattagaactgcattttagaaagttaagtctagtggctgcagagcatacatatagaaggtagagctttgagtccacaagaacattatggtttaataaaactctgtgagagagattagagcacaaacaaaggcagtcataatggaaatggaaagaaagttaaaggctaaagactccagagacattttgaaaaatgtgggaaattaggagaggagctgcatcaatcaggacatcagtgttactgatttgcgagactagggaattaggatgttcttgatgaaagtgagcaaaggaattttgcagagatcagagtagaacttttttttttccctgaaagcattctgaaaactgtaaacaccctactgcataagatatcatcatcattattactaagcagtcctatgttaatagccctttgggtctagagcttgaattatgcgctataccttgtacttgaaagaaactatatcctgactagtccagatggatattacttaacctgctttaagatcctctagggaggaacaaccacaacaaatccaagaaaggtccccttcctagcaactgtgcatccttccagctgccttatcaatgatatcatcccttcgatatgttacagagtccatttggacaatttttaaagggactcatgacattctggtaaaagagaattatgatttctggactctttaaaattcaaatgtagggggaaaaaaagcaagtcttctgtttgatcataaaagctataaagatgcaaagagagaaaggtccattctagcatttcaataatatctgttttcactgaaaacctgagctgactttaatcatctacacttcagactgggctaatacctcagaaagctgcaaatactgtgaacgctgtcacactagcacaaagcctttgcaaaaatttccccaaaatacacagattaaaaagcacattttctctctctctgttttcctctctctctctctctctctcacacgcacacacacatacacatgca

SEQ ID NO: 284 - DNA, 1855 bp, Homo sapiens
caaaaagataagagataatgagagacaggactagctggatttcctaggccgactaagaatccctaagcctagctgggaaggtgaccgcatccacctttaaacacggggcttgcaacttaactcacacccaaccaatcagagagctcactaaaatgctaattaggcaaaaacaggaggtaaagaaatagccaatcatctattgcctgagagcacagcaggagggacaaggatcgggatataaacccaggcattcgagccggcaacagcaaccccctttgggtcccctccttcctatgggagctttgttttcactctatttcactctattaaatcttgcactgcactcttctcgtccatgtttgttacggctcgagctgagcttttcgctcgccgtccaccactgctgtttgccactgtcgtagacccgcccctgactcccatcccgccactgactcccatccctccagatccggcagggtgtccgctgtgctcctgatccagcaagactccggttgccactcctgattttgctaaaggcttgccattgttcctgcacggctaagtgcctgggttcgtcctaattgagctgaacactagtcactgggttccacggttctcttccatgacccacagcttctaatagagctataacactcactgcatgatccaagattccattccttggaatccgtgaggccaagaatcccgggtcagagaacacaaagcttgccaccatcttggaagcggcccaccaccatcttggaagcggcttgccaccatcttgggaactctgtgagcaagggcctcaggtaacattttggtgaccacgaagtgacctccaaagcgatgcggagtctcactgtgttgcaaattcctgacctcaagtgatcttcctgcctgggcctcaaagtgcggggattatacgcaggggccactgctttcagcctttaaattctgttaaaaacagcgttggtgagaaagaaaatgtctacttcctgagaaagactgataagaatctaaaaggcataattttctcataaaagggcagctgcatatgttggcatgattgatgagatctgctacagtcaagcaagcagccctgggtgaccagtttacccttccctgcgagggttccagctgccagttgcccccattctgtgacagcttctccttctcctcaccttgtcatccagccaagattgtacactgtaggagtacaggtgagcatctgcctccataatcattgccaacagccctccattatcaactgccaggggtgcttcaaagcaatgtggagttctttctcttgacacagggaccaagtgtatttatgcctgaaacaaactctgcctttgctgactagggaaactcacatgtaaaatgtttttttttaattgcatcacaaatcactacagtattataaaacaggtcgtagcatcctccagccctcaccaccatgacccccatcaggtattgtacattagactatgtaaagacctttcacttaaaaatagggattttctccctggttattatattctcatataaaagaaaaaataaaaagctctgtcaaacattttcactccagcgtcgtgtaaattaaatctacctataaaggtgaattatcttacaacatctgtccttctgtttgtacagccacaccatgtgtggatcagaaataaacaagacagataatttgtgtatagcaacattaaagtgaattctactgttttggtttttaactgcatgatgttaaaatttttattgttaaatgatctatggttgtaatttaatatttactgagagtccacagtaatctaggaactatatggactataaataagatgtaactcct

SEQ ID NO: 285 - DNA, 878 bp, Homo sapiens
gataaggaacacgaaagcatgtttgtaaactgtgaatgatggaataggaacacaggctaattatgcagtatagtgatggcataatgaagaggcacagtgctttcaaagataatagaagatggcatccagaacacatgtataggaactaatcgttgatggaaagaggaccaattctgccactgacatgggagaaaagaatgagagcacagattactggatttgtggagggagaagatacaactccttttggataccttctgtttgtttaactatgtgatgaaaaaccattaactaagagcgaagtggtgaggagagaataaaatatttaagaatagagaaagtgatacaaaataatctcctgaggagagtgagagtgagtgtacgacttactataggactagagtaaattgctgatccagctacaagtttatctgattttacagaagatgaagtgaaatcatccaacctgcccagtgggtcaatatgtctagccatgcttagtccctacccccacttcaaccacagaaaatgagatgcggagtctcactgtgttgcaaattcctgacctcaagtgatcttcctgcctgggcctcaaagtgcggggattatacgcaggggccactgctttcagcctttaaattctgttaaaaacagcgttggtgagggtcagcgctgccactgcacaacctcagggttggaaccaccaccatggaaacttttgctgctgacacacatgtacccacccacagaaccagaagccaccacacccacccccaaatggacaattcagtacttccctagtttcttatagacaacatataggtttctcatgctatttgatttcctctgacaatctgtttttattggtgcatttagac

SEQ ID NO: 286 - DNA, 923 bp, Homo sapiens
cagcatggcggtaggagttgctccttacagttttggtttgaaaagtttgattccttgatttaacccaccaccagtacaacaaccatcactctttcattcaccaaaaattgggtcaccaaaagacaaggccctccacaggattgagtgacaacatcataagcttcaaaggaaatgcaaacatttgtttgaaaaaccggtaaaatcctaagttgttccaggccatctggatgtatacgtgcaagtcacaggggttatgatggcttagcttgggctcagaggcctgacaccgacaagacatgtcaggcaatcctcaggtgataggcagttgttaaactgtctctttaaaataataattggtcacagccaatgccagggaaaggcactctcccaagagataaacacctgaagctggtgatcagtgacttcctgatatgacctcaggagtggagcgagtggtctcacgcatgcacactaagaggcaaaatggtggagttttactggtatatgacctgcctctaagaatactccaccggtaaaggaaaaacgcctcaagtgagcatgcatagaacttcagtaaacacactgtgcacatggcccctccaaagtgctggcagaccactcagcatgcggacagcctaccccaagggaagaatcgggcaagaagagacacagacaccagaagaatgccaacatataaaagcccaagtcaaaggtctaactgcacactcaagtcacccacttggtcctcttccaagtgtactttacctccttttgttcctgctctaaaactttttaataaactttcactcctgctctaaaaatgggctcagcttcttactctgccttttgttcccttggttgaatcatttcttctgaagaggtaagaattgaagttgctgcagacccttatgaatcattgctgc

SEQ ID NO: 287 - DNA, 10586 bp, Homo sapiens
gaagaatcacaaaagaagtgaatatgccctgccccaccttaactgatgacattccaccacaaaagaagtgtaaatggccggtccttgccttaagtgatgatattaccttgtgaaagtccttttcctggctcatcctggctcaaaaagcacccccactgagcaccttgcgaccccccactcctgcctgccagaaaacaacccccctttgactgtaattttcctttacctacccaaatcctataaaatggccccacccctatctccctttgctgactctcttttcggactcagcccacctgcacccaggtgattaaaagctttattgctcacacaaagcctgtttggtggtctcttcacatggacgtgcatgaaatttggtgccgtgactcagatcgggggacctcccttgggagatcaatcccctgtcctcctgttgtttgctccatgagaaagatccacctacgacctcaggtcctcagactgaccagcccaaggaacatctcaccaattttaaatcaggtaagcggcctcttcttactctcttctccaacctctctcactgtccctcaaccattttctcctttccactcttcaatctctcccttctcttaatttcaattcccttcattttctgggagagacaaaggagacacgttttatccgtggacccaaaactccagcaccggtcacggactaggaaggcagacttcccttggtgtttaatcattgcaaggacacctctctgattattcatccacatttcaaaggtgtcagaccacgcagggatgcctgccgtggtccttcacccttagcgacaagtcccgcttttctgggaaaggggcaagtaccccaaccccttctctccttgtctctaccccttctctgcttttctgggggaggggcaagtacccctcaaccccttctccttcaaccttagtggcaagtcccgcttttctgggggaggggcaagtacccctcaaccccttctccttcactcttagtggcaagtcccacttttctagaggagggggcaagtaccccaacctcatatctctgtgctccaatcccttatttccatgccgcgaccccttatttccgtgccccgaccccttatttccatgccccgaccccttatttccatgccccatcccttatttctatgcctcaacctcttatctctgtgccccaaccccttttcccacttttctggaaggtaagaacccccaaaccccttccctccatttctctactctctcttttctctaggcttgcttccttcactataggcaactttccaccctccattcctccttctactcccttggcctgtgttctcaaaaacttaaaacctcttcaactcacatctgacctaaaacctaaatgccttattttcttctgcaatgccgcttgaccccagtacaaacttgacagtagttccaaatagccagaaaatggcactttgaatttttccatcctgcaagatctaaataattcttgtcataaaataggtaaacggtctgaggtgcctgacgtccaggcattcttttacacattagtcacttcctagtctctgtgcccagtgcaactcgtcccaaatcttccttctttccctcccacctgtcccctcagtaccaaccccaagcattgctgagtctttctaatcttccttttctgcagacccatctgacctctcccttcctccccaggctgctccttgccaggctgagctaggtcccaattcttcctcagcctctgctcctccatgctataatctttttatcacctcccctcctcacactgggtcctgcttacagtttcgttacgtgactagccctccccatcctgcccagcaatttactcttaaaaaagtggctggagctaaaggcatagtcaaggttaatgctcctttttctttatcccaaatcagatagggtttaggctctttttcatcaaatataaaaacccagcccagttcatgacttgtttggcaacaaccctgagacactttacagccctagaccctaaaacgtcaaaaggccgtcttattctcaaaatacattttattacccaatctgctcccgacattaaataaaactccaaaaattaaattccggccctcaaaccccacaacaggatttaattaacctcgccttcaaggtgtataataatagaaaatagttgcaattccttgcctccactgtgagacaaaccccagccacatctccagcacacaagaacttccaaacgcctgaaccgcagcggccacgcgttcctccagaacctcctcccacaggagcttgctacatgtgccgggaatctggccactgggccaaggaatgcctgcagcccaggattcctcctaagccgcgtcccatctgtgtgggaccccactgaaaatcggactgttcaactcacctggcagccactcccagagcccctggaactctggcccaagcctctctgactgactccttcccagatcttctcggcttagcggctgaagactgacactgccggatcacctcggaagccccctagaacgtcactgacgccgagcttcaggtaactctcacagtggaaggtaagcccgtccccttcttaatcaatacggaggctacccactccacattaccctcttttcaagggcctgtttcccttgcctccataactgttgtgggtattgatggccaagcttctaaacctcttaaaactccccaactctggtgccaacttagacaatactcttttaagcactcctttgtagttatccccacctgcccagttccctgattaggctgagacactttaactaaattatctgcttccctgactattcctggactacagctgtatctcattgccgcccttcttcccaatccaaagcctcctttgcgtcctcctcttgtattcccccaccttaacccacaagtataagatacctctactccctccttggggactgatcatgcaccccttaccatctcattaaaacctaatcacccttaccccactcaacgccaatatcccatcccgcagcatgctttaaaaagattaaagcctgttatcactcgcctgctacagcatagtcttttaaagcctataaactctccttacaattcccccattttacctgtcctaaaaccagacaagccttacaagttagttcaggacctgcacattatcaatcaaattgttttgcctatccaccctgtggtgcccaacccgtacactcttttgtcctgaataccttcctccacaactcactattccctgcttgatcttaaagacgcttttttcactattcccctgcacccctcgtcccagcctctctttgctttcatttggactgaccttgacaccatcaagctcagcaaactacctaggctgtactgccgcaaagcttcacagacagcccccattacttcaatcaagcccaaatttcttcctcatctgttacctatctcggcataattctcataaaaacacacgtgctctccctgccaatcgtgtctgactgatctctcaaaccccagcacctcctacaaaacaacaactcctttccttcctaggcatggttagcgcagtcagaattcttacacaagagccaggaccacaccctgtagcctttctgtccaaacaacttgaccttactgttttagcctagccctcatgtctgcatgcagtggctgccgctgctttaatacttttagaggccctcaaaatcacaaactatgctcaactcactctctacagttctcataacttccaaaatctattttcttcctcatacctgacgcatatactttctgcttcccggctccttcagctgtacactctttgttgagtctcccacaattactgttgttcctggcccagacttcaatccggcctcccacattattcctgataccacacctgacccccatgactgtatctctctgatccacctgacattcaccccatttccccaaatttccttctttcctgttcctcaccctgatcacgcttgatttattgatggcggttccaccaggcctaatcgccacacaccagcaaaggcagtttatactatagtacaagccactagcctgcctcttagaacatctcatttcctttccatcatgggaatctatcctcaaggaaataacttctcagtgttccatctgctattctactactcctcagggattattcaggcctcctcccttccctacacatcaagctcaaggatttgccccacccaggactggcaaattagctttactcaacatgccctgagaccgataactaaaaaaacctcttagtctaggtagatactttcactggataggtagaggcctttcctacaggtctgagaaggcccccgcagtcatttcttccattctgtcagacataattcctcagtttagccttcccacctcaatacagtctgataacagacgagcctttattagtcaaatcagccaagcagtttttcaggctcttagtattcagtgaaacctttatatcccttatggtcctccgtcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccatttaagctcctgtatagatgctcctttttattaggccccagtctcattccagacaccagaccaacttagactgtgccccaaaaaaacttgtcatccctactatcttctgtctagtcatactcctattcaccattctcaacgactcatacatgccttgctctggtttacactgccggtttacactgtttttccaagccatcacagctgatatctcctggtgctatccccaaactgtcacttttaactcttgaagtaaataaataatctttgctggcaggactatgccgaatctccttaagcactctctaatcagatatcctgagtcgtcccaattctcagaccttttatacctgtttttctccttctgttattccatttagtttctcaattcatccaaaaccgtatctaggccatcaccaatcactctatatgacaaatgtttcttctaacatccccacaatatcaccccttaccacaagacctcccttcagcttaatctctcccactctaggttcccacgccgcccctaatcccgcttgaagcagccctgagaaacatcgtccattctctctccatatcaccccccaaaaattttcgctgccccaacacttcaacacttttttgttttatttttcttattaatataagaaggcaggaatgtcaggcctctgagcccgagccaagccatcacgtcccctgtgacttgcacatatacgcccaggtggcctaaagtaactgaagaatcacaaaagaagtgaaaatgccctgccccaccttaactgatgacattccaccacaaaagaagtgtaaatggctggtccttgccttaagtgatgacattaccttgtgaaagtccttttcctggctcatcctggttcaaaaagcacccccactgagcaccttgcaacccccactcctgcctgccagagaacaacccccctttgactgtaattttcctttacctacccaaatcctataaaacggccccacccctatctccctttgctgactctcttttcggactcagcccacctgcacccaggtgattaaaagctttattgctcacacaaagcctgtttggtggtctcttcacagggacacgcatgaaaaaaatgtgctgggaacaggagataccaggtagttctgccctcagggcccactcatggcaggtagtggtaagccaagcattctggaccttgggccaccaggtggcatatgcaagcacagttttagtgagtgcaggtgggcaaattcttgagactccaggcagtcttcctgtatgctggcagtgggagtggtaagccagatccgtgggtgagtccttaggcccttaagccgaatgtatggcctggattatggtagtagtgatggcaggataattttggggctctcatgtggcactcactaatgttagctgttggtatgatgggctgagcaagctggtccccaggttccttggttgtgcatgtgcatggatgtagttgatggtattgatgacaggctatatgggctcaccttcaggattccagaagtagggtacagatgctagaggtggtagaaggggttgggtaatccccaggtccctgggaggggtgctcatgctttgggtgggggaagcaatggtgacaggtctggtgggcctgatctcagggcatcagggtgtgcagagctccaggaggtagtaggcagggcaggcagtctgtggtgttggttgtggagagcctgacctctgggctggtgctagagtgtggtgatcctgctgttgagtatgggtggggttgctatcagtggtcccctgcagggagctctcaggttctgaggggtgtacactttcaactctggcagtagcagtgtccacagtggtgtgtgtgaagagcctgcactcatgacatgcactagagcacagaggccatgcttttgaagggggcagggttgctattcagagccccaaacaggcacttctcagtttctgggtagtgtttgctttgtctcctggctgcagtcagtgactgctatcatgttcaaaggggtcagatggatcctgcctttctgggtgtgaactcaagcacagaggctgtgttgttggtgggaatggggttactatttgcatcctcagacaggcagctgtcaggctcactcactttggctccccgtggcagcagcactattgtgatatgcagaaaggggaagggatccattttcacatgagcccaagtactgagaacatactgctaatagggatgtggttactgtttacatacccagactctcagatttaaggtttgcttgctttggctttcagaggcagcagtggctgcagcagtgtggagagttggggaagggatcttgacctctgtgcataagctagagcacaaaggccatgctgctagttagggcagggtggttccctgccctaatggtaccaggtaccattggtatcattataccaggcagggagctcttgggttctgccaagcacatgcactggttccctttgtctcaggagaagcctccttgatgtactgcgctatcatttccttgaggagttgtactccctgtgggttagagtgctggggaccccacaacaccatcgggtccagccaccattgtgccactgaagccctccaggtggatgccagggaattctactgggggttcacagggtgtgaagatgtggaattgttggttctcagaagaggatgcagtctggtggaagctggactctggccatagtgccctactgcagctgcttatgtcttgctatgtgatgtggtgcaagtttcccgcttgcagcaatgccctggcaggcctctagatcaccacgctgtagagtccccacctatgctaatctcagagctgtatagatggaagaggtctcctgtggttaggattgcagtagtctaagggagatcacacataaagaaactctcctttccttccaactggtggggttcctcatgtgatggatgtctccaattccaagcaatattacagctagcagttcagtacctctctgctcagcagtgaagaaactaggtcttgttatgtcgccaaggctggtctcctactcctggtctcaagtgatcctcccacctctgcctcccaatgcactggagttacaggcatgagccactgtgctcagcctgtaattgttttaggactgtacaaatcatgcccatataagatgaatctcttatacctgacagaagtcatgccagttagagatacttgtgcaaggcttggataacaaaagtgaaacagaaactcctccttgtttatggcagctgatacacaaatccccaaaatgaaagcatttacagcagctagaagatctgttcctcaggagagtcacgtgtgtgctgggtgtgaggcagtctggacaatggttgcaatggagcaataacaagaggggcccctgacatccagatggcaagcccagagatcagatcttgaaacatatattcagtatttgctcctttatttctgatcctgtccttcaaaatactttaaactttattgtatttaattccctatagcttaaaatacagaggatggtttttgtttgtattaaacctttactgacaaaaccaccattcttatcattgcatttataaagtgctagactgtactttctttaagtagcatttctttttacaattatatataaacactatcatgtagtacatgaacagaattaaataaaatgcaaattattgtttgacagaattgaggagttatttgatattatgtaaaaaaacaaaaaagatttatcaaagtggaatttgtgaattttttttatgtgagtttcaactaggttgtgtctgaatcatttaagatcagcttcacactaatctggcttaggaaatggtaaccataacaaaaatagcaaacaactagtgcaaatctttacatttgaaaagcaatttgccttacattattaaacttaaatgtcaaagttagagacagaaaatactatttgtggtcaccattaaatactttaagcagctggttctgaaattttaagaggtatgcttagtaatgtgtggcatcactaatggatcatcttggaaatgttcggggattttaagttaattataaacaataatgcttttactctctgcattagtccattcgcatgctgctaataaagacatacctagactgggtaatttataaaggaaggaggtttaatagactcacagttccacatggctggagaggcctcacaatcatggcagaagatgaaggaagagcaaaaagacatcctacatggcagcaggcaagagagcatgtgcagggaaacttccctttataaaaccattggatctcatgagacttattcactatcaagagaacagcatgggaaactactgaccccatgattcaattacatcccactgggtacctcccatggcatttggaaattgtggagagctacaattcaagataagatttgagtggcatcagagccaaaccatatcactcttttaatgactactggtaaatcacacatgcaaagcacttttttgttgctattatgtgatatttaacaattccaattttataaatttatcccttgggaaaggtccacataggaaaaacagattaagttgattttcaaatagaactgaccaaaaacaaaatgcaattgtttaacaaaaacaataaaataaaatgcattactaagtcaatgaaatatataaacattcattttgtaaaaataaaagtaagcacttttgttttagctaactgtctattttttgtttttatttatcctcagttgtccagcatttttcctcaaaagtaaactcattttgtgtgtgctgacatacattatatagcctaaatttccttggtataagagtacattcgcttgttttccaatattctgaaatatatttgctattctaaggaaatgttaattgggcattgaacaatagtaagtttgtggaactttctaagacaaataagtttgtgttaaaaagcttgtgggagaaaaatttaaaaggtcctatgaataaactggacaacaagaagcaaagagattatcaaataatctatcacattgaatcaatgcagtgttagtcccataatttgaataggaaatgacgtattatgtgtataataataattataatgtaatgaatttctctctgcaattctctccctctgagatgagtcaatggacttttttttacataatgaaatctttatatcttttcagtattggagtacaaagtaaataaataataaaaagtgaatagccatgtggcacataagtgagcaacagtagaaaagcatatgtatcaaacttttagtaacatgggtttagataatcttttaaaaaatttagctcaaatgaaataggaagaaatgtaaagtaattactttaaatatcatatgtaattacagttgacccttgaacaacatgagtttgttctcttaggtccatttatatgtttattttttttaaacaataaatgatacactgagtgtgcctgcctctcctgcctccccttccacctcttccacctcttccaactctgccacccctgggacagccagaccaacccctctgcttactcctaagcctgttcaacatgaaaacaagaatgaagactttcaggatgattcacttccacttaatgaaatactaattatactttatcttccttataattttcttaacaacattttcttttctctagcttactttattgtaagaatacagtatgtaatacatataacatgcaaaatacgtgttaataaactgtttatgttattgataagtcttccagttaatagtaggctattagtagttcagttttggggaagtcaaaagtaatacctgaattttctgctggataggggatcagaacccctattcctatgttgttcaaggtcaactgtac

SEQ ID NO: 288 - DNA, 11133 bp, Homo sapiens
gaagaatcacaaaagaagtgaatatgccctgccccaccttaactgatgacattccaccacaaaagaagtgtaaatggccggtccttgccttaagtgatgatattaccttgtgaaagtccttttcctggctcatcctggctcaaaaagcacccccactgagcaccttgcgaccccccactcctgcctgccagaaaacaacccccctttgactgtaattttcctttacctacccaaatcctataaaatggccccacccctatctccctttgctgactctcttttcggactcagcccacctgcacccaggtgattaaaagctttattgctcacacaaagcctgtttggtggtctcttcacatggacgtgcatgaaatttggtgccgtgactcagatcgggggacctcccttgggagatcaatcccctgtcctcctgttgtttgctccatgagaaagatccacctacgacctcaggtcctcagactgaccagcccaaggaacatctcaccaattttaaatcaggtaagcggcctcttcttactctcttctccaacctctctcactgtccctcaaccattttctcctttccactcttcaatctctcccttctcttaatttcaattcccttcattttctgggagagacaaaggagacacgttttatccgtggacccaaaactccagcaccggtcacggactaggaaggcagacttcccttggtgtttaatcattgcaaggacacctctctgattattcatccacatttcaaaggtgtcagaccacgcagggatgcctgccgtggtccttcacccttagcgacaagtcccgcttttctgggaaaggggcaagtaccccaaccccttctctccttgtctctaccccttctctgcttttctgggggaggggcaagtacccctcaaccccttctccttcaaccttagtggcaagtcccgcttttctgggggaggggcaagtacccctcaaccccttctccttcactcttagtggcaagtcccacttttctagaggagggggcaagtaccccaacctcatatctctgtgctccaatcccttatttccatgccgcgaccccttatttccgtgccccgaccccttatttccatgccccgaccccttatttccatgccccatcccttatttctatgcctcaacctcttatctctgtgccccaaccccttttcccacttttctggaaggtaagaacccccaaaccccttccctccatttctctactctctcttttctctaggcttgcttccttcactataggcaactttccaccctccattcctccttctactcccttggcctgtgttctcaaaaacttaaaacctcttcaactcacatctgacctaaaacctaaatgccttattttcttctgcaatgccgcttgaccccagtacaaacttgacagtagttccaaatagccagaaaatggcactttgaatttttccatcctgcaagatctaaataattcttgtcataaaataggtaaacggtctgaggtgcctgacgtccaggcattcttttacacattagtcacttcctagtctctgtgcccagtgcaactcgtcccaaatcttccttctttccctcccacctgtcccctcagtaccaaccccaagcattgctgagtctttctaatcttccttttctgcagacccatctgacctctcccttcctccccaggctgctccttgccaggctgagctaggtcccaattcttcctcagcctctgctcctccatgctataatctttttatcacctcccctcctcacactgggtcctgcttacagtttcgttacgtgactagccctccccatcctgcccagcaatttactcttaaaaaagtggctggagctaaaggcatagtcaaggttaatgctcctttttctttatcccaaatcagatagggtttaggctctttttcatcaaatataaaaacccagcccagttcatgacttgtttggcaacaaccctgagacactttacagccctagaccctaaaacgtcaaaaggccgtcttattctcaaaatacattttattacccaatctgctcccgacattaaataaaactccaaaaattaaattccggccctcaaaccccacaacaggatttaattaacctcgccttcaaggtgtataataatagaaaatagttgcaattccttgcctccactgtgagacaaaccccagccacatctccagcacacaagaacttccaaacgcctgaaccgcagcggccacgcgttcctccagaacctcctcccacaggagcttgctacatgtgccgggaatctggccactgggccaaggaatgcctgcagcccaggattcctcctaagccgcgtcccatctgtgtgggaccccactgaaaatcggactgttcaactcacctggcagccactcccagagcccctggaactctggcccaagcctctctgactgactccttcccagatcttctcggcttagcggctgaagactgacactgccggatcacctcggaagccccctagaacgtcactgacgccgagcttcaggtaactctcacagtggaaggtaagcccgtccccttcttaatcaatacggaggctacccactccacattaccctcttttcaagggcctgtttcccttgcctccataactgttgtgggtattgatggccaagcttctaaacctcttaaaactccccaactctggtgccaacttagacaatactcttttaagcactcctttgtagttatccccacctgcccagttccctgattaggctgagacactttaactaaattatctgcttccctgactattcctggactacagctgtatctcattgccgcccttcttcccaatccaaagcctcctttgcgtcctcctcttgtattcccccaccttaacccacaagtataagatacctctactccctccttggggactgatcatgcaccccttaccatctcattaaaacctaatcacccttaccccactcaacgccaatatcccatcccgcagcatgctttaaaaagattaaagcctgttatcactcgcctgctacagcatagtcttttaaagcctataaactctccttacaattcccccattttacctgtcctaaaaccagacaagccttacaagttagttcaggacctgcacattatcaatcaaattgttttgcctatccaccctgtggtgcccaacccgtacactcttttgtcctgaataccttcctccacaactcactattccctgcttgatcttaaagacgcttttttcactattcccctgcacccctcgtcccagcctctctttgctttcatttggactgaccttgacaccatcaagctcagcaaactacctaggctgtactgccgcaaagcttcacagacagcccccattacttcaatcaagcccaaatttcttcctcatctgttacctatctcggcataattctcataaaaacacacgtgctctccctgccaatcgtgtctgactgatctctcaaaccccagcacctcctacaaaacaacaactcctttccttcctaggcatggttagcgcagtcagaattcttacacaagagccaggaccacaccctgtagcctttctgtccaaacaacttgaccttactgttttagcctagccctcatgtctgcatgcagtggctgccgctgctttaatacttttagaggccctcaaaatcacaaactatgctcaactcactctctacagttctcataacttccaaaatctattttcttcctcatacctgacgcatatactttctgcttcccggctccttcagctgtacactctttgttgagtctcccacaattactgttgttcctggcccagacttcaatccggcctcccacattattcctgataccacacctgacccccatgactgtatctctctgatccacctgacattcaccccatttccccaaatttccttctttcctgttcctcaccctgatcacgcttgatttattgatggcggttccaccaggcctaatcgccacacaccagcaaaggcagtttatactatagtacaagccactagcctgcctcttagaacatctcatttcctttccatcatgggaatctatcctcaaggaaataacttctcagtgttccatctgctattctactactcctcagggattattcaggcctcctcccttccctacacatcaagctcaaggatttgccccacccaggactggcaaattagctttactcaacatgccctgagaccgataactaaaaaaacctcttagtctaggtagatactttcactggataggtagaggcctttcctacaggtctgagaaggcccccgcagtcatttcttccattctgtcagacataattcctcagtttagccttcccacctcaatacagtctgataacagacgagcctttattagtcaaatcagccaagcagtttttcaggctcttagtattcagtgaaacctttatatcccttatggtcctccgtcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccatttaagctcctgtatagatgctcctttttattaggccccagtctcattccagacaccagaccaacttagactgtgccccaaaaaaacttgtcatccctactatcttctgtctagtcatactcctattcaccattctcaacgactcatacatgccttgctctggtttacactgccggtttacactgtttttccaagccatcacagctgatatctcctggtgctatccccaaactgtcacttttaactcttgaagtaaataaataatctttgctggcaggactatgccgaatctccttaagcactctctaatcagatatcctgagtcgtcccaattctcagaccttttatacctgtttttctccttctgttattccatttagtttctcaattcatccaaaaccgtatctaggccatcaccaatcactctatatgacaaatgtttcttctaacatccccacaatatcaccccttaccacaagacctcccttcagcttaatctctcccactctaggttcccacgccgcccctaatcccgcttgaagcagccctgagaaacatcgtccattctctctccatatcaccccccaaaaattttcgctgccccaacacttcaacacttttttgttttatttttcttattaatataagaaggcaggaatgtcaggcctctgagcccgagccaagccatcacgtcccctgtgacttgcacatatacgcccaggtggcctaaagtaactgaagaatcacaaaagaagtgaaaatgccctgccccaccttaactgatgacattccaccacaaaagaagtgtaaatggctggtccttgccttaagtgatgacattaccttgtgaaagtccttttcctggctcatcctggttcaaaaagcacccccactgagcaccttgcaacccccactcctgcctgccagagaacaacccccctttgactgtaattttcctttacctacccaaatcctataaaacggccccacccctatctccctttgctgactctcttttcggactcagcccacctgcacccaggtgattaaaagctttattgctcacacaaagcctgtttggtggtctcttcacagggacacgcatgaaaaaaatgtgctgggaacaggagataccaggtagttctgccctcagggcccactcatggcaggtagtggtaagccaagcattctggaccttgggccaccaggtggcatatgcaagcacagttttagtgagtgcaggtgggcaaattcttgagactccaggcagtcttcctgtatgctggcagtgggagtggtaagccagatccgtgggtgagtccttaggcccttaagccgaatgtatggcctggattatggtagtagtgatggcaggataattttggggctctcatgtggcactcactaatgttagctgttggtatgatgggctgagcaagctggtccccaggttccttggttgtgcatgtgcatggatgtagttgatggtattgatgacaggctatatgggctcaccttcaggattccagaagtagggtacagatgctagaggtggtagaaggggttgggtaatccccaggtccctgggaggggtgctcatgctttgggtgggggaagcaatggtgacaggtctggtgggcctgatctcagggcatcagggtgtgcagagctccaggaggtagtaggcagggcaggcagtctgtggtgttggttgtggagagcctgacctctgggctggtgctagagtgtggtgatcctgctgttgagtatgggtggggttgctatcagtggtcccctgcagggagctctcaggttctgaggggtgtacactttcaactctggcagtagcagtgtccacagtggtgtgtgtgaagagcctgcactcatgacatgcactagagcacagaggccatgcttttgaagggggcagggttgctattcagagccccaaacaggcacttctcagtttctgggtagtgtttgctttgtctcctggctgcagtcagtgactgctatcatgttcaaaggggtcagatggatcctgcctttctgggtgtgaactcaagcacagaggctgtgttgttggtgggaatggggttactatttgcatcctcagacaggcagctgtcaggctcactcactttggctccccgtggcagcagcactattgtgatatgcagaaaggggaagggatccattttcacatgagcccaagtactgagaacatactgctaatagggatgtggttactgtttacatacccagactctcagatttaaggtttgcttgctttggctttcagaggcagcagtggctgcagcagtgtggagagttggggaagggatcttgacctctgtgcataagctagagcacaaaggccatgctgctagttagggcagggtggttccctgccctaatggtaccaggtaccattggtatcattataccaggcagggagctcttgggttctgccaagcacatgcactggttccctttgtctcaggagaagcctccttgatgtactgcgctatcatttccttgaggagttgtactccctgtgggttagagtgctggggaccccacaacaccatcgggtccagccaccattgtgccactgaagccctccaggtggatgccagggaattctactgggggttcacagggtgtgaagatgtggaattgttggttctcagaagaggatgcagtctggtggaagctggactctggccatagtgccctactgcagctgcttatgtcttgctatgtgatgtggtgcaagtttcccgcttgcagcaatgccctggcaggcctctagatcaccacgctgtagagtccccacctatgctaatctcagagctgtatagatggaagaggtctcctgtggttaggattgcagtagtctaaggaaatctaatggaaacttagaaaaagaatgaaaactctatccctagttttctaaggaacacatatggcacagagacaggactggcagcaaacaaagataaatgaagagtcaccctcagtgaaatcctgactgctgctttaagttctctaccacattttggattttagtgttaggattatttctgaaggagtcttctgaacctcatgttacttacaggaaaaacaatagaatttgatttacataaatgtccttctcaaaccctttgatcaatggtgctcaagttccattttatctgtatacccatagttattcaattgtttaactcattttctgagcaaccaagttctcagtgcagagaactcaattatgttgtttgcttttctgatccaccatcttctgtgtgcactcatgataggatgaacatgggatgaaatcatatttgtaatgaattatagaatgatccctgaaggtagagtacttgtaattatatttatatatcttttgtggttcatatctcataagcgatagatccatgcttatcatgttaatcgtgttattcattggatttaggatctgacttgcctccaccggagactgcttccaagtctgatttttgcaagtcactgaacatttcttcctggtcgtaaaatattcattatttcaactaatagtaatatggttttctttctaatgtattcatagcccatagctttttgagctctagacagactgatttgaaccttttaagcaataaatgagaagaatcattttttgaaatagataatattattttatttagaataacaacatgccacttggggagatattttttgtatatctaattgccacttggggagttttttttttgtatatctaaaagttctcaccagaatatactttatacagaactattgcaaacaaacttggaatcataaaatttcgaggcatactttgtggaaatataccataaattgtgtaaatatctgagtataaagtggagctgtttcgagactgactgtatttaagtaatggagatgcatataaaacttagattttaaatattttattaatcttggcatagtgcatcctaattaggcaggaaaagacctggagggatggaaaggtattcccacaccttcttctcatgcatattgtctttagtcattacttacaattattattttttgtttggtggtttttggtttcaaagggataattacttaaaaggaaagatactgactaaaatatttgctttgtgttagtttaatttaatgatctaatatttgtgttattttatccatgaaagcaatacttctgcctgcaagtatctaaaccagtcatatatttctacctcaccttctttggtaaacaggccttcattattttattcttgatcagttgaaatttaaactgaaataaaatacacttattcaaaatatttaaattatataaaaacaaaaatatttagaaagactgagatcatttatagtatccttagtttttctctagagggtttagcagcaggttgcttctaattcggactttatgtaattataaaattctgaaaaaaatgttaactagaaactatcttgtgtttatgtttaattactttaataataattgttgtgcttcattcattattgaggaaaaattgtaagccttctttcctagttctcacattattttaccaactacggggcattatggcaatcataccctactgaggttgagtattaaaaaataaatatttaaaattaaaatacagcttgtcacatagaatgagcacctgatgccatttatgaggaacaggtggatgtttattcaggcatgttttatgtaccagcaggaattatttcaattaaatatcaatgtcactgcctttagagaagactgaaacaagagcaaaggatacacatacacacagacacacacacaggcatgtaggtgacacaggaacttaaggtatctgaactgaaccagatttacaaaaaagattggttcaatttgtctagattgcctaaaggaagaggtagttgcctctaaaatagatcaagagattttgatctttgttgttgcattgaaatgtgcgattctgcaggtgctattattctttgaaactttctttgggtgaattgaacataatattcttaggtgggttgggaaataaaaatgactaggaaaaacatgtgtctttgcattcagtatatagtgtcttgaattagcaagttatctaagttgtgttaatggagaaaaatacgcaagataaatatttgggttatcacaaaggcaaatattcctaattagtgagagtgagggaggagaaggagacagagaaaaaatatgaataacttattcaaatatacttctatttttaaaatactccaagatattgtgatctgtaaatgtgtatatatgttttcacatcaattattgcaacttaatatgggaaaaattaaggcttgttttaataccaaaataccactcaacaacacagtacatgagcagctgttcacactgaatgatgtagataattaatctaattttccctgtgcttcattttgtgttctattagttttcttattcaaactttcaagtcacaaatctgatttaaaacctcttaactggtctaatgcataatgtgttctctctgcattcagtgtctagcagtaagccgcaaagctggaatactaatttgttttggaatgtgaaaaacactcaataatcaaataataaaatcctggatccaccatttcttaatgacacgaccaaatgagtccaatgccttgaaatgtgagcataagttaaaaaatagaacaaagaagaatataacaatgtgaatgaagaaaggagaaccatgctaacaagaacaccatattcaatatatttggtctctattcaaaatggtcccaattcagaatacaagatttttaaatgagcaagacaaattttgattaacaatattaatgttgctattttaatatttgctactctctatcttctctctcttttcctatttctctcttcttctgtcaacacactcatgattatctgaatttacatttaatattcgaaaattattttctgtagtctctttgaaaaagtctgtattgatttttcaaaacaaaagagctttgttcccttttcttttcttgcaatgtttgtacctcctttggcaaaataaagtttatttccatactttctcttgaattcaagtaaataaaaaaacacacacacacatttcctaaaatgaagaaataggttatgtcagaaaaattaaccatgtactgagtgattaaactattttgtgtagaaatgtcatttctattttgtttaaatgtaatgcaatttaccagaccataaagaactccttagatgaaatggctgttttccaggcaatgctactctgctgctgattgcaatatattctgacatctatgacagttttataattcttctattctgtgctctgaagtgtccctactttgctgaaggttttctcctgggaaaaggcactacagttttgtggactgaaaggacaataaacagtttgatgg

SEQ ID NO: 289 - DNA, 11103 bp, Homo sapiens
gaagaatcacaaaagaagtgaatatgccctgccccaccttaactgatgacattccaccacaaaagaagtgtaaatggccggtccttgccttaagtgatgatattaccttgtgaaagtccttttcctggctcatcctggctcaaaaagcacccccactgagcaccttgcgaccccccactcctgcctgccagaaaacaacccccctttgactgtaattttcctttacctacccaaatcctataaaatggccccacccctatctccctttgctgactctcttttcggactcagcccacctgcacccaggtgattaaaagctttattgctcacacaaagcctgtttggtggtctcttcacatggacgtgcatgaaatttggtgccgtgactcagatcgggggacctcccttgggagatcaatcccctgtcctcctgttgtttgctccatgagaaagatccacctacgacctcaggtcctcagactgaccagcccaaggaacatctcaccaattttaaatcaggtaagcggcctcttcttactctcttctccaacctctctcactgtccctcaaccattttctcctttccactcttcaatctctcccttctcttaatttcaattcccttcattttctgggagagacaaaggagacacgttttatccgtggacccaaaactccagcaccggtcacggactaggaaggcagacttcccttggtgtttaatcattgcaaggacacctctctgattattcatccacatttcaaaggtgtcagaccacgcagggatgcctgccgtggtccttcacccttagcgacaagtcccgcttttctgggaaaggggcaagtaccccaaccccttctctccttgtctctaccccttctctgcttttctgggggaggggcaagtacccctcaaccccttctccttcaaccttagtggcaagtcccgcttttctgggggaggggcaagtacccctcaaccccttctccttcactcttagtggcaagtcccacttttctagaggagggggcaagtaccccaacctcatatctctgtgctccaatcccttatttccatgccgcgaccccttatttccgtgccccgaccccttatttccatgccccgaccccttatttccatgccccatcccttatttctatgcctcaacctcttatctctgtgccccaaccccttttcccacttttctggaaggtaagaacccccaaaccccttccctccatttctctactctctcttttctctaggcttgcttccttcactataggcaactttccaccctccattcctccttctactcccttggcctgtgttctcaaaaacttaaaacctcttcaactcacatctgacctaaaacctaaatgccttattttcttctgcaatgccgcttgaccccagtacaaacttgacagtagttccaaatagccagaaaatggcactttgaatttttccatcctgcaagatctaaataattcttgtcataaaataggtaaacggtctgaggtgcctgacgtccaggcattcttttacacattagtcacttcctagtctctgtgcccagtgcaactcgtcccaaatcttccttctttccctcccacctgtcccctcagtaccaaccccaagcattgctgagtctttctaatcttccttttctgcagacccatctgacctctcccttcctccccaggctgctccttgccaggctgagctaggtcccaattcttcctcagcctctgctcctccatgctataatctttttatcacctcccctcctcacactgggtcctgcttacagtttcgttacgtgactagccctccccatcctgcccagcaatttactcttaaaaaagtggctggagctaaaggcatagtcaaggttaatgctcctttttctttatcccaaatcagatagggtttaggctctttttcatcaaatataaaaacccagcccagttcatgacttgtttggcaacaaccctgagacactttacagccctagaccctaaaacgtcaaaaggccgtcttattctcaaaatacattttattacccaatctgctcccgacattaaataaaactccaaaaattaaattccggccctcaaaccccacaacaggatttaattaacctcgccttcaaggtgtataataatagaaaatagttgcaattccttgcctccactgtgagacaaaccccagccacatctccagcacacaagaacttccaaacgcctgaaccgcagcggccacgcgttcctccagaacctcctcccacaggagcttgctacatgtgccgggaatctggccactgggccaaggaatgcctgcagcccaggattcctcctaagccgcgtcccatctgtgtgggaccccactgaaaatcggactgttcaactcacctggcagccactcccagagcccctggaactctggcccaagcctctctgactgactccttcccagatcttctcggcttagcggctgaagactgacactgccggatcacctcggaagccccctagaacgtcactgacgccgagcttcaggtaactctcacagtggaaggtaagcccgtccccttcttaatcaatacggaggctacccactccacattaccctcttttcaagggcctgtttcccttgcctccataactgttgtgggtattgatggccaagcttctaaacctcttaaaactccccaactctggtgccaacttagacaatactcttttaagcactcctttgtagttatccccacctgcccagttccctgattaggctgagacactttaactaaattatctgcttccctgactattcctggactacagctgtatctcattgccgcccttcttcccaatccaaagcctcctttgcgtcctcctcttgtattcccccaccttaacccacaagtataagatacctctactccctccttggggactgatcatgcaccccttaccatctcattaaaacctaatcacccttaccccactcaacgccaatatcccatcccgcagcatgctttaaaaagattaaagcctgttatcactcgcctgctacagcatagtcttttaaagcctataaactctccttacaattcccccattttacctgtcctaaaaccagacaagccttacaagttagttcaggacctgcacattatcaatcaaattgttttgcctatccaccctgtggtgcccaacccgtacactcttttgtcctgaataccttcctccacaactcactattccctgcttgatcttaaagacgcttttttcactattcccctgcacccctcgtcccagcctctctttgctttcatttggactgaccttgacaccatcaagctcagcaaactacctaggctgtactgccgcaaagcttcacagacagcccccattacttcaatcaagcccaaatttcttcctcatctgttacctatctcggcataattctcataaaaacacacgtgctctccctgccaatcgtgtctgactgatctctcaaaccccagcacctcctacaaaacaacaactcctttccttcctaggcatggttagcgcagtcagaattcttacacaagagccaggaccacaccctgtagcctttctgtccaaacaacttgaccttactgttttagcctagccctcatgtctgcatgcagtggctgccgctgctttaatacttttagaggccctcaaaatcacaaactatgctcaactcactctctacagttctcataacttccaaaatctattttcttcctcatacctgacgcatatactttctgcttcccggctccttcagctgtacactctttgttgagtctcccacaattactgttgttcctggcccagacttcaatccggcctcccacattattcctgataccacacctgacccccatgactgtatctctctgatccacctgacattcaccccatttccccaaatttccttctttcctgttcctcaccctgatcacgcttgatttattgatggcggttccaccaggcctaatcgccacacaccagcaaaggcagtttatactatagtacaagccactagcctgcctcttagaacatctcatttcctttccatcatgggaatctatcctcaaggaaataacttctcagtgttccatctgctattctactactcctcagggattattcaggcctcctcccttccctacacatcaagctcaaggatttgccccacccaggactggcaaattagctttactcaacatgccctgagaccgataactaaaaaaacctcttagtctaggtagatactttcactggataggtagaggcctttcctacaggtctgagaaggcccccgcagtcatttcttccattctgtcagacataattcctcagtttagccttcccacctcaatacagtctgataacagacgagcctttattagtcaaatcagccaagcagtttttcaggctcttagtattcagtgaaacctttatatcccttatggtcctccgtcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccatttaagctcctgtatagatgctcctttttattaggccccagtctcattccagacaccagaccaacttagactgtgccccaaaaaaacttgtcatccctactatcttctgtctagtcatactcctattcaccattctcaacgactcatacatgccttgctctggtttacactgccggtttacactgtttttccaagccatcacagctgatatctcctggtgctatccccaaactgtcacttttaactcttgaagtaaataaataatctttgctggcaggactatgccgaatctccttaagcactctctaatcagatatcctgagtcgtcccaattctcagaccttttatacctgtttttctccttctgttattccatttagtttctcaattcatccaaaaccgtatctaggccatcaccaatcactctatatgacaaatgtttcttctaacatccccacaatatcaccccttaccacaagacctcccttcagcttaatctctcccactctaggttcccacgccgcccctaatcccgcttgaagcagccctgagaaacatcgtccattctctctccatatcaccccccaaaaattttcgctgccccaacacttcaacacttttttgttttatttttcttattaatataagaaggcaggaatgtcaggcctctgagcccgagccaagccatcacgtcccctgtgacttgcacatatacgcccaggtggcctaaagtaactgaagaatcacaaaagaagtgaaaatgccctgccccaccttaactgatgacattccaccacaaaagaagtgtaaatggctggtccttgccttaagtgatgacattaccttgtgaaagtccttttcctggctcatcctggttcaaaaagcacccccactgagcaccttgcaacccccactcctgcctgccagagaacaacccccctttgactgtaattttcctttacctacccaaatcctataaaacggccccacccctatctccctttgctgactctcttttcggactcagcccacctgcacccaggtgattaaaagctttattgctcacacaaagcctgtttggtggtctcttcacagggacacgcatgaaaaaaatgtgctgggaacaggagataccaggtagttctgccctcagggcccactcatggcaggtagtggtaagccaagcattctggaccttgggccaccaggtggcatatgcaagcacagttttagtgagtgcaggtgggcaaattcttgagactccaggcagtcttcctgtatgctggcagtgggagtggtaagccagatccgtgggtgagtccttaggcccttaagccgaatgtatggcctggattatggtagtagtgatggcaggataattttggggctctcatgtggcactcactaatgttagctgttggtatgatgggctgagcaagctggtccccaggttccttggttgtgcatgtgcatggatgtagttgatggtattgatgacaggctatatgggctcaccttcaggattccagaagtagggtacagatgctagaggtggtagaaggggttgggtaatccccaggtccctgggaggggtgctcatgctttgggtgggggaagcaatggtgacaggtctggtgggcctgatctcagggcatcagggtgtgcagagctccaggaggtagtaggcagggcaggcagtctgtggtgttggttgtggagagcctgacctctgggctggtgctagagtgtggtgatcctgctgttgagtatgggtggggttgctatcagtggtcccctgcagggagctctcagtttctgggtagtgtttgctttgtctcctggctgcagtcagtgactgctatcatgttcaaaggggtcagatggatcctgcctttctgggtgtgaactcaagcacagaggctgtgttgttggtgggaatggggttactatttgcatcctcagacaggcagctgtcaggctcactcactttggctccccgtggcagcagcactattgtgatatgcagaaaggggaagggatccattttcacatgagcccaagtactgagaacatactgctaatagggatgtggttactgtttacatacccagactctcagatttaaggtttgcttgctttggctttcagaggcagcagtggctgcagcagtgtggagagttggggaagggatcttgacctctgtgcataagctagagcacaaaggccatgctgctagttagggcagggtggttccctgccctaatggtaccaggtaccattggtatcattataccaggcagggagctcttgggttctgccaagcacatgcactggttccctttgtctcaggagaagcctccttgatgtactgcgctatcatttccttgaggagttgtactccctgtgggttagagtgctggggaccccacaacaccatcgggtccagccaccattgtgccactgaagccctccaggtggatgccagggaattctactgggggttcacagggtgtgaagatgtggaattgttggttctcagaagaggatgcagtctggtggaagctggactctggccatagtgccctactgcagctgcttatgtcttgctatgtgatgtggtgcaagtttcccgcttgcagcaatgccctggcaggcctctagatcaccacgctgtagagtccccacctatgctaatctcagagctgtatagatggaagaggtctcctgtggttaggattgcagtagtctaagggagatcacacataaagaaactctcctttccttccaactggtggggttcctcatgtgatggatgtctccaattccaagcaatattacagctagcagttcagtacctctctgctcagcagtgaaggaaatctaatggaaacttagaaaaagaatgaaaactctatccctagttttctaaggaacacatatggcacagagacaggactggcagcaaacaaagataaatgaagagtcaccctcagtgaaatcctgactgctgctttaagttctctaccacattttggattttagtgttaggattatttctgaaggagtcttctgaacctcatgttacttacaggaaaaacaatagaatttgatttacataaatgtccttctcaaaccctttgatcaatggtgctcaagttccattttatctgtatacccatagttattcaattgtttaactcattttctgagcaaccaagttctcagtgcagagaactcaattatgttgtttgcttttctgatccaccatcttctgtgtgcactcatgataggatgaacatgggatgaaatcatatttgtaatgaattatagaatgatccctgaaggtagagtacttgtaattatatttatatatcttttgtggttcatatctcataagcgatagatccatgcttatcatgttaatcgtgttattcattggatttaggatctgacttgcctccaccggagactgcttccaagtctgatttttgcaagtcactgaacatttcttcctggtcgtaaaatattcattatttcaactaatagtaatatggttttctttctaatgtattcatagcccatagctttttgagctctagacagactgatttgaaccttttaagcaataaatgagaagaatcattttttgaaatagataatattattttatttagaataacaacatgccacttggggagatattttttgtatatctaattgccacttggggagttttttttttgtatatctaaaagttctcaccagaatatactttatacagaactattgcaaacaaacttggaatcataaaatttcgaggcatactttgtggaaatataccataaattgtgtaaatatctgagtataaagtggagctgtttcgagactgactgtatttaagtaatggagatgcatataaaacttagattttaaatattttattaatcttggcatagtgcatcctaattaggcaggaaaagacctggagggatggaaaggtattcccacaccttcttctcatgcatattgtctttagtcattacttacaattattattttttgtttggtggtttttggtttcaaagggataattacttaaaaggaaagatactgactaaaatatttgctttgtgttagtttaatttaatgatctaatatttgtgttattttatccatgaaagcaatacttctgcctgcaagtatctaaaccagtcatatatttctacctcaccttctttggtaaacaggccttcattattttattcttgatcagttgaaatttaaactgaaataaaatacacttattcaaaatatttaaattatataaaaacaaaaatatttagaaagactgagatcatttatagtatccttagtttttctctagagggtttagcagcaggttgcttctaattcggactttatgtaattataaaattctgaaaaaaatgttaactagaaactatcttgtgtttatgtttaattactttaataataattgttgtgcttcattcattattgaggaaaaattgtaagccttctttcctagttctcacattattttaccaactacggggcattatggcaatcataccctactgaggttgagtattaaaaaataaatatttaaaattaaaatacagcttgtcacatagaatgagcacctgatgccatttatgaggaacaggtggatgtttattcaggcatgttttatgtaccagcaggaattatttcaattaaatatcaatgtcactgcctttagagaagactgaaacaagagcaaaggatacacatacacacagacacacacacaggcatgtaggtgacacaggaacttaaggtatctgaactgaaccagatttacaaaaaagattggttcaatttgtctagattgcctaaaggaagaggtagttgcctctaaaatagatcaagagattttgatctttgttgttgcattgaaatgtgcgattctgcaggtgctattattctttgaaactttctttgggtgaattgaacataatattcttaggtgggttgggaaataaaaatgactaggaaaaacatgtgtctttgcattcagtatatagtgtcttgaattagcaagttatctaagttgtgttaatggagaaaaatacgcaagataaatatttgggttatcacaaaggcaaatattcctaattagtgagagtgagggaggagaaggagacagagaaaaaatatgaataacttattcaaatatacttctatttttaaaatactccaagatattgtgatctgtaaatgtgtatatatgttttcacatcaattattgcaacttaatatgggaaaaattaaggcttgttttaataccaaaataccactcaacaacacagtacatgagcagctgttcacactgaatgatgtagataattaatctaattttccctgtgcttcattttgtgttctattagttttcttattcaaactttcaagtcacaaatctgatttaaaacctcttaactggtctaatgcataatgtgttctctctgcattcagtgtctagcagtaagccgcaaagctggaatactaatttgttttggaatgtgaaaaacactcaataatcaaataataaaatcctggatccaccatttcttaatgacacgaccaaatgagtccaatgccttgaaatgtgagcataagttaaaaaatagaacaaagaagaatataacaatgtgaatgaagaaaggagaaccatgctaacaagaacaccatattcaatatatttggtctctattcaaaatggtcccaattcagaatacaagatttttaaatgagcaagacaaattttgattaacaatattaatgttgctattttaatatttgctactctctatcttctctctcttttcctatttctctcttcttctgtcaacacactcatgattatctgaatttacatttaatattcgaaaattattttctgtagtctctttgaaaaagtctgtattgatttttcaaaacaaaagagctttgttcccttttcttttcttgcaatgtttgtacctcctttggcaaaataaagtttatttccatactttctcttgaattcaagtaaataaaaaaacacacacacacatttcctaaaatgaagaaataggttatgtcagaaaaattaaccatgtactgagtgattaaactattttgtgtagaaatgtcatttctattttgtttaaatgtaatgcaatttaccagaccataaagaactccttagatgaaatggctgttttccaggcaatgctactctgctgctgattgcaatatattctgacatctatgacagttttataattcttctattctgtgctctgaagtgtccctactttgctgaaggttttctcctgggaaaaggcactacagttttgtggactgaaaggacaataaacagtttgatgg

SEQ ID NO: 290 - DNA, 13928 bp, Homo sapiens
gaagaatcacaaaagaagtgaatatgccctgccccaccttaactgatgacattccaccacaaaagaagtgtaaatggccggtccttgccttaagtgatgatattaccttgtgaaagtccttttcctggctcatcctggctcaaaaagcacccccactgagcaccttgcgaccccccactcctgcctgccagaaaacaacccccctttgactgtaattttcctttacctacccaaatcctataaaatggccccacccctatctccctttgctgactctcttttcggactcagcccacctgcacccaggtgattaaaagctttattgctcacacaaagcctgtttggtggtctcttcacatggacgtgcatgaaatttggtgccgtgactcagatcgggggacctcccttgggagatcaatcccctgtcctcctgttgtttgctccatgagaaagatccacctacgacctcaggtcctcagactgaccagcccaaggaacatctcaccaattttaaatcaggtaagcggcctcttcttactctcttctccaacctctctcactgtccctcaaccattttctcctttccactcttcaatctctcccttctcttaatttcaattcccttcattttctgggagagacaaaggagacacgttttatccgtggacccaaaactccagcaccggtcacggactaggaaggcagacttcccttggtgtttaatcattgcaaggacacctctctgattattcatccacatttcaaaggtgtcagaccacgcagggatgcctgccgtggtccttcacccttagcgacaagtcccgcttttctgggaaaggggcaagtaccccaaccccttctctccttgtctctaccccttctctgcttttctgggggaggggcaagtacccctcaaccccttctccttcaaccttagtggcaagtcccgcttttctgggggaggggcaagtacccctcaaccccttctccttcactcttagtggcaagtcccacttttctagaggagggggcaagtaccccaacctcatatctctgtgctccaatcccttatttccatgccgcgaccccttatttccgtgccccgaccccttatttccatgccccgaccccttatttccatgccccatcccttatttctatgcctcaacctcttatctctgtgccccaaccccttttcccacttttctggaaggtaagaacccccaaaccccttccctccatttctctactctctcttttctctaggcttgcttccttcactataggcaactttccaccctccattcctccttctactcccttggcctgtgttctcaaaaacttaaaacctcttcaactcacatctgacctaaaacctaaatgccttattttcttctgcaatgccgcttgaccccagtacaaacttgacagtagttccaaatagccagaaaatggcactttgaatttttccatcctgcaagatctaaataattcttgtcataaaataggtaaacggtctgaggtgcctgacgtccaggcattcttttacacattagtcacttcctagtctctgtgcccagtgcaactcgtcccaaatcttccttctttccctcccacctgtcccctcagtaccaaccccaagcattgctgagtctttctaatcttccttttctgcagacccatctgacctctcccttcctccccaggctgctccttgccaggctgagctaggtcccaattcttcctcagcctctgctcctccatgctataatctttttatcacctcccctcctcacactgggtcctgcttacagtttcgttacgtgactagccctccccatcctgcccagcaatttactcttaaaaaagtggctggagctaaaggcatagtcaaggttaatgctcctttttctttatcccaaatcagatagggtttaggctctttttcatcaaatataaaaacccagcccagttcatgacttgtttggcaacaaccctgagacactttacagccctagaccctaaaacgtcaaaaggccgtcttattctcaaaatacattttattacccaatctgctcccgacattaaataaaactccaaaaattaaattccggccctcaaaccccacaacaggatttaattaacctcgccttcaaggtgtataataatagaaaatagttgcaattccttgcctccactgtgagacaaaccccagccacatctccagcacacaagaacttccaaacgcctgaaccgcagcggccacgcgttcctccagaacctcctcccacaggagcttgctacatgtgccgggaatctggccactgggccaaggaatgcctgcagcccaggattcctcctaagccgcgtcccatctgtgtgggaccccactgaaaatcggactgttcaactcacctggcagccactcccagagcccctggaactctggcccaagcctctctgactgactccttcccagatcttctcggcttagcggctgaagactgacactgccggatcacctcggaagccccctagaacgtcactgacgccgagcttcaggtaactctcacagtggaaggtaagcccgtccccttcttaatcaatacggaggctacccactccacattaccctcttttcaagggcctgtttcccttgcctccataactgttgtgggtattgatggccaagcttctaaacctcttaaaactccccaactctggtgccaacttagacaatactcttttaagcactcctttgtagttatccccacctgcccagttccctgattaggctgagacactttaactaaattatctgcttccctgactattcctggactacagctgtatctcattgccgcccttcttcccaatccaaagcctcctttgcgtcctcctcttgtattcccccaccttaacccacaagtataagatacctctactccctccttggggactgatcatgcaccccttaccatctcattaaaacctaatcacccttaccccactcaacgccaatatcccatcccgcagcatgctttaaaaagattaaagcctgttatcactcgcctgctacagcatagtcttttaaagcctataaactctccttacaattcccccattttacctgtcctaaaaccagacaagccttacaagttagttcaggacctgcacattatcaatcaaattgttttgcctatccaccctgtggtgcccaacccgtacactcttttgtcctgaataccttcctccacaactcactattccctgcttgatcttaaagacgcttttttcactattcccctgcacccctcgtcccagcctctctttgctttcatttggactgaccttgacaccatcaagctcagcaaactacctaggctgtactgccgcaaagcttcacagacagcccccattacttcaatcaagcccaaatttcttcctcatctgttacctatctcggcataattctcataaaaacacacgtgctctccctgccaatcgtgtctgactgatctctcaaaccccagcacctcctacaaaacaacaactcctttccttcctaggcatggttagcgcagtcagaattcttacacaagagccaggaccacaccctgtagcctttctgtccaaacaacttgaccttactgttttagcctagccctcatgtctgcatgcagtggctgccgctgctttaatacttttagaggccctcaaaatcacaaactatgctcaactcactctctacagttctcataacttccaaaatctattttcttcctcatacctgacgcatatactttctgcttcccggctccttcagctgtacactctttgttgagtctcccacaattactgttgttcctggcccagacttcaatccggcctcccacattattcctgataccacacctgacccccatgactgtatctctctgatccacctgacattcaccccatttccccaaatttccttctttcctgttcctcaccctgatcacgcttgatttattgatggcggttccaccaggcctaatcgccacacaccagcaaaggcagtttatactatagtacaagccactagcctgcctcttagaacatctcatttcctttccatcatgggaatctatcctcaaggaaataacttctcagtgttccatctgctattctactactcctcagggattattcaggcctcctcccttccctacacatcaagctcaaggatttgccccacccaggactggcaaattagctttactcaacatgccctgagaccgataactaaaaaaacctcttagtctaggtagatactttcactggataggtagaggcctttcctacaggtctgagaaggcccccgcagtcatttcttccattctgtcagacataattcctcagtttagccttcccacctcaatacagtctgataacagacgagcctttattagtcaaatcagccaagcagtttttcaggctcttagtattcagtgaaacctttatatcccttatggtcctccgtcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccatttaagctcctgtatagatgctcctttttattaggccccagtctcattccagacaccagaccaacttagactgtgccccaaaaaaacttgtcatccctactatcttctgtctagtcatactcctattcaccattctcaacgactcatacatgccttgctctggtttacactgccggtttacactgtttttccaagccatcacagctgatatctcctggtgctatccccaaactgtcacttttaactcttgaagtaaataaataatctttgctggcaggactatgccgaatctccttaagcactctctaatcagatatcctgagtcgtcccaattctcagaccttttatacctgtttttctccttctgttattccatttagtttctcaattcatccaaaaccgtatctaggccatcaccaatcactctatatgacaaatgtttcttctaacatccccacaatatcaccccttaccacaagacctcccttcagcttaatctctcccactctaggttcccacgccgcccctaatcccgcttgaagcagccctgagaaacatcgtccattctctctccatatcaccccccaaaaattttcgctgccccaacacttcaacacttttttgttttatttttcttattaatataagaaggcaggaatgtcaggcctctgagcccgagccaagccatcacgtcccctgtgacttgcacatatacgcccaggtggcctaaagtaactgaagaatcacaaaagaagtgaaaatgccctgccccaccttaactgatgacattccaccacaaaagaagtgtaaatggctggtccttgccttaagtgatgacattaccttgtgaaagtccttttcctggctcatcctggttcaaaaagcacccccactgagcaccttgcaacccccactcctgcctgccagagaacaacccccctttgactgtaattttcctttacctacccaaatcctataaaacggccccacccctatctccctttgctgactctcttttcggactcagcccacctgcacccaggtgattaaaagctttattgctcacacaaagcctgtttggtggtctcttcacagggacacgcatgaaaaaaatgtgctgggaacaggagataccaggtagttctgccctcagggcccactcatggcaggtagtggtaagccaagcattctggaccttgggccaccaggtggcatatgcaagcacagttttagtgagtgcaggtgggcaaattcttgagactccaggcagtcttcctgtatgctggcagtgggagtggtaagccagatccgtgggtgagtccttaggcccttaagccgaatgtatggcctggattatggtagtagtgatggcaggataattttggggctctcatgtggcactcactaatgttagctgttggtatgatgggctgagcaagctggtccccaggttccttggttgtgcatgtgcatggatgtagttgatggtattgatgacaggctatatgggctcaccttcaggattccagaagtagggtacagatgctagaggtggtagaaggggttgggtaatccccaggtccctgggaggggtgctcatgctttgggtgggggaagcaatggtgacaggtctggtgggcctgatctcagggcatcagggtgtgcagagctccaggaggtagtaggcagggcaggcagtctgtggtgttggttgtggagagcctgacctctgggctggtgctagagtgtggtgatcctgctgttgagtatgggtggggttgctatcagtggtcccctgcagggagctctcaggttctgaggggtgtacactttcaactctggcagtagcagtgtccacagtggtgtgtgtgaagagcctgcactcatgacatgcactagagcacagaggccatgcttttgaagggggcagggttgctattcagagccccaaacaggcacttctcagtttctgggtagtgtttgctttgtctcctggctgcagtcagtgactgctatcatgttcaaaggggtcagatggatcctgcctttctgggtgtgaactcaagcacagaggctgtgttgttggtgggaatggggttactatttgcatcctcagacaggcagctgtcaggctcactcactttggctccccgtggcagcagcactattgtgatatgcagaaaggggaagggatccattttcacatgagcccaagtactgagaacatactgctaatagggatgtggttactgtttacatacccagactctcagatttaaggtttgcttgctttggctttcagaggcagcagtggctgcagcagtgtggagagttggggaagggatcttgacctctgtgcataagctagagcacaaaggccatgctgctagttagggcagggtggttccctgccctaatggtaccaggtaccattggtatcattataccaggcagggagctcttgggttctgccaagcacatgcactggttccctttgtctcaggagaagcctccttgatgtactgcgctatcatttccttgaggagttgtactccctgtgggttagagtgctggggaccccacaacaccatcgggtccagccaccattgtgccactgaagccctccaggtggatgccagggaattctactgggggttcacagggtgtgaagatgtggaattgttggttctcagaagaggatgcagtctggtggaagctggactctggccatagtgccctactgcagctgcttatgtcttgctatgtgatgtggtgcaagtttcccgcttgcagcaatgccctggcaggcctctagatcaccacgctgtagagtccccacctatgctaatctcagagctgtatagatggaagaggtctcctgtggttaggattgcagtagtctaaggtaagactgtgtacccctaacggctcacactgaccctttccctataatagggagccgttccaggatcccagctggtcctggctgagctagctgctagcttcctctccttctgtgcctcaggtgtttcctgtgacttctctcttaaactctagtgttctttcctagataaattctgttcaattctattcagtgtgtgattatctattaacagttttacttctttctggggaggaagagtgtctgatgtctctagttagcatcttaaaacctctctccaatatgtggttctattgtccacatgtctgctatcctataggaagatgctctgacatttgtctttattttgatatccctcatgagtttttgaagtggttttataaagtcatatcaaggaatggatatagacaaaaaaggaaatgctatttttaattgattgatagaataattattgaaatacattcttcttaaaatggaactttaagggcatcttagcatgtgtcaagaaacaaataagagggagaacagggggagggtgatgaggagatgttagtcaatggataaaaaatttcagttagatgagaagaataagttctattgtaaaatatagtgactatagttaatgacaatgtattgtacttttcaaaattactaagagtagattttaagtgttttcatcataaataaatggtaagtatgtgcggtaatacactattaattacctcaatttagccatttcactatgtatatatttcaaaacagcctgttgtagaaatatatataatttttgtctattaaaaataaattaaaaatagaaacaaatgagcagttagttgaaaagaaactaaacatcctcatgagatagtaactaagtttatgactcagcaggagcattttattttttataaatgcacctttggttaacaaagaaagcaaaaagaacactgatattaacatgtaaatgaaaaattagcataaaaagttgatatttcttcaaattttcctgaggtgatttttatctgttctaagacttacaattatttgataagacttttaaaattacttactaaatgcaattttaatatgtaaaagtaatttttcagcaaaatattaacatatattaaagagataaaatacactgattagtttctcagtttatcattttgtcactttggaagtaaggctatattcacgtactatgtgctagccatttgtagggaaatgctaacaaatgaccacctgagtaattttcagttgtctcaacttttaaacaaaaattggagaacttataaaatggcacagaggatttgttaaaaatacagcattcaagtattatacatattaggtcctaaatacagttaatttatgatggcgcaatttcattatataaatggtagtcctgaatggaatatgttatatccacttatgtacaaattatatattttctcatgtaattaaagaaagttaatcacagtgtatatcacttgcaaatgggttaaaacaaacggggacttcatgtgtaatgaatatagccaagtataatattcaaataaattttataacaacatatgtaataatatgctgctaatgttctttttatgtttttaaaggttttctttgttttattaatataaaaatgattaaatatacccaggcaacttatgaaattatacatttttgtaaaaagtgtttacaggtaaaaaatgactgggaaaagttgatctagataagaaaattatatagtggtaaaatattacttgagtattttctgtgtaaagtgttatggttttattttcattgttgtaattgtgtgtaatccacacaatttttttctggcattagaaaggcagagattacaacgaatgtgacaatgattacttgctagagtgttcgctgatgagatataaataggttctatgttggaagtacagctgcagaggagatcaataaaattgttgtatggaatttgtaatacaaattaatttgtaccaatggtcacattaattattctatttaacacattcaaatatattctatttcagtagtgtgcctctgtaacattctcaacacaaaaatacaactttgaacaatatcttgccttttcatattttatattaaaacagaataacattgttctgccgttttgacccttccaagatttctcacagataactgagaggattgagaaacagctaggttccgagtaaaaagggtttaatgaatgttgcagtagggtaattttcatggaaatgacatttttttgaagcctagaaaatgtaacaaaaagagaaaaggaaacagcctatcttcatgctgatgacaatgtttataatgagcctgaataatagaaatttaaccagctcctgaagtattataatctgcttttgatttctatgggaactttgcaagtagatataggtataacaaaagagattttatttgaaactcttcaattaaactaagaattgatagaaaacagttcatattttatattgagttaaccatgtatatgatcattactaatgaggcaaatcttttgataccttcatattccattctcaaatagagaacaataaatgtaatatttttcagacaattctctctcacaacatgttctcactctccatctgtatgtacatgtgtatgtatatatgtatttttgcacagatagatgtacagatagacataccactcttagaagaggcagtggtgttgggagactgaggaaggctaattcatacaaactatgtgtctgggagaaacatgtaatatttcaaacatttccaaaagttaaaatcttttactggcatgtatttcagaatattattaataattattaggttgtattaagaagcttgagatatgctgagtttttaagtaattgtttttgctcagcaaagagattttcctgaatttcctaaatttaaaacctatgtttcattgtcaattttttttcaggcattatgtattatgatagataagctgaagcatgttaatttgtgctccagattaaaaagtctcagtgctacagattaaagtgtcccagttgatatgataacattctttaaatcatctttagctagtactacacacacaaacacacatactatattgtattcaaaggtgaaaatccttgtatcttaaactaaaataaaaataaagaattttgttgtcataaaagcctgtatcccagtgtttaaggcactcacctgctgtgcaagacatctcttttggacatgtcctattattaaaagccttcataaggctttaaagactaagaaaagatcaatcagtttcatttttgtttttcagtaagcagagaaacgattggaagctctagtccatcagtgtgctgttgacactaagcccaacattgcctttgatcagatgatgttttgccagccttttttgtgtcttacttttagggacgtggattaaaacaaactgcccaactttcagtccaaacaagaaagaaccctgataggcaggaggaatcatctggagcatgttaaagagcagtctttctcagttattttttagtctttgctactgattcctatagtctaatacttgattattcacagtacttatcaattaacaccactggttaaaacgcagttttatgacttatgatttccatgtagatttgaaagaaaacccagaggagtaacactaagaatattgtgttctgccaattaaaaacaaaatatctaatcagaaaattaatagcctcagaatttgatatccaggagaagaattgggagatcctgctatgttttgctctgagggtcaagtgaaaacaataaaatgtaagcctttgactcagtatgtgagttgatgataaagagtggactgtgctatgaattttgtactgaaatgctctgaaatatgtttactgagatctaattctctctcactttttctctactcttatttgaatcactggatgcaagggattacttgttttcttcattttctctctcactttttcctctgtcatgtaaaaataatgattgggtaactgcaaatacaaactcacctttgttggctcctttgcctcttcttggtaactgtaaatgacttatattctgattcttacttggctattactataattgtgactttgagtaaaaaacttaaccttaaaaacttagttttaccatttgaagaatgaaaaattagataagatgatgcccagtgactctttgcctcacattttagtacagtttattcatttctgtttgatttcatatgatgtctctttgtgtgactttttacaaagaaactactaagactttgaaattggattgaaattaaagacaatttcaatccagtcttctccagcccatactcttgagaagatttagatgattacaaaatgttggtttttcactgaccaagatggcctcaatgtttcccttagctggcctgctctttatactgaccttttcctaactatggagtccatccatcttttcattagaagatttactttagtaaacttgcaagagtaaattctttatctgcctttttcaaatgcatgtaagttttctttcagcctcttgctactttgataatccaaaaaatgcttttttcaagtacatggaaaccatttctttgaaatgtgaacatctaaggaaaaacatctgtattagtcttttttcaagttgctgataaagactgagaaatttacaaaagaaagaggtttaatggactcactgtttcatgtggctggggatgccttagtcaagttgaaatgtatgtctcacatggcagcagatgagatgagagcttgctcagggaaactcccctttataaaaccatcagatctcatgagacttattcactatcatgagaacagcatgggaaagacctgcctccatgattcaattacttcccaccgggtcccttccacaacacattggaattgtgggagctacatttcaagataagatttggatagggacacagccaaaccatatcagcatccttatctcccagtcccggtggacaccacttagtaaacacagatggccaaattgcagagaaaaccattttcaaaatgagcaataactcagtgtacttcacctatcccattgattaacctctctaaattctctagtactttcccacaagttcaccctagtgctttacctcccactcccccaaaacttcatttcaacagtattaagtccaatctgtcttctctactgctgtagcctgaataaagtctaatttgcccatttaagtttgaagcaatttttgcttcaataccctttatctttgtgtgaaaattttgcctggtcttggaagactggggaaaaagctattcttattttttcagttattgcctcaagcatctgtcttcaaatttctagaaaatcctttttgtataccctgtactcatattcccaaattttggtcacttttgtttttgaatactgccattacctccatccttattaggtgaaacattgttactctatcaaattcttgatcaaacaatgcctacaccatgaaatatgattttccttatttctttacttagaaatgatcttccattgtctgaattcctattgtatattttatacttccttcatgacttagcattatgtcctttatatgcataagtataaatataactataacttttacattatatgatcagtgttatttagattttttaaattaatgattttggttttatgtttgtgtctttcttttgcaagagcctaacttatttttataccagtggttctcaaagtgttattgtgagaatctcttagaaaagcatattcggggatctagctcaatagtccagtatcaaaaactctggggtgaggccctgcaatgtgtatgttaacaagccattcaggtgattttcatatatgtggagtttgagaactattgtttatttttctcactgtcttgcacttcataagagataaaagtgtttctaaatacagaaaatgtattcaaacattcaaacatatccaagcaacatacatatgtatttcacttaaaattaatgtttattttaattatattatttttttctagaaaactcacttgttctctagaatatgtattatagctcaaagtgtcactaaagatcatctaacaatcagttttcatttttgtaaatgaagtgaggatatactgggagaaattgaataaaacatgatgtactctaataaattacattgagattgaaatttttattttccaaagcccagtccaacgtaattttaaaacaacatattgtggttaatgtgtggttatttcactctaaatattagatccccactctccaacagaattttttgtaataataaaaattttctacatctta

SEQ ID NO: 291 - DNA, 2031 bp, Homo sapiens
aattaacaatgttaaatcctaagcaagatacaaatgtcaattttagaattagaagggaatttaatgcacaaaggaaagatgttattgcattttatcccatttctgaatgttagctttataaaaagcatttctattaaaatcatacatgcagtttttctaatactgaagatataagcagtaaagtgatctggtcattttctccaaggttgaattcttccccctatcattgagaaatatagcccacagtatttggtgacattttctgagtttatttgcatgatattcaatgtaagtaaataccaactttttattctgttggtttatcctaccttaatatttgttaaaatgcattcataattgatttattgtaaggtcagaaaatgctagaaaattgtatttctcttatatgaactacaaaattaggaaattctctcaggaagacattataaaacataatagttataaaaagtcacccacactacagataaaagcagctaagtataatcgattactattttttcctacctaagatagatctgctttaaccaagtcttatgagactatgatatatgagaattctgatatacctgacagataagctagaggtggttatttgctttatgaaattattcgtaatagttcacttataaaaagtaacttctggcgcttttaacataattgatttatacataacttttcagaaatatatgtaccatgcacaattatatctccattttaataaatttctctttttgtttaaaaccaagatttaaaaatgtgttccccaactatcctgagctcagagcataaaccttccagagtggagcatgtgaaagacacagtgctgtattttccatgaatattgttaatggcaggaactgagaggtatccatgtggctgaggctaaaaagcccaagcagggctttaccgggctatcttgatcttcaccactgagcctgctctcagatgcacctgtagctttatgagattcaaattcagttccaactgggctttgtccatttctctggctttagcagtccttttgcatggggtaaactggttcttgatgagtcttgcaccctctaggaccccttatgttgaaggcagctccagggacctcttaacacccattctttacattcattcattccagtagagaggggcctcgacagacaagccacgccctagaacttcagtctcactcctgatgcacagaaaccagatatgagcagatgaaatttgcctggaaatctcaagagccattaacttctctgaagtggggtccatcatgataagtctgaacatcgtagtaaagattgtctcattcttattcctcatgatctgatgattgcatagcagaatataaccacttaattctgaattgtcatgttttgtacagatggtttgctttcaaatgataagacttaattgatcagcattcataagtaactgtgagtattcggcaacattaatcaatctaacatcaatgcttaaaaataagcccagtgcattatgtgggaataatttttcatctgaggctacctagtaaagaaattggtagaggatcagccaaagagacctcagagtaatgggactcaagtcaaattgtctcatgttcaggtttacagtagcatatcaactaaccaggaaactctataattttattatcttctctatttatcactatagaatcaatgtgtatccagctattgaatcctgtaatataggtctactgtttaaaactgcagattttaagtaaaatccgtaaaatctagtttacacaatagagtggaattgatccttcatttagtcattttccatcctgtaaagaaaacaaggcttattctcatcttctaagctggagaggaaaaatatagagaaaagaagaaaaagaagcccaaggaagataatcaggagggtgcctagaagcagagatgtttatagctaaaagggatcttggagactcatctagcacctaccaactcccacctccatggcattaccaataaagacactggggctaagaaagat

SEQ ID NO: 292 - DNA, 2091 bp, Homo sapiens
gcggcgggacggcgggccaggcaggtcggcgcggcccggcgctggagctaggcggccggactggcaggggcggcgtgccgcgcgggaccctcactggggaaggtggggggtcggggccgcctccgccccgggccgcacgtccgaagaccggaggaggggactgcgcacgccaccaagagggcgcacagccgaggctggacgatgcgcggtttcggagcagggtttcctgcccagggagcccggctgcgctcgaggggaccccgaagtcaccggcagggtcggagctcggtgcaccacgccccccctctgcgcccggggcctctgcggggacagaggtctcaggaaagtagcctttatttatgtggcaccgatcggaacccgcggccggccaggcggacctggacggagcgtccctgctcggaacctggcgcggggcgccgcgcgctcgtgtggcgcctcggcctccccaccgttcagtccccggaggcacggagctcgcggcgggacgatgacggttgggccgggccaggcgtgggagactcccagactccggcccgccgggacggccagctgcgtcaccttggacgtgggcaatacttcggagcctcggttatgtcgcctgtaacctgaggacaacggcctggaaggggctcaggtgacacggcggccctcactggggccgatttagccggtctgccgcccctccgcgccggaccgccaggcggggtaccagggaaactgcgatgcgccggcttgcgagcccaccgtgacgcagagctggcggccgctagcgacagccaccctgtgagggactttccccccaataccctaaccgctttcctgtccctaagggcccgctcccgccccggctccgtttctgtctctctgaggaagcccggcgcagcctaaccctcacagggccgcggagagggcgcgccaggcggggatttgcgccaggcccgcggcgcatgctcagtggttggggactgggcgggtaccccgggcggggagcctgactgaacggcggctctgctgattggtcgggctgctcacgccacgcccgttgccttccgatggacagttccttacctgccgggtcggcctccgcagagagtggtggtcttgaaaacccagttttgggagaatacctgccgcgcctcccgcccaaatacccagaggtttcatagccgccatcgctgcggtggaggaggccgcctgttgcgtcccaccccaccagaaagcctaacactggcctgaagcgtaatcttaaagtggtaggggaaaataccgatctagcgcagagagcaaaacacctccgttctgggtttaatgggcaggtctggaggtgaggtatgccgtccgcactcaataattacttgcaggatcggattgtttctccagtgggtggggactgcaggatgtagcattgagtgagcctggcagattgaaagataaaacaagggtgatgataaaaacaattacacactaacccatttcctcctccgtgaaatgagggaatggcccagacattttccagacctcttctgtcctaagagtggagctgggtgacagagcaggtgcaagccggcctttccctgcctccccggggaacgcactctgttcggtgagagcaactcagctcgcattgactcctttcagctgcaggagtgtggccgttcagttctcatttgaactgttgacaacagttgtcttctgagaatcatgagttagagcctccctttaggcttctgactccctcaaaagtaccagacaacacaaacttttcccctcttgttaccttggctctctaagctgtatctacttctatacaaggcgaacaattttgtctttttaaattaaaaacaacaacaaaagcacctaaggttgtagggttttatattcttttttcttttctttttttaagagctatatgattacagtagagtgtgtgtgtgtgtgtgtgtgtgtgtgtgtgtgtgtagtctaaagaacaaaatttcaacaaatggttttaaagatctaattggcttctattagcaatgcatgaaccaggcagcattctgactacaaaatagacgggagctcttgtgg

SEQ ID NO: 293 - DNA, 2091 bp, Homo sapiens; identical to SEQ ID NO: 292

SEQ ID NO: 294 - DNA, 5852 bp, Homo sapiens
ctgcactccagcctgggtggctgagcgagactcagtctcaaaaataaataaataaataaataaaggaggagtagacaaaatactaattattaatgtttattgaatgcttactctattccagaaactggccgttctaagtgacctgaatgtattcttaatcctcacaattctgtaagatggatactattattatcccctcttacagatgagctggttaaacaatttgctgaaggtgaacagctagtaagtgacagggcagggatgatgaacctaggcagtgggcgttcagagcacatatactccactatgctaaaccacctctcttcaggtggctgcaattgcagctttcaatattttttctcaaaaaaaaaaaaaaaaaaaaaaagacttgaggttagaatggaaaagtgtcaggaattaatggagctcattggtaggtacacagttattacattattctatgtttctctgtatatttcaatcacaatattaacacaatttaagtaaaaataaaaattatgctgtttagcagcaacaaaataaagtaatcagtatgtacatgtgagtcagggaagacttctacagaacaggagacacttgtgctggatcttaaaaagtagtcaaaagatagataggccagatgaggtggctcacacctgtaatcccagtactttgggaggtcgaggtgggaggatcccgtgagcccaaaagttctagaccagacttggtaacaaaaggagaccccttgtctctacaaataaaaaataaaaaatttagccaagcatgatggtacgcacctgtaccaagtacacagcgacttgagaggctgagatgggaggatcacttgagcccagtagataggggctgcagtgaactatgatcacaccactgcactcctgcccaggcaacagagcaagaccttgtttcaaagcaagcaaacaaacaaacaaacaaaaacaaacataggtagatggacattctgggtgaaaagagaataccacatgccacatagcaaggcgtgaagctagccacatgcattgccaagttacaaatggtaccacgcaactggagaaaatactagagacaagtctttaggaataggcgagggccaggtcctaaagaaagtgaatactgttctaaagagtttggagtttttatctaagaggccagagatcacactgaggcaaaaggggggccacatgtggcataaggctatgttcagtttgtgtgtgtggacatgtgtgtgcaaatttgaattagttaactacatatatatccaaaatatggcagctttcacataaaattttaacttttctacttctcatgagaaatcaaaagatttaacaatacagggatgctcaacaatacagggatacagtataataactatttagatagcatttacactgtataagggcagctcactttgccacgtcccgtactttactctgatgtagacacttgtttttttgttttttttttggttttttgttttgttttgttttgttttgttttttgagactgagtctctctctgtcacccaggctggagtgcaatggcgcgatctcggctcactgcaacctccgcctcccaggttcaagtgattctcctgcctcagcctctcgagtagctgggattacaggcacatgccaccatgcccagctaatttttgtatttttagtacagacagggtttcaccatgttgaccaggctggtctcgaactcctgacctcaggtgatccgccctcctcggcctcccaaagtgctgggattacaggcatgagccaccacgccggccaacacttgtattttttcatccctgttcattcttttttttttttttttttttttgagacagagtttcgctcttgtcacccaggctggagtgcagtggcgtgatcccagctcactgcaacctctgccttccaggttcaagcgattttcctgcttcagcctcccaagtagctgggattacaatgcatgccaccatgcctggctaatttttgtatttttagtcgagacggggtttcgccattttggccaggctagtcttgaactcctgacctcaggagatccatccgcctcggcctcccaaagtgctgggattacaggcatgagccaccgcacctggccctaattctgtcatttcttctatattcgttagctaacatcctgtaaagaagacattttcttttttactctcccatctgtctctctctgtcgcacacacacacacacatgcgcacacacacacacacacaccccactgtggcctcagctttttatttgctcaatgagttgcaatcattctttgtattattcagaatttcccaaatctcaagtaatatagaaaggacaaatagaattctcaaactccagttaaactttcagaaacgcttgaacttccttgacccaaactattgccttttctcttaatgacagtgaagtcaactccataggtagcccattaactctcaaaatcctggcctcaagtgatctccctctcttggccttccaaagcattgggattacaagcgtgagccacagtgcctggcctagcccattgattctcaacctattaactgatacttagtcatcttatctgcctgggaatgttgctcccattatagactgtcttattacgagctgatatagccaatattgcctatgactggggtgatacgcttggttttgtaaaaactgaggtaaaataggcataacaaaatttagcattttaaccatctttcagtgtatggtccagtggcattaagtacattcacgctgttgtgcccctatcaccactatccatcccaaacttttttcatcttgcaaaactgaaactctatccattaaacactaacccctcattttcctccttctcccagcctcttgcaaccaccatctactttctctcactatgaatttggctactctaggtacttcacataagtggaattgatacactcatatcaacaactatttgttttatcaagaaatatgaataccttttcaaaaatatccctcaaaacaatcccaggccaggaacagtagctcacacctataatccccacactttggaagactgaagcaggagaaccacttgaggccagaagtttgagaccaacctgggcaacatagcaagacatggtgtgtacaaacaatttttaaaaaacaaaaaattagtagggaatggtggcacccacctgtagtcccagcaactggggaggctgagatgggaggatcgcttgaggctggaagtttgtgtgctatgatcctgctactggatcttgctagagtgctatgatcctactactgcactctgcactccagcctgggcaacatagcaaaactgcatctaaaaaaacaaaaacaaaaaccattgacaatttaaaatgtagaggcttcatctgctgaaggacacatcagaaaaagactgccctttacctcagtggaaaggaccttgtaggcactaactaacaaataacacagcaattgaactctagggtattgatccttgcatccttctttctttcttcctttttttaagacagggtctttgtcacccaggttggagtgcagcgatgcaatcatagctcactgtaaactcaaacgccccagttcaaatgacccacctcagcctccaagtagctgggactacaggcatgcgccaccacacccagctaattttttttttttttaagagatggggtcttgccatgttgcccaggctggtctcaaacacctgccctcaatccctcaagatatcctcccacgtcagcatcccaaagtgctgagattacagtcatgagccactgtgcccagctatatccctgtttcttgaccaaggagaaattagccattcttgaatcaggaggacattgctatcagagacctcaaatggagaatactgaggaatcatccagaagcagaaaactgcaggaaggggacaacttccactgaagaccataggaacaagctaacgactgcatgaagacagcccaagacctgaggaccatggaagataaggagctggagctatgtgtttgtcacacttcaatctgcatggaggcttttcataatttttctagatattttctttcatcttttttgatttatgctttgctttgttgacagacagcttgttaccttgactagagtacctataagcaatgatttcttagagccagatagaaccggcttatgagaatcaattgctaaattgtcaggaatcttgccagatagttgtgaaaccactggtgacttgaaatcagtctacaggaacatgcacacaatggaaatcagaaaacatagttttatttgtccttacaatgtgtgtctggaaaatgttactgccagtgttctatgttctaaagttatttgaagtaatcatttcccctgtgtgattaggttttatattcaggtctgttcatttgtttctgtttgtgttcaattgtttctgtttgtgtttaatttgattttttcccatttgacttaattttggtttttgaatatatgagtaatttacatgattgaaaagttaaaactgtataaagaaagatactccaagagttcttgctctcaccctgttccctattcccatctcacccattgttcagaagtagccatttccattttcaacaatttcttgtttattatttctttgaaaaaatacatatgcataaatatgtgtgtgcgtgtagatgtgccctagtttattcaatcagtctcctattcatgggtagttgtactggttttcaagccattcctattgcaaatagcatatctgtatagcatatcttattttgcatttgcatatcatatctgtacatcatagtttgcatttgtggaggtgtatcagctagatttctagaagagtcactgaatcaaagagtagatgaacatgtaattttgttaaatattgccagatttccttccaggggagttgtgccattttgcaatcccaacagcaatgtgtggaaatacctgtttctccccaggcttaccaacagcgtatgttgtcaagcttttgtacttctgcctaagaactgtgaggtgtctgagatttttgccctccttgcaaggtggatgccttgccctggtgggcttgtgtcagagctaaagaacactgaaattaggaaacccccagtcttataaggagctactaaaaacctacctaacctttgacctggaggaaaatgttgtttttattgtcttggtcaggagaggaatctaccctctgtccttccagaatgtttgcagcacaaaagacattgagaacagaagctgtcacaagacgtatagaaacaccatgaaggattgtctctcaacactgccaatctgataagggaagaacagtatttgaatatacgctgtccagtacctcctgtgaataccaaaatccatgaatgctcaggtcctttatgtaaaatgtggtaatatttgcatataacctatgcacatactccagtatactttaaataatctctagattacttataatacctaatacaatataaatgctatgcaaatgattgatatactctattatttagggaatactaataagaaaaataagtctgtacatattcaatacaaacaatttttttttcaaatacagtcatgcacccataaggaagttttagtcaacagctgactacatatacaatggtggctataccatatagcctatgtgtgtagtaagctataccatctaggtttgtgtaagtacactctatgatgttcgcacaatggtgaaatcgcctaacaacactttttttttttttttgagatgaagtcttgctcttgcccccaggctggagtgcaatggtgtgatctcagctcactgcaacatt

SEQ ID NO: 295 - DNA, 3834 bp, Homo sapiens
cggaaaggggagggtgagtggtcggccagatccgccggatccgggatccgggagtcgcgctaggacctggagggctagtcggcgggctgcgcgtccggccgctagctgagctggaggccaccggccagagccgaccccaggagtgagagagacaggggcgtgcgtgagttccggcggcctgcaccgggcaaaccccgtaccttcccagcatcggctcagcaacccacgtgcatccaggccggtcaatgtcattgagtcacctccgcgccttggccaccctggagtcccgagaatccgaagttccagacaaatgcccaaactacattcctgcatgttcgaaagcgtaaattgcaaagcacaaatccagttgtagattgtggccgggagcagtggctcacgcctataatcccagcactttgggaggccgaggcggacagatcacgaggtcagcacttcgagaccagcatggccaacatggtgaagccccatctctactaaaaatacaaacattagccaggcatggtggtaggcccctgtaatcccagctactcggtaggctgaggcaggagaatcacttgaacccgggaggcagaggtttcagtgagctgagactgcaccattgcactccagcctgggcgacagaccaagactccatctcaaaaaaaaaaaaaaaaaagttatagattgtaaggaaaatacccccaaggaagttgaggacacagcagacttggactgtctccaaacctgttcattcttctgagtgcactgctcggagcatcctattgggcagcatatcctggcctcctttccagttcgatgtggtactatacctgatttctggccaataaaatatgagaggacatgaaattcaacagcccctgggcttggcttataaaaccttccatgcaatcctccacaccttttcacctctcagctgctgagacttttctaggcactacacagaagcagcctgggtctccagtagcaaaggagagcagatccttctcactatcctgcaccgaactgtgacatgagcaaaaaataaagtttttattttcttacaccattgagatttgaggattgctagagcagttagtcttcccagcctaatacagtattagtagaggacaattaggccagacacagtagcttatgcctataatcacagcagtttataaggccgaggtgggcagatcacctgatgtcaggagtttgagaccagcctggccgacatggtgaaaccccagctctacaaaaaatacgaaaattagccaaacatggtggcacgtgcctgtgatcccagctactcaggaagctgaggcaggaaaatcttcaagccaggaggcggaggttgcagtgaaccaagattgtaccagtgcactccagcctgggcaacagagtgagactctgtctcaaaaataaataaataaacaacaaaaaacctttttcagaataaaaacatacattaacaatatcaagaatggccaggcacggtggctcacacctctcaccccagcactttgagagtcccagggtctttgtcacccaggttggagtgcagcgatgcaatcatagctcactgtaaactcaaacgccccagttcaaatgacccacctcagcctccaagtagctgggactacaggcatgcgccaccacacccagctaattttttttttttttaagagatggggtcttgccatgttgcccaggctggtctcaaacacctgccctcaatccctcaagatatcctcccacgtcagcatcccaaagtgctgagattacagtcatgagccactgtgcccagctatatccctgtttcttgaccaaggagaaattagccattcttgaatcaggaggacattgctatcagagacctcaaatggagaatactgaggaatcatccagaagcagaaaactgcaggaaggggacaacttccactgaagaccataggaacaagctaacgactgcatgaagacagcccaagacctgaggaccatggaagataaggagctggagctatgtgtttgtcacacttcaatctgcatggaggcttttcataatttttctagatattttctttcatcttttttgatttatgctttgctttgttgacagacagcttgttaccttgactagagtacctataagcaatgatttcttagagccagatagaaccggcttatgagaatcaattgctaaattgtcaggaatcttgccagatagttgtgaaaccactggtgacttgaaatcagtctacaggaacatgcacacaatggaaatcagaaaacatagttttatttgtccttacaatgtgtgtctggaaaatgttactgccagtgttctatgttctaaagttatttgaagtaatcatttcccctgtgtgattaggttttatattcaggtctgttcatttgtttctgtttgtgttcaattgtttctgtttgtgtttaatttgattttttcccatttgacttaattttggtttttgaatatatgagtaatttacatgattgaaaagttaaaactgtataaagaaagatactccaagagttcttgctctcaccctgttccctattcccatctcacccattgttcagaagtagccatttccattttcaacaatttcttgtttattatttctttgaaaaaatacatatgcataaatatgtgtgtgcgtgtagatgtgccctagtttattcaatcagtctcctattcatgggtagttgtactggttttcaagccattcctattgcaaatagcatatctgtatagcatatcttattttgcatttgcatatcatatctgtacatcatagtttgcatttgtggaggtgtatcagctagatttctagaagagtcactgaatcaaagagtagatgaacatgtaattttgttaaatattgccagatttccttccaggggagttgtgccattttgcaatcccaacagcaatgtgtggaaatacctgtttctccccaggcttaccaacagcgtatgttgtcaagcttttgtacttctgcctaagaactgtgaggtgtctgagatttttgccctccttgcaaggtggatgccttgccctggtgggcttgtgtcagagctaaagaacactgaaattaggaaacccccagtcttataaggagctactaaaaacctacctaacctttgacctggaggaaaatgttgtttttattgtcttggtcaggagaggaatctaccctctgtccttccagaatgtttgcagcacaaaagacattgagaacagaagctgtcacaagacgtatagaaacaccatgaaggattgtctctcaacactgccaatctgataagggaagaacagtatttgaatatacgctgtccagtacctcctgtgaataccaaaatccatgaatgctcaggtcctttatgtaaaatgtggtaatatttgcatataacctatgcacatactccagtatactttaaataatctctagattacttataatacctaatacaatataaatgctatgcaaatgattgatatactctattatttagggaatactaataagaaaaataagtctgtacatattcaatacaaacaatttttttttcaaatacagtcatgcacccataaggaagttttagtcaacagctgactacatatacaatggtggctataccatatagcctatgtgtgtagtaagctataccatctaggtttgtgtaagtacactctatgatgttcgcacaatggtgaaatcgcctaacaacactttttttttttttttgagatgaagtcttgctcttgcccccaggctggagtgcaatggtgtgatctcagctcactgcaacatt

SEQ ID NO: 296 - DNA, 3834 bp, Homo sapiens; identical to SEQ ID NO: 295

SEQ ID NO: 297 - DNA, 3834 bp, Homo sapiens; identical to SEQ ID NO: 295

SEQ ID NO: 298 - DNA, 3834 bp, Homo sapiens; identical to SEQ ID NO: 295

SEQ ID NO: 299 - DNA, 1210 bp, Homo sapiens
aaggcaatgaatgtttttatttgttaatccacattagcagcaacaccagaaaaatcattaaccaccccacctagcattgaaactgactccacttatcgcttcttctttttaaattataatgtaaaaatgaattgcaaaatatattttatttgaacttactgaagtcaaaatcataggaaccagatatttaaataaagtttaaatctaaagtttatattttaaacataaaatttaaatcgtttgttttgaaaagtatatccttgaaaagtattttgatatagatgggaagattttcatagactggcatctatttttccacctactgtttaatgaagtaaactgttgaatgatgtaaactgttaaatgaagtaaacagttaaaactgatgacataaaagacaagcaaagcgaaggaaacattatgaatgtattcagtaacttctgttggagattatgtgttatatatgcacaattctagttatttttcaatcaatgctttataggcataaattgaaattacctgatattaaaagtttctgaaattcactatagaaaatacacatgagcataaacaaatgaggatattctctctctcctgtgaaaaaaatgtgtgggtaatatattacattacagatagaaattgtatacttgaaataaccataaaagacttaaatagtatatggatactattttcagcaaaattgtttcatatttaaatttaaacttttagttattttttcatgtgtctaatgcaagatttctaaaattttcattttttactttttataatgttaactgaaaaggagggagtgcatttaacataaaaacagaagatgaatcctgagatttctcataaatgtcttaatgtcctagagatgtgggcacttgctccatagtaaattatggatgccacgttttacaaaatccttactgcccctttgaattgtgtccttcctccaagataagaagctatgactcaattgttcaacatggaattataatgaaaagcctttctagttctatctttccctaaatgggctctatttcttgtaattcacatgacactctttggctgtggctgtctgttaaatttcctgttttggactagtttcagcaaaccaaaacaaatagctcacagaaaaggcaatggtaactactttttttttttttttttttttttttttttttggtattttcagttagattctttc

SEQ ID NO: 300 - DNA, 1210 bp, Homo sapiens; identical to SEQ ID NO: 299

SEQ ID NO: 301 - DNA, 3520 bp, Homo sapiens
gattgctactgtaaaaatgccctgcacggaggctgtagccaattccactcaagtgaaaggatgtttgtttattcctggcctcactgaaaattaccaagctctttatctcgttttttgtctagcagaagctaagaaaagagcttattttgtgactgcatccggaccttgagttctttggctcttgtgtgagtggatggtgacaccaggccagctggggattcttcccaggctgggctcacaggctggggctgggcacacggagcagctgcgggaaaaggatctggacaccagccccccagcgtgtcaccggcaggaaggtgaggtgggaacagagtgacgtccatgcatgttcaggactaagccagtggatcacaaacatcctggagagcagtgactctgtgattccatcacaagaatatgaaggactgagaagatctccagctctgcccattgcaccttcccattgagaagcagcatggcaccctggtggcaggggctgatactcagccgggccagggtgctctcctgttaaccataaccaagctcacaggacatgggatgagcccactgtgtgacacagggagcgggacacagtctgttaagtcttgcacagccatgctctgccacgcaggcaggcctttccttggcctccctctccctgttcgtgctcatgtgaacatccacctacgtggatagactgggctttggttcattattgctctgtgaattcctcgaacttccgcatctgcccaacctcccccaccccattgttttcattgtgtttcaccaaatggaaattctagagtaagcatgtgagtcctctcccaaacttgttcactgttgagagtgctaaaatgctaaccccagatgctaactgaggggtagggttaccttatctttagagcactgcgaattgtatgttaagtggaacttaatgaaaaaatagttaattgaccaacatgaatatcccctgaacagaatctcccctgaacagaatcctacaatgaaactaagggagataaataaagctgtttacctgaaagctctctctaatcaagatcctttgaaatttataaaacatggtcaatatttgcactggactttgtaaaaataaagcttgataagagaagagtttgaagtgaaatgctgccactttctatgcaatatttgatttaaatttaattcctagaaacctcagatgaatgtggttcatgtatcaaagcactcagcattatttatcgcggccttaaatacacagtgagcttacatgtgaatgaatacatatattatgtatctctctctatatatatactatatagataatatagtatatatatatatatagtgtatatatacactatatatatcgtgtatacatatactatctatatagtatatatgtatatggtatatatatctatctatagatagatagatagatatacttaaaaaaaccccattcccttaagagcagttaagggacaccatatatcaaatttcttggcacgttgtgaatattaatatccccaaagtgtcaatgtcaaatgatttgacttgaaatcactaagcttggtaatctcactatttttaaacaaggcctaacatcttttaatcttgaataccagcaagttctcagacttcagttgtttattttctcttttctttcctttaaaaaattctgacaagctcttttccttgacacaaagaaagcgtataaattttattttggtttgaacaacagaaatttgcctctcagaattctggagattggaaagtctaaggactaagctgctggccaatttagttcttagtgaggactctcttcctggcttgtagatggctgccttctcactgcatcctcagagagagagagagagagggctcttgtgtctcttcctttctcataaagcgtcagctctcttgtattagggtcccacccataattacccccttatatgccccatctacaaatagagtcacattgtgggttagagcttggcagtgaataattatggaggttattgttggctttagaatttcgtggtagaaacaataaattgcctttgtgtttacgttttattttatttttttaacattaacatgtatttgcaacaatgaaaacagcaggtgaatacattctgggtaggggaaaaagttagaggagtgctatccagaagttatatttcctaggaatatggggaataaaacattcaatattggtggttctaatagatgaattaaatttaatttgatgtggagtggccatgtcccctgtctcgggatgccgtgtgaagcctggctcttgtgacagctgtttagatttgctgaaagatgttttaagtgtcctaggaaagaggtttccattcattctagaactgatagttttctcttaaagtgttaatttacattttaatgttgatgtggtatccatctcaggttaatgtttggcactaggtaattgaatttttaaaaatctcattttattttctgtctgcttttgggagagagaagtggttaggtttttattacaggaaggatttttctctttctctattataatacctgaaagcaaatatatataagctatacatgaagtcattacaattcttttttctcattttattttcacttttgggaaagattgctgccaatatttgtgagatctcttttcagttctatcttttacttctgcatgtccgttatcttagccatgcaatgtttagtttgaggcagtttcacccaagggacataccttagaatagactctcatggccagtaatgaatgactgatggagggaacagcagtttataggttttttgttgtttttaaggagaaaaattaacacccttcatcaaacctcctctttcttccttctctcctcccctccatctcaccctgcctccccttgggatcttactcctgtgattagtttgggttccacacaaagaaagatttattactttaatgtctttgtgatttagttttatgtgatcttcctagggacaccagggagtacacgctcccctttctgaatatgttgtaagctcctttgaggcaaaaatgaatgttcctgtgttacaagaacagagcagcccttatcatcttctcgaatcttatctttctgagttaaacatttggcatcagtgacgaagtaagaccagacattgaggatgagacgtcaaatccaaatagaatcttcaactcggaggcaccagtctctctcacttgaggaaagaatgcgaaggaaggaatggcctgacttcctcatgtgtgccctgtttctcggtaggcaccatgtgggggctgccacacatgtgccgaagctttgggaacgttccgtttaaataccaatttcgatgccaatgcctaacatggagcacaaatatccagaggtagaagctgagaacaaggatgaaggaagaatcaatgatgattgggagatactgagcctgagtgaaggaggagatggaaattatcactggcaggagccgggagtgatgtgaggggttgatgagtgaa

SEQ ID NO: 302 - DNA, 6343 bp, Homo sapiens
tgctgggattacaggcatgagccaccgtgcccggccactttctttctttctttttttttttttttaaaaaaacaaaacaactttgggttttatttaaaatgcccgtggaggtggttagcgccccattcttctgctgtagttatttcaccccgggagggtgtgggccttagccatgtggccgtgatggtcgtatctgaagtgtgaatacttccccgcgctatcttctaacctgcgctgtctcagcttagtgtgaacgtacggaccgttctcaaatcctggtgaagtcactggcagttttttcctgcacacagagtagctgtgctgtttttgagctgagggcagtgtcatgctgggctgcatctggcacatggagaggacgggccagtcgagcaggtggcctcctggccgctcacagactctgcgcccgccagactgtgagaggggttcaggcacgacacttccggagctgtcatctggaggagattctcatcattttttccaccacttaaaataaaaccactcaatgccttctccagtgtactctctggtctatttaaaaatagcagcgcaagtcccaccacttcttatttataaagggaacagccagtgaacatatttttacctcccgtgtctgtcatcatgttcttgccactcattgcctccaattccaaataggtaaagagtgagggccgtgccgctgtgcctggagtggcaggggcagccacacagacctgggggtccctgagctcccccagctccagggaggacgccccaggcatgagcaggggccgccaacaggacaaagaggccactctgtcagcctctgctggacccctgagctcccctctcatgggcctctccgtttgggtggctccgagaggccaactccagccccaactgcaggctcccaggactgcaggggcagggactctggaggtccgtgtgcttcgtgagagaggggaccctgtcctcctagcaggggtccagcggcaccacagcaagacttctgtggccaagtacacgccatgctcagctctgcccccacccgcacccccggaccatcctgtgtgcagctgggctgccccgggacccacacgcgcgaggggcacccggtgctcaggagcctccacacacagcagctcgcacttagaacccacacgccaagcagaaacccctcgaagcgggctgggagcacggacccctgatttatagaggaggccccgggggccctgtcgggggagctgtggggaccggccccccagagctcagcacagcccggccctccttccagacaccagcactcgcatgtcccagcaggtgagggtgggtcaaacctgctggatctgaagttaattgttcgactggaaggaaacctgtgcgctccccggagcatgacgccacgccgcctccttggcgctgcagagccaaagccactggcgtctgccgggatggaccttccctggaaggagagacctcagccccgcgtgggtaggacgcgcctgctgaacgccctctcagggccgacactggaaaacaccttcctctaaaggaacatccgagtcagaaaacaggtgctcgcagcaggcaccaaagcgcctttgcgaacgcttagggctgtttcaggaaaccgctcagtagcaaaggcagaagatgccaagacaccttcaaaaagcaggaattaactttccacagggagggcaccaccaaaaacaagggtgcggggctgtagggcgacaggctgcatcggttcacgctgaaaatccagctgctccggggccactcaggcagccgtgtggcctcacgggtccgggtttcagaggccaccgagtggcctgggacgatggatcgcgacacggaggtgcatggctccatcatggggaagaatgtgctttaaaataggtgcatggaggaagagcctaaaaaatagtccagagtagcaacaaaaaccatctcgaggcaatgtgaccacaggtggctttgatttccttcttgtgcctctagacagcattcaaatattccagcctgaacatgcattacctcagtacctgaacagggccggagtcgtgggccgtctcgggccagggcaggaaacacttctatgctgttcgggaggacggaggacagacagcgaggctctcaggtcaccggcaccagtggcaccacccacagggactgcagggaagggcgggcaggctcccgttcgttctcccagcacccagtttccagacgaagcctccctgggatcctggcttcccacggctctgcactgtccctttctcagaacttaacgtgggcatttcctgaggcctcttcctccggatgagctggtttcggcctgggatcccagcgtccccacaccctctggtgaccaccacatggcccagcagccacacagcacccggcacccacctgggcgtctgaggctggaggaagctctgccctttctttcgagtcatgggggtggggcggtgtgcatcactttgggcccatggatggtgggtgccatgcggccacgtcagagcagggcatggtggggtgtgggcagggagcagtgggaggtggccctgtgagagctggggaggtgtcccaaagtgccagcatcctgcagatcgaaggggacgcacacaccgtgccactgcgggaggtgtgagctccacgctgcaggctgtgtgagagaggggtgagccggcgcccccgagtgaagacacaaagaatcccgagggcctggtgaggccacaggcccgcacctcccacccccatggcctcgtggctctgtggggtgacaggaacccgacccacatgtagctcaatcctcccaaggtcagcttgtgaagaagggaaagaaaattatggaaacaggcgtctctgtaggggatgctccaagacgcatttggaggcaggaaaatgcctgaagtccctcaatgggcggatgtcacagtgctgggcgagccacggtgtgtactcggggcctcactttgggagctcagacgtgtcgctggccctgacgctcattggtctgaaggacaaatcgaaggccctctggtcacggaagctctgggctttgtacttggccaggtgcctggacctcccgcgacgctcgggctccgatgcctccatcctgtcctgcagggccctctcagccccagggtggtctggggacccctcctgggccggggcctggggagtcccgcagcccccagcctcaggcttgggctcagttgggctctttcccagccccaggggagaggtggcaatgctcttgcccctgagggggcggcttcctgggggtgggtacccggcgctgggctcccccaggccactgccccctgactgtccaccatccctgggggctgggcttctggaccccccactcctgccagcagcatccactccctcagctatgccactaatgggctgctcccaggcccgaggcgccatcccacttgtcaaggcctgttcccgaccctgttcccaagcccgttcctgagcccctttctgggtctgcctctgagtctctatctgggtctgctcccagccctgatcccgagcccgatcccgagcccattcctgagcccctttctgggcctgaccctgagcctctatgtgggtctgctcccgaccctgttcctgagcccgttcctgagcccctttctgggcctgttcccgagcccgttcctgagcccctttctgggcctgttcccgagcccgttcctgagcccctttctgggcctgttcccgagcccgctcctgagcccctttctgggcctgttcccgagcccgttcctgagcccctttctgggcctgttcccgagcccgttcctgagcccctttctgggcctgttcccgagcccgttcctgagcccccttctgggcctgaccctgagcctctatctgggtctgctcctgagcctgttcctgggcccgttcctgagcccctttctgggcctgaccctgaacccgttcctgagcccctttctgggtctgttcctgagcccatttctgggcctttatctgggtctgccactgggcctgtccctgagcctcttcctgggcccatttctgaacctctccttgaacctgtttctgggcctgtccctgaatctgcccctgagcccatttctgggcctgtccctgaacctgtccctgggccccaccctgagctggttcctgtgcctgcccctgggcctctatctgggtctgccactgggcctgttcttgagcgtgtccctgagcctgtccctgggcccaattctgaaactgtttctgggcctgtccctgactgtgtccctgggtcccaccctgagcctgttcctgtgcctgcccctgggcctctatctgggtctgccactgggcctgttcttgagcgtgtccctgaacctgtccccggtcccattcctgaacctgtttctgggcctgtccttgggctgccgggcttcccggcccctcgggctcccctggaggcacagctgggttcctggcagccctggtgccctctccccacgccgtgctccgcccccgctcctcccagggtccctgcagatgctgctgaccttggtcactgcgctggcaggcgcccccaaccccaatggccatccctttgtccccggccagatcctgtgcccaccatgtctgaggctcttttgctgggttcagcacaaccttcgagcccgacggcgccaccctcttccccgcatccccgggctggggggtctcctcctgtgcctggtgactctgttgcctccccaggtccgcctgtgtcaggggacgctcctgggattcacctgcctgcgtcctaggctcggggacactggcccggagctttgcctgtgtgtcaccagcagtagggggcaggtgtgcctgtagatggggagggccccgctggtgggtgccacctacccaccccatgtccacctccgcgggaggcactgcgggaagcagatggtcaggctccgccccacggggaaacctgacgccctccctgccctttgcctgtgggttctcaggaggcgacggcgggaggccagggccatagctgggggactctgccacgctccttgcctgtggcctaggatgatcagaagcaggaattccagactctgtgctgaaacccaaaaggatctgtctggagtctctgtgtcagaagtgtctctgggacactgtggtcggcgcccacagcccctcttgctgctgccagacgcggagctgcccgtggcccctgcggcgaagaggcgctgagtcccgcctgcatccctgaaagcttgctcagttccactggggctcggtgaccccttctgttctcagtcacggtgggaaattctgtgtgggcattttcaaccacattctctcctccacaaatacaaggttcctcttcttccgctcctgcgtgtgcagcctcagcgcactggcctcggagcacaggcagctgttctgctcgaacttctcccgcagcttggacagcaccgagctcttgcccatgatcttcggcaagaggcccctggcggctttgggccgctccacagggggcttctcgcgtgcttctttctccttcgcctccttctcctcggcggccaagaatatcttcaggatgtttttcacggtgctcttcccggccgggtggccccagcggggcttctcgctgaggcagggctttggggccggctccttggtcttctccaggagcttgttgatggtggcacccacgaggcccccacccggcccctgcttgtccttggagatcagccggcccacctccctggtcctcttgagggtttgggcgtccacagacatgacgtcactgcaggtcttgctgctcttccggctgcagagaaaaaggaatcatcacctacttcatcatcatttttctccaagatgactctatagaacatttatcatggggcaatcccaccttttcaggggccccaaaagtctggtagggagaaaaagagattaggagccaggagctgtggcttctgggctgtctctgctgttaattcggggttggcagggatgccaaagcttttctgggtcactgtttcctgttaaatggcaggaacttctgacacacgctcctcctaagggcattgaggagttgacattgaacagtttagtgaaagcgtttggaaaaccactttgcatatgcaacatattaaaagaaaattttaacaaacatactttgcttgtacagtaggtaaaaaagcacatataaagaagtgtctattctctgtgtggactgtgtatgtctctacctttaagtatgaaagataaaattaacagcatatttaaattctgccatgatcccagggacctgggtccctacagcagagactgaagattcagcaaaccg

SEQ ID NO: 303 - DNA, 1465 bp, Homo sapiens
tctgagcctaaacgtgtaggtgagtgctttctccatctttgcacatgtgaagtgcgcctgaaccatagccccacattttctcaaacaccatcacactcatagaacagaaaggaaagggcagtttcaccagctagcccccataaaccactccctagggtcctccccagcacctgctaaatttgggaggcctgattccagggggctggataatgagctggcaaaataaacccagaagaatcgtaattgcagacaaagataaactcaggttccagcacagatagacagcccataccagtgcttttgatattagctgcagttaagcgggcaggaaaggctcccactctatggccggtggtgtggtcagctcagcgccgccacctcggcaggctccatcccaccatcaccctcccaatcaggctgatagtgtctccttatgccaagtggaaggaactgcaatcaaattctgacacgaactgcaaatcctccagggccctgggctactggttaggccagtagggctgtgtatcaaccgattaaaccaattaataactggcagcacagcacggcctccttctcaacaaattacgatgctgatccccagactcggccatccatgcccatggtctattgttcttacgctttcaaaacgcctcccctgcttcatgctttctagtcttgaggacttggcttaaatatgcttctgaattgccactccctcttgttgacaattcttctttttttttttttgggagacggagttgctcttgtcacccaggctggagtgcagtggcgccatctctgctcactgcaacctccgcctcccgggttcaagcaactctcctgcctcagcctcctgagtagctgggattacaggcatccaccatcacgcctggctaatttttgtagcagagacggggtttcaccatgttggccaggctggttttgaacttctgacctcaagtgatccgcccctctcggcctcacaaagtgctgagattacaggcgtgagccactgcacccggctgacagttctttacaccgttctccagttggggcggagtgggagacaccacggagcctacctctgcaggaggcatagcttggcagaagggagacaccagccagaggaagggtgcattttaggcaccgaactttaggtaaagcgctctgggtcaggcgtctcctccagagtggtctgtttaaagttaaaaaggtcgccttcaaaatagttgtaaaatctatacacttacccagacatacacatttttcgagacagggtcttgctctgtcgcgaaggctggaatgcagtggtgcagtcgcaagccatcttcctgcctcagcctcccgaggagctgggaccacaggcccgcaccaccacacccggctaatttcgttttctgtttgttttattttcgtttgtttgttttggaaggatggagtctgactgtgttgcccaggctagtct

SEQ ID NO: 304 - DNA, 1465 bp, Homo sapiens; identical to SEQ ID NO: 303

SEQ ID NO: 305 - DNA, 3474 bp, Homo sapiens
gaataatcagcctgcttcaataatgaatagcctcaccctttgatttattcagtatctagccgtatccttgcttaagaaacccaggggctaatcttgaaataaaccgggcatgaatttgagattgtggaatcctacattctcagaaaaatcactgaggggggttaatccataagctagttgcagtcatggtgatgccagccagacctccaggtgatccgttactgaagatagccatcagagtaagacatgcaaacctgcaccctgcaccactcctgctcatagtttccatgcctcctacttcttaaaatccctttagctagcctaaaattttgaaatagtctttgaggcgctagtccaccatctcctcaggttgctagctcttgaataaacctgcttttcctgcaccaactcttgtcttgcaagtcttgcttttgagcagtgagcagtgatcagctgacccttagtttggttacactatcactcaggaaattccaagcattttagaaggtctgtggcaggaaccaggaactaagttcaaatttattttttattataccacaggtcccaactcccatgactacctggatggtgacaaagacgaattatctcttcatccttctttctcactctaaatatacacagacatgctattaggagggaaaactttccctctaccaactttggttcagtgggtgggagcctgtgaattaactatagacaggttagcagggggaaagaaaacaagttgtattcataacttgtggaagcattcagatgaagaggcttgatgaagagctagagacagaagtttagttatcaactcataggggaaaagaaggagggagaaatgacttctataggaaaacaaatgacttttgggaaagacaaatagaagctttggataaagttttacacaattttcttggaatatctcctgtctgggtgaagtaatcctcacacggttaacaagaatcctggacaaaaatataattatgagtaagtgttaatcaggctacactttgacccacttccttgtaaccaaaactcacgaacactagctactgataatttgcattctcattgttcccatagataagatctttgacattagaatcataaggcttttgtttaagaattgtttatgcagatcctgaattccggcagaacagctgacaccaccaactttaaagagcccaactgatgaactgatcagcatgagaatactgttttttcatctctctgtcccatgacttcactctgcattcttcaaccaattagtgatctcttatttccacctactccaaatccttaaaaacaacagcctcaaactctttgaggaaatggatttgaggtttccttccatcttttggttcagcagccctgcaattaaacctctttctctgctgcaacccagtgtcttggcatattgacatgctgtgcacatcaggcaaaagacctattaccattacatgaggacccctccggagggagataatggtgggggcatttctgggaggctctgctttagtcagggtgcacgtgttgccgcaggaatcgctggtacatgccatcctggccataggagggctggaccagccccagccccagcagggtcagcagcaaaagcagaagcaatgaatgggtcctctgcagagccatcagtatcttagaggtgcctagaaaagaaagcaaggggcaggagaaataagagagaagttgctgtggccagtacaatgacacagggcagggactgactgcgtggctgccaggtttgtgtggacagagtataaaaagagagaaaagggtgaggtcaggccccgtctcctcatgatgctttcacagtatctgtcatcccggccctgtggtttggcatcatagtgctgggtcaggaagtgtgtgtacctggagttatcctgagccagggtcggtggggtcagacccagacccagcacgaagaccaacaacaaaacgcccaggcccatcaccatctcttccaacacaggctcctgcggagggcaaaaggaggtctataagcatgaacttattcaataacggaagtaacaggtaaagaaggaaaagcacacgtggcaagaagaaccacgtctccaggaagaggcaacactactgattgaaggacagtggggacaaagtcctgctgacatgcctgtatttccaaacaaagacaaaaattaaacatttgcttttcaaccaactctgggctttgtgcccactcactctttgttcccattccctctttcccaagtatttcatggcattcttccgggaataactgtttacagagaattacagagaatctgcttaaatacagattcaataaaaactcctaaagaaaggtttcactgaccttcattggtccacttttttatccagctactttaatttgagtcacagtgaccaatgcttccaacaataacttgacaaacctcttactcttgcctgcttataacctgattatctgttttcaacaatagctaaagccattcctcttttcctggaatgattttttccatcctctctgccaaacgatagttcatctccacattactagagtgcctcatgtcctgttactaacatcgtaccactccatggagtcatagaacaagagtgggaggggcctctgagactctgtccacccctcatattaaagaagagccaactgaggaacagagaaagagacatgtattgcccaaggaactcattgcattcgccggcctggaagctttccaatgcaccacacaattttttttttttttttttttaagacggagtcttgctctgtcacccaggctagagtgcagtgacgcaatctctgttcactgtaacctccgcctcccaggttcaagagagtctcctgtctcagcctcccgagtagctggggttacaggtgctcaccaccgtgcccggctaatttttgtatttttagtagagacgaggtttcaccatcttggccaggctggtctcgaactcctgatcttgtgatgcacccacctcggcctcccaaagtgctgggattacaggcatgagccaccgtgccgggcccacacaacttttatattccatactagtactttctagacaatcagagctaactttaaaggggccactgaaagttgctgttcgaaggaaacctacattgactattaccataaattcaaaaattattttactctgcttgtcatcagtaaaagaattgcttgaattgaagcgtatgtaataaacctatcctcttgcaaaacttgttagtggctctgtggttaagtaagtcttgaatacctgaggctgcttctgggaaggtggtcctgtgccacagataatgatgtcccttgggtttctactgattacattatgacttgattataagatttttactgtcacgagggagggtcttggctcatctgagatttccctagccccctgagtggtgctgaaattgttttaataaagatgttgcgc

SEQ ID NO: 306 - DNA, 3474 bp, Homo sapiens; identical to SEQ ID NO: 305

SEQ ID NO: 307 - DNA, 3474 bp, Homo sapiens; identical to SEQ ID NO: 305

SEQ ID NO: 308 - DNA, 3474 bp, Homo sapiens; identical to SEQ ID NO: 305

SEQ ID NO: 309 - DNA, 322 bp, Homo sapiens
ccgcccacagctgtgtccggaagcagcaagcgtgcctgggcagagacccccagagtgtaaagaggtcctgggacaggctttgcacgttccacaagagtgtctcgctgtgtcgtctagactggagtgcagtggtgtgatcatggctcaactcctaggctcaagcgatcctcctgcctcagcctccggagtagctgctgggactgcaggaacgtgccaccatgcctggctcaaacacaaagttttttcataaaactcacttggcggcaaaattctaccttacctgaagttatttacggggtttttaatttccactttgaataaa

SEQ ID NO: 310 - DNA, 650 bp, Homo sapiens
ggtcaccgtaagtagaataggtgaaagactcccgtgccttataaggcctgtgggtgacttcttctcaacgtgctcgcttcggcagcacatatactaaaattggaacgatacagagaagattagcatggcccctgcgcaaggatgacacgcaaattcgtgaagcgttccatattttgcgcagtctgtcaagatcatttcagtatctgctaattagtactaaggaaacagtgtgaatctaagcgaaaacgtgtggcacccaatgacgaaacagtggttttcattacaaaaaatttgtgaaatctatgaagtgggaacgaagcagagtcacccgaggaatgttgtgtgcgaatagatcgttaatacgcattttggaaatggaaaaaggtcaccttgtgccttcttcattgaacttttcattctgaaatagacttacggtcttgtctcaccaaacaacacaaactccagagccccagcttgtttggcttttgttcagtagaagaccaactggcatatgaattgttcaataaatccttactaaatctttcctaacctaataaatctctactaaaggaaggaaacattagcgctcatttcttgcgcctactttgtgccattctccatcatcttagacctgagtgcttacacccttt

SEQ ID NO: 311 - DNA, 8927 bp, Homo sapiens
aaaagaaggaaaaattagtttgaatctcaaaaaaaaactgtcaggcctctgagcccaagccaagccatcgcatcccctgtgacttgcacgtatacgcccagatggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggcccatcctggctcaaaaagcacccccactgagcaccttgcgacccccactcctgcctgccagagaacaaacccctttgactgtaattttcctttacctacccaaatcctataaaacggccccacccttatctcccttcactgacacttttcggactcagcctgcctgcacccaggtgattaaaagctttattgctcacacaaagcctgtttggtggtctcttcacatggatgcgcatgaaatttggtgcggtgactcggatcgggggacctcccttgggagatcaatcccctgtcctcctgttctttgctccgtgagaaagagccacctacgacctcaggtcctcagaccaaccaggccaagaaacatctcaccaatttcaaatccgccactcccagagcccctggaactctggcccaaggctctctgactgactccttcccagatcttctcggcttagcggctgaagactgacactgctcaatcaccttggaagccccctagaccatcacggacgccgagcttcaggtaactctcacagtggaaagtaagcccatccccttcttaatcaatacagaggctccccactccacattaccttcttttcaagggcctgtttcccttgcctccataactgttgtaggtattgacgaccaggcttctaaacctcttaaaactccccaactctggtgccaacttagacaatactcttttaagcactcctttttagttatccccacctgcccagttcccttattaggctgagacactttaactaaattatctgcttccctgattattcctggactacagctatatctcattgccgcccttcttcccaatccaaagcctcctttgcgtcctcctcttgtatccccccaccttaacccacaagtataagatacctctactccctccttggcgacccatcatgcaccccttaccatctcattaaaacctaatcacccttaccccactcaatgccaatatcccatcccacagcacactttaaaaagattaaagcctgttatcactcacctgctacagcatggccttttaaagcctataaactctccttacaattcccccattttacctgtcctaaaaccagacaagccttacaagttagttcaggatctgcgccttatcaaccaaattgttttgcctatccaccccgtggtgccaaacccatatactctcctatcctcaatacctgcctctacaacccattattctgttctagatctcaaacatgctttctttactattcctttgcacccttaatcccagcctctcttcactttcacttggcctgaccctgacacccatcaagctcagcaaattacctaggctgtactgccgcaaagcttcacagacagcccccattacttcaatcaagcccaaatttcttcctcatctgttacctatctcggcataattctcataaaaaaacacgtgctctccctgccaatcgtgtccgactgatctctcaaaccccaacaccttctacaaaacaactcctttccttcctaggcatggttagtgcggtcagaattcttacagaagagccaggaccgcaccctgtagcctttctgtccaaacaacttgaccttactgttttagcctagccctcatgtctgcgtgcagcagctgccgctgctttaatacttttagaggccctcaaaatcacaaagtatgctcaactcactctctacagttctcataacttccaaaatctatcttcttcctcatacctgacgcatatactttctgcttcccggctccttcagctatactcactctttattgagtctcccacaattaccgttgttcctggcctggacttcaatccggcctcccacattattcctgataccacacctgacccccatgactgtatctctctgatccacctgacattcacaccatttccccaaatttccttctttcctgttcctcaccctgatcacgctggatttattgatggcctaatcgccacaaaccagcaaaggcaggttatgctatagtacaagccactagcccgcctcttagaacctctcatttcctttccatcgtggaattctatcctcaaggaaataacttctcagtgttccatctgctattctactcctcagggattattcaggccccctcccttccctacacatcaagcttgaggatttgccccacccaggactggcaaattagctttactcaacatgccctgagtcagataactaaaatacctcttagtctaggtagatactttcactggataggtagaggcctttcctacagggtctgagaaggccaccgcagtcatttcttcccttctgtcagacataattcctcagtttagccttcccacctcaatacagtctgataacagacgagcctttattagtcaaatgagccaagcagtttttcaggctcttggtattcagtgaaacctttatatcccttacggtcctccgtcttcaagaaaagtagaatggactaaaggtcttttaaaaacacacctcaccaagctcagccaccaacttaaaaaggactggacaatacttttaccactttcccttctcagaatccaggcctgtcctcggaatgctacagggtacagcccatttaagctcctgtatagacactcctttttattaggccccagtctcattccagacaccagaccaacttagactgtgcccccaaaaaacttgtcatccctgctatcttctgtctagtcatactcctattcaccgttctcaactactcatacatgccctgctcttgtttacactgccggtttacactgtttttccaagccatcacagctgatatctcctggtgttatccccaaactgccactcttaactcttgaaataaataaataatctttgctggcaggactatgccgaatctccttaggcactctctaatcagatatcctgagtcgtcccaattcttagaccttttatacctgtttttctccttctgttattccatttagtttcccaattcatccaaaaccgtatccaggccatcaccaatcattctatatgacaaatgtttcttataacatccccacaatatcaccccttaccacaatacctcccttcaccttaatctctcccactctaggttcccacgccgcccctaatcccgcttgaagcagccctgagaaacatcgcccattctctctccataccacccccccaaaaatttttgccgccccaacacttcaatgctattttgttttatttttcttattaatataagaaggcaggaatgtcaggcctctgagcccaagccaagccatcgcatcccctgtgacttgcacgtatacgtccagatggcctgaagtaattgaagaatcacaaaagaagtgaatatgccctgccccaccttaactgatgacattccaccacaaaagaagtgtaaatggctggtccttgccttaagtgatgacattaccttgtgaaagtccttttcctggctcatcctggctcaaaaagcacccccactgagcaccttgcgaccgccactcctgcccgccagagaacaaacccccattgactataattttcctttacctacccaaatcctataaaatggccccacccttatctcccttcgctgactctcttttcggactcagcctgcctgcacccaggtgattaacagctttattgctcacacaaagcctgtttggtggtctcttcacacggacgcgcattaaaaaaacatccttacataatatgttaaaggatgctatacaatatggggaaaatgatataagtatatgacccaagaggatgaaaaaattcacttattggcagaaaggacaacatcatttgtatgtagaaaatcacctctcaaaatagtaagttgctgaaaggggagtggttgcgctagaatcagcaccaatgactcttttatcctatttctcagttttaggggaaaagactctacaaaactacaggtgttttgctgacagtagaaaaaaaccttcccttgttaacatgttagtcaagctttggaaaagacatcacatgtcaaatcctatcacaggatgctttatagagattatctattttaaattttattggaatttcgatgacatcaagttgttattgcttggaccacagtggtggtggttatctgaagatttctgcaaaagtgccatgcctcctcaaataaggggagagggaaaatcatttggggacagccaacttcttccttgagcggtgcagttataatcatgcattgtgccctctgtgagtgcttctttctcctttgaaattcttcagtgggttcttcagcatcgcccactctgttgctggagaccacccattgtgcccttggatggcgtgcccaatatccttggccagctggctgcattccccactcagctactgattgttgattgttgtgcttcacgaacttcccgctgagcgtcctctcatcctggggtggagagcaggcccatcacggggctcccacctgcctgcctgccatactgtccatgccagtgcctgagaaacaccgcctctgctccactttcagtgggaaccagcgttttgcacccccctccatagccttttctcttcactctaccacctgaagcaattcccactgggccgcttcttcacctttaagttttccaggtaagaatcagacatcagtctctgtgtcttgtcaaatgttcagggatactaccaagctctttaagtggtcttatagaagcctccacagtttacagatggggtaagcacccactttccatcttttgtgggaagaaaaatgcacagcactctgagaactgtctctaaggaattaatcactatcaacttcctttctactctcatatatggaggtaggcaatgggctaagggggtggactagcacctctctttagaaagtggatacatttcccaattgcagtcatcaggttgggagcctggggcctcactggaaattgagacaaaataaaagttaagttcaacttagactgtgcatatgtaacattcaaacatttgggttatttgagtcagtgagttcagtgattagtatgaatccttaccatgtggtagactagattgacttcagtatgacgtagataggtgtgattaataacttagagttattttagctgagggtgtgtcatgtaccaaaaactggtgaatggaacatagttcacagtgttggaattatgggactcaactggataggcaggaggaaaaagaaagggtaagtatcatacacatagaaactgtcagtattttttagactgcagaagtgaatgtcagacctactgtattaagctcttaagcaagggacaaaactggatttttcaagtctggggctaattcaaaaacagtgttacattgtaacccatacctcagaaattattttataatagctaaatatttacatagtgcttactatatgccagacactgttttaaacacttttaatgtatttaatccttttaacaattttacaagatagatgcactgttacttccttttacaaatgaggaaaatgaagcacagagggatcaaacaaccagcacaaggttaaagtcatggaaaatatgagatgtaagccctgatgtttggtattagactacactttgctttcacaaacattatcttgtgatttatgtcacaaataaatcacattatatagcaatgataaagcaattccaaaagataggcatatcagactcaagcatactcaatgaatcacttagctatgggatgataggggctgcctagaaaataatagactgttgtagctcctgttccagttccttctaccaccttctgacgggtatgttttgtttgccatttaacttacatcacaacatgttaatttcaagaataaatttattagtgtttttctaaaagtaaaaataattgaggagaaaataaatcagcaaatgttatattaaatagaacagacacttacggcctggagtcttttcatttttaaggtataaaaagcttttattgcttttatcttacttaaaaagcaatgcgtgcttatgactgaagaattagaaaatctctgcaaaagggagaagaaagcattcacaacccaactacctgatgataaccactgttaatatcttagtaactgtcctttcaagcctatgcatatatatgttcatttaatgtgtgtgtgtgtatttacatcattatttatataacatttttatttttgactgggggaagagcaaaattttattttggaatgaaaaaggccaacggggtagtcagaaaagaataaagtgagtggtgtggcatcctctctccatcttcttggtggcttgggttatacatctgtgcttcaagttcttccaaaggcccaactgttttgtttggtgtgcatgtttgcttaccttgaaagttatcaatcaagctcagagtccgttaaataaaatatagcctatcatctatcttcattatgacctggaaagacagagtccaatttagactcctagccctcttcacaagctctaccctggaacttgcccccaccagtagcctgtcctacttcaacttccattcctggctttgtcctgcccagtgaataggctcatgtacattaggacagatacctgaacccctatggccaagctcattactcatctgccacatcctctcctagtcacctctgagcctcttcttggccatgtatttggctcacacttccctggaagtgggtttggagcctctgggcagggagtcatggagtctagaagattgtgatctagcgtatgggctagatgtggcttgcgggctcagactgggcacttgttggctgcaggaactccttcccttgccgggaaggatgtggctagaagcgggaaagaacaggatcttcatgtattctctatatgaggtgctgatcaaaataaataattatttacacctagagatgttctctaaattatgactgtagaaagtaggtaagtaagttaaaattgggaatgtgtagctttagcatgccaacacctacatctgcagaatccccatggtttatgtgcgctgttgcctttgactggaacaaccttcatcagacatgtgcccttttactttcaccttattcataactgctcaaacatcttctttccttccctttccatctaatctataccaagtgcacccacccctccagcactctgtatcctctcacccccacttatcttcttagaacttatcacgaaatgaaattacagtacctgtacttgtttactgtctttctgccctactagaattccacagaaaattaatctaatttgtcattatatctattgtgcctagaacagtgcctgccacccagtgggcattccctaagtatttgctaaattactaagttacaattaaaaacacacattactcatacatagtggaattctgatattaatttccacttccttttaactaagaaatggggcaaataactggaaataaatcttttctactgcagtctgaattttacttccataaaataaaacacatacaaataattttttaaaattaggatataatatcagaaaccactgcattggctaatggcataagcagcgaaatcttggctcaaccaaacagtcaacaaagaaggagtgtaggccaggtgtccccacctaggctatgctatcttcttacttccttcttctggcaggaaaggagatgtcaggctgtaggaaagtagtagcacgggctacttcctcaaggactaagtaaagtagcattccatgctgtgggcaaaaggagacaggggcagggccaggtgctggtgaggagaggcagtccactctcaagaggggacagtgaggtgaggatccaggacctctttccggaccactcctggtagttctgagttccagtctgacagctcacagacacagccccccattttgcctccagcaggagaagacaaggagatggagagactgtcaacctagaaccagtaatgaccagttccaacttaattacagaaagggagaaaagatcaatcatttaagttgcttcatcgtctaaataaaagtgttttggctgttgaaacatgaacctagactcctgcctcaacatatttaaaatgagaacaaagtggcagtatcatggtggtgggcgtttagatgcttacattgttttcatctacaaaacaggctttcctttcacaccctagctctttgctgggctggtggagctgattgacagatatagcccgctccaaaggaacagccctttctcaaggaatgaatgatttgctctaagtatttaaatcctctgctcaaaatcaaacataaattgaagtatcaaaataaacaaaaatatggtttgtggttttgaaagcatttctttgtgatttttgctaaaaagagaaatgccaaaaaaatttttttaaagattttgagacaattatctggcgcagtggctcacgcctgtaatcccagcactttgggaggctgaggcaggcagatcatgaggtcaggagatcaagaccatcctggccaacatgttgaaaccccatctctactaaaaatataaaaattagctgggcatgatgggcgcctgtaatcccagctactcaggaggcagaggcaagataatcacttgaatccaggaggtgggggttgcaatgagccaagatcatgccactgcactccaacctgggc

SEQ ID NO: 312 - DNA, 835 bp, Homo sapiens
caggcacataccatcatgcccaggagaattccatgcatggagattcaaataaagacaaaagggagatgcaactatggaggctgagaagtcccaccatcggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtgggggggggtcagccccccgcccggccagccgccccatccgggagggaggtggggggtcagcccccccgcccggccagccgtgccatccgggagggaggtgggggggtcagccccccgcctggccagccgtgccgtccgggagggaggtgggggggtcagccccccgtccggccagccgccccgtccgggaggtgaggggcgcctctgcccggccgcccctactgggaagtgaggagcccctcagcccggccagccaccccgtccgggagggagatgggggggtcagcccccccacccggccagccgccccgtccgggagggaggtaggggggtcagccccccgcctggccagccgccccgtccgggagggaggtgggggggtcagccctccgcccggccagccgccccgtctgggaggtgaggggcgcctctgcccagccgcccctactgggaagtgagg

SEQ ID NO: 313 - DNA, 835 bp, Homo sapiens; identical to SEQ ID NO: 312

SEQ ID NO: 314 - DNA, 1250 bp, Homo sapiens
attcagcccatctgcacccaggtgaaataaacagctttattgatcacacaaagcctgtttggtagtctcttcacacggacgtgcatgaaaaatatatcaaaagagtattcgcattcctgtgtttattgcagcattattcaaaatagcaagacgtggaacaacctgagtgttcattgacagatgaatgcatcaagaaaatatggaagttcaagctgctagatggacaggtcaaatgaagaaacagatgcctgaccactactaagctgtaactgatactgcagttgagatacaagatgtgaatctaaaagaaatcacctcggatgtctagccctgtcctcaaataatttcagctcggctgtctcatgactacaaccatacaagaaaccccaacagccaacatatggaaacaacctaaatgtctgtcgacaggtgaatgaataaagaaaatgtggtatatacatacagcagaatattgttcagtcttaaaaaagaaggaaaccttacaatatgcagcatcatgaatgaacatggaggacattatgctaaatgaaataagccagtcacagaaggaacagacactgcctgattccaatcgtaggagataactagtattgtcaaatttataaaattgacaagagaatggtagttgctagtgggtgagcagaggggaagatgaggagttattgttgaatgtgtataaagttttaattatgcaagatgagtaagttctagcgatctattgtacaaccttgtgcctatagttaacaatgatgtattgtggatgtaaaaatttgttaaagaggatacatctcatattgttttcttaccacagtaaaaaaaaaaagaaacaaataaacaagaatgtatatagtactgaaaactgtatgtctgatgattaaaaattaagaatatcctcaataccacataatttacacaatagatacaaaaggtgttggcaacaaagcatgtctgtcaacttggcttaaattttaatcataatctctcaaagtcttgagagaaggctatgttttgttcgtgtcattgttattgttgttgtttgactctaaagaataaatgagatcttggtaaatttttgttatatgcaatacgtatctaaggaactacaaaaatcaacttctattactcttgcctaattctttcttagtacatgattagatctgtgtagtacttcattgatcgtctgctgtgtaggcagcataggctcaatgtttattgaatgcagatttacg

SEQ ID NO: 315 - DNA, 15089 bp, Homo sapiens
attgtgacccccactcctgcccgccagacaacaaccccgtttgactgtaattttcgtttacctacccaaatcttataaaacagccccacccctatctcccttcactgactctcttttcagactcagcccacctgcacccaggtgaaataaacagctttattgctcacacaaagcctgtttggtggtctcttcacacggacgcgcatgaaatttggtaccgtgacttggatcgggggacctcccttgggagatcaatacccagtcctcctgctctttgctctgtgagaaagatccccctacgacctcaggtcctcagaccaaccagcccaagaaacatctcgccaatttcaaatccggtaagtggcctctttttactctgttctccaacctccctcactatgcctcagcctctttctcctttcaatcttggcaccacacttcaatctctcccttcttttaatttcaattccctttattttctggtagagacaaaggagacatgttttatctgtggacccaaaactccggccccggtcatggactgcaaaggcagccttcccttggtgtttaatcattgcagggacccctctgattattcacccaggtttcagaggtgtcagaccacgcagggatgcctgccttcgtcattcagccttagcggcaagtcctgcttttctggggtagggtcaagtaccccaacaccttctctccatgtctctaccccttctctgcctttctgaggggcaagaaaccacaaaccccttctccttcaccctgagcggcaagtcccgcttttctgggggagggacaagtaccccaacctcctatctctgtgccctgatcccttatttccactccccgacatcttatatctctgagccccgatctcctatttccacagcccaacctcttatatctctgcgccccgatcccgtttctgcgccccgacctcttatatctctgcaccctgatcccttatttctgcaccccaacctcttatatctctgcaccccgatcccttatttccgtgccccatcttatatctctgcaccccatcccttatttctgctccccaacctcttatatctctgcaccctgatcccttatttccacacctcaacctcgtatctctgcgccccgaccccttctctgcttttctggagggcaagaaccccccaccccttctccatgtctctactctcttttctctgggcttgcctccttcactatgagcaagcttccaccttccattcctccttcttctccctagcctgtgttctaagaacttaaaaacctcttcaactctcacctgatctaaaatctaagcatcttattttcttctgcaatgccacttgactccaatacaaactggacagtagttccaaatagctggaaaacggcactttcaatttttccatcctgcaagatctaaataattcttgtcataaaataggcaaatggtctgaggtgcctgacatccaggcattcttttacacatcggtccctctctagtctctcttcccaaggcaactcatcccaaatcctccttctttccctcccgcctgtcccctcagtcccaaccccaagtgtcactgagtctttctaatcttccttttctacagatccatctgacgtctcccctcctccccaggctgcttcttgccaggccaagctaggtcccaattcttcctcagcctcggctcctccaccctataatccttttatcacctcccctcctcacacctggtctggtttacagtttcattccatgactaaccctcccccacttgcccagcaatttacccttaaaaagctggctggagctaaaggcataatcaaggttaatgttcctttttctttatcccaaatcagatagcgtttaggctctttttcatcaaatataaaaatccagcccagttcatgactcgtttgacagcaaccctgagacgctttacagccctagaccctaaaaggtcaaaaggccgtcttattcacaaaatacaatttattacccaatctgctcccgacattaaataaaacaaaaattaaattccggccctcaaaccccagaacaggatttaattaaccttgccttcaaggtgtacaataatagaaaaaagttgcaattccttgcctccactgtgagacaaaccccagccacatctccagcacacaagaacttccaaacgcctgaaccgcagcagccaggcattcctccagaacctccccccccaggagcttgctacaagtgccagaaatctggccaccaggccaaggaatgcctgcagcctgggattcctcctaagccatgtcccatctgtgcaggaccccactggaaatcgcactgtccaactcacctggcagccagtcccagagcccctggaactctggcccaaggctctctgactccttcccagatcttcttggcttagtggctgaagactgacgctgcccaatagcctcagaagccccctagaccatcacggatgccgagcttcagataactctcacagtagaagattcagcccatctgcacccaggtgaaataaacagctttattgatcacacaaagcctgtttggtagtctcttcacacggacgtgcatgaaaaatatatcaaaagagtattcgcattcctgtgtttattgcagcattattcaaaatagcaagacgtggaacaacctgagtgttcattgacagatgaatgcatcaagaaaatatggtacatatacaccatggaatattattcagcaataaaaaataatcaaattctgtcatttgcaacaacatggttggaattacaggtcattatgttaagtgaaattatccaggaacagaaagacacatcttctcactgatatgtgagaaaaaaattaaattgaactcatagagagtagaatgattgttaccaaaactgggaagggtagtggggagaggtaaataaagtgggaattgttaatgagtgcaaaaatacaattaggtggaagaaataacatgtagcattttgtagcacaatagggttaatatagctaaatatttagtttatatttcaaaataactaaaagaaagtaattggaattttcctaatacaaaagagatgataaattgtaaggtaatagatatcccaattaccctgatttgatcattgcacattgtatacttgtaacgaaataacacatgtaccccataaatatgtacaactattatgtatattaaaaaacatctttttattgtagtggttgccctaaatcttgcaatatacttttatgaataagtcaatttccaaaactatatggcttcacgggtagtgctagtactttataataacaaagtattctgaatttctccctccactccattgtagcattgctctcattcacttcacttatgcatatgctatgataattgaatacattgtttctattgttactttttaaaaactgttatctcttagattgaaccagaatataaagaataaaagttttattttcctttacttattctttctttagcacttttcctttatgtagatctaagtttctgacctagatcctttttccttgcctttaaagagtattttcctacatttctagcaaggaaaatctactggcaataaattttctcaattgttgcttattttagaaggccaatttatccttcactctagaataacttacagactacagaattgtatgttgttcctctccgcaaccttctccacttaaaatatttcactctgctctattcttacttgcatgatttcgagtaaaagtcggatataatttttatccctgcttttctataggtaaggtgtttattcctgtttgttttctttatctttcggttgctatagtttttacataatatgcctaggtgtagatttttggcatttttttcctgcttggtattctctgagtttctgatactatctgtggtttggtaaatgacattaatttggggaattttttcaattattattcttcaaatgtttcttctctgcatgagccaaaatagctcaaatgtttcttctgtcctctttcctctatgttctccttctggtatctgtcaggcctctgggcccaagctaagccatcatatcccctgtgacctgcacgtacacatccagatggctggttcctgccttaactgatggcattccaccacaaaagaaatgaaaatggcctgttcctgccttaactgatggcattatcttgtgaaattccttctcctggctcatcttggctcaaaagctcccctactgagcaccttgtgacccctactcctgtctgccagagaacaacccccctttttcctttatgtacccaaatcttataaaacagccccacccctatctcccttcgctgactctcttcggactcggcccgcctgcacccaggtgaaataaacagccttattgctcacacaaagcctgtttggtggtctcttcacatggatgtgagtgaaatttggtgccgtgactcagatcagcggacctcccttgggaaatcaataccctgtcctcctgctctttgctctgtgagaaagatccacctacaacctctggtcctcagaccaaccagcccaaggaacatctcaccaattttaaatccggtaagcggccactttttactgtcttctccaacctctctcactatccctcaacctctttctcctttcaatcttggcgccacacttcaatctctcccttctctcaatttcaattcctttcattttctggtagagacaaagaagacacgttttatccgtggacccaatacaccggcgctggccacagactgggaaggcagccttcccttggtgtttaatcattgcaggggcatctctctgattattcacccaggtttcagaggtgccagaccaggaagggatgcctgccttggtccttcacccttagcggcaagtcccgcatttctaggggaggggcaggaaacctgacctcttatctctgtgccccaatcccatatttccatgccccgacctcttatctctgctccctgatcccttatttctgtgccccgaccccttctctgcttttctggagggcaagaaccccccaccccttctccatgtctctactctcttttctctgggcttgcctccttcactatgggcaagcttccaccttccattcctccttcttctcccttagcctgtgttcttaagaacttaaaacctcttcaactctcacctggcctaaaacctaagcgtcttattttcttctgcaatgctacttgaccccaatacaaactcgacagtagttccaaatagccggaaaatggcaatttcaatttttccatcctacaagatctaaataattcttgtcttaaaataggcaaacggtctgaggtgcctgatgtccaggcattctttcacacatcgatccttctctagtctctgttcccaatgcaactcatcccaaatcttccttctttccctcccactggtcccctcagtcccaaccccaagcatcgctgagtctttctaaatcttccttttctacagacccatctgacctctcccctcctcgccaggccgagctaggtcctaattcttcctcagcctcggctcctccaccctataaatccttttatcacctcccctcctcaaacctggtctggcttacagtttcattccatgactagcccctcccccacctgcccagcaatttactcttaaaaagctggctggagctaaaggcataatcagggttaatgctcctttttctttatcccaaatcagatagcatttaggctcttattcataaaatataaaaactcagcccagttcatggctcgtttggcagcaaccctgagatgcattacagccctagaccctaaaaggtcaaaaggccgtcttattctcaaaatacattttattacccaatctgctcccgacattaaataaaactccaaaaattaaattccagccctcaaaccccacaacaagacttaattaacctctccttcaaggtgtacaataataaaggcagccaagtagcaacatatttctgagtggaggcaattccttgcctccactgtgagacaaaccccagccacatctccagcacacaagaactttcaaacgcctaaaccgcagtggccaggcattcctccagaaacgcctcccccaggagcttgctacaagtgccagaaatctggccaccaggccaaggaatgcctgcagcctgggattcctcctaagccgtgtcccatctgtgcgggaccccactggaaatcggacgttcaactcacctggcagccactcccagagcccgtggaactctggcccaaggctctctgactgactccttccaagatcttctcagcttagcggctgaagactgacgctgcccaatcgcctcggaagccccggagaccatcacggacgccaagctttaggtaactctcacagtggagggaagttcaagctgctagatggacaggtcaaatgaagaaacagatgcctgaccactactaagctgtaactgatactgcagttgagatacaagatgtgaatctaaaagaaatcacctcggatgtctagccctgtcctcaaataatttcagctcggctgtctcatgactacaaccatacaagaaaccccaagtaaggaaagccccactgagctcaggcagcacagaaaaccaagaaagatgaaaataaatcattgatttgagccattttcagtctaccactaatagccagaaaataataatcataaaacaaacaaaaatgtgctgatgatttagtatattgcaaacatgagaaggactttgtaaacatttacttgttcaatttcccagcaatatatgacataaacatcataaattttatctttaagatatataataaatgtaagttcaggaagtcttggcaacttgctggaggacgtagaattgggctttgaattcaggtcaatctgtatctaattctgcttttaatcccttacctattaaagtttcaatagcaatgtcctttaacagaatttatatttttcaaagatatgtgaatctaaaagttcatagatggttgctgggcaaagtggttcatgcctgtaatcccaacactttggaaggccaaggcaggaagattgcttaaggccaggagtttgagaccagcctgggcaacataacaagaccttgtctctacaacaagtacaaaaaaataattagctggacatggtggtgttcacctgtagtcctagctactggggaggctgaggcaggaggatcatttgaggccaggagtatgaggttacagtgagctatgatagcactactgcactccagcctaggtgacagggtgagacactgtctcaataaaaaaataaaataatgaaagtttatggataggaaatacatttctatggtatcaggttttatatttttacttttaaagtggtgtatttttcagtcatgcagagcaggaaatgaatctgtgaacaagcaataatgtcactcacagatattatagaagcaagtgcttatataaatcacttttctaaatgttttatacgtatctcacctaattctcctaacactcctatcatcggaactattattagtcacattttagagataagcatttgaggcatagaaggatttaatacctcgcccagttagtaagtggcagagtcaggctctgaacacaggaaacccggctataaagaagctttaacttaagtagcatataccttgctgtgtaaatatattgtaatgctaatatttttaaaaaattctgactctttgaaagttgattgagaccatcaccaaatactagtattaatcttttgtaattcttgtactcacagcagccaacatatggaaacaacctaaatgtctgtcgacaggtgaatgaataaagaaaatgtggtatatacatacagcagaatattgttcagtcttaaaaaagaaggaaaccttacaatatgcagcatcatgaatgaacatggaggacattatgctaaatgaaataagccagtcacagaaggaacagacactgcctgattccaatcgtaggagataactagtattgtcaaatttataaaattgacaagagaatggtagttgctagtgggtgagcagaggggaagatgaggagttattgttgaatgtgtataaagttttaattatgcaagatgagtaagttctagcgatctattgtacaaccttgtgcctatagttaacaatgatgtattgtggatgtaaaaatttgttaaagaggatacatctcatattgttttcttaccacagtaaaaaaaaaaagaaacaaataaacaagaatgtatatagtactgaaaactgtatgtctgatgattaaaaattaagaatatcctcaataccacataatttacacaatagatacaaaaggtgttggcaacaaagcatgtctgtcaacttggcttaaattttaatcataatctctcaaagtcttgagagaaggctatgttttgttcgtgtcattgttattgttgttgtttgactctaaagaataaatgagatcttggtaaatttttgttatatgcaatacgtatctaaggaactacaaaaatcaacttctattactcttgcctaattctttcttagtacatgattagatctgtgtagtacttcattgatcgtctgctgtgtaggcagcataggctcaatgtttattgaatgcagatttacgatttgtgaaccaagagatacaatgttctttaatagtattagagtttagatttcatgtgtcctcagtgtcaacaaggacagtgacatttctccaagacttttattagtgaggtatagcatccgtgatgctcagtaaatggaaaagcagttacaatgtcaggctgaaggaaaacattgaaacccacttaggaaacttcatgtataaagacacctgactttattttctatttcaaacctgggcttgccaagtgtggatttactgtgcataaaagcagcagtttatttgaattgtgaagtactcctttaaaatgaatagttctaattgtattatacaatttagctctaaaaggctattatattagtgtgctagggctgccataacaaagtaccaaagactgggtggccttaacaacagacatttattttctcacaattctgaatgctagaaatctgagctcaaggtctaagtagggttggtttcttccatggtctctctcctggcttatatatagccttcttttctctttgtttccacctggtcaatcctctgtatgtttttgtcctaatttcctcttcttctaagttcactagtcattaaattaaggcctattcatatgaccttgtttaaccttaattacacctttagagacctatctctacatatagtcacattctgaggtactgagggtaggaagtttgttgtggcactattcagccagtaaaaactacccaccctcaactgttgctcaatcttgtctaccatagtcatctcttataagtcagatgacccacaatttaggaagctgatcctgtggtaaatcctgttctccttaaattggtgaaagcatagatgtcaaaaatagccatatagtaaaaattaagtgaaggcataaaataccttttcaaaggcttccaaaaggtaagacctttctaaatatttctaaattgatctaccctattttgcagttccaaccatgaggattaataactgctgtggaattttttataagggccagactagaatttttaaatgatacctcacataattattttatgaaaacactgtaagttattaatcaaattaggttagctgtttttcagcaaatattctattcttggacattgtgaatgaagaatgctaacctttgattggggttatagggctttacaacatccgaagcatactagtgcaaattaaacagtgtatcatcagaaatatatttgggaaaagggaaactataaaggcaaccaaaataggctgcgtaaactttgcaaacttctgtggctggctagagctgatgtactcaggatctcccaatatcctgttaatacctcagtgtctgtcttttccccctacattcaaagaatctatgcaaccccctgggggcaaacctgttctaaatcatattagcctttatcccattataattccctgtatatcctagtctaaaggaaatttaattgccttattcagtcacataaattcattttaatctgacacataatgtacaaaacatatatattgtaagataatgttcatgaaagacttatttatcaagggagaaaatataatgtatacatatggggtaatgacacaagatataaacatggtaacagcaatgaaagttaaaaaatatataggatcagaattctgaaaaaaaaaagctattaccactaattcggatatttgggaaggattgatgatggaaatggcagtggtagcgagttttgaattgtgaaataggtgtattttaattccaggccaaaaaaaaaaaaaaaaaaaaaaaacaagtagcatgaggtaaacataaagagaagagtgagacctccaggaggaaaagtaggatttgtttggctcaagtaaatggtagatgaaaggcaacagaattcagacatgggaacataatcttatgaaataactccatcctatatgtaaaggagaaagtgaaagtttcagagaaggaccgaaatatgcttcagaagaattaatgctgtaggaatacgttaaatggatttgaacaggatgtgccaacagcggagtaccatggcacaggtaagctgcatggtaggagcctcaggaataagggggaaggccctgaaaggatacaattacaaaaaaattacaaactatgaagtcaattggttatgatgatgaggcagagattttggtcctggctgactaacaagatattgcctttaataaaagcagcaagaaaggttaattttggtacgaaaaacatgagttcagttctaaatattgtagtagtcaatatttttagatgattgtcaagactcaccacccctggtgtgcaagttgtgcataatctctcagactgtgaatgtgattaattttattcttatgattagaatatgctgtgatatggcacaattgactttaagaaagggagattgtgcatttgggcctcacctaatcatagaaaccttttacatgtagggcattttgtctggctagtagcaaaagaggaagtcagaggttcaaaacatgagaaagactgaatggttcagtgctggcttgaagattagggtccacatggcaaagaattcaagtggcttctcaaagctgaaagcagcaaggaagacctagcaaagaaatggggacacttagcaaggaaacggggacttcagttctacagcctcaaagagatgacttttgctaatactaagaacaagcttggagtggatttttctctagagccttctgatgagaactcagcttggctcgtaccttggttttggtcttttgataaccagtaaagagcccactcatgcttagccagacttctggcccattgactgtgaattaataaattacttacattttaagctgctaaattcatggtaacttcaatagaaaataaatgcagatatattgccctttagttgtatggaaagcattgaagatagaatttctcaaccttggcactattgacatttttgtactggataattatttgttatggcggtctgttctgtgcattagaagatgtttagcagcattcctgacctctacccctagatgccagtagtattcaatattgtaacaaccaaaaatgtctccagacgttgtcaaatgccctcttgagagcaaaatttcctcggtagagaagcatttatcttagggtaaaaactagcggtcatttataaataggaggtgtcttagtctgtagtcaggttgctataacaaaatatcataaacatagatagcttattcacaacataaatttattatgtgcctggtgaggacccatttcttatacatagcgtcttcttgctgtctccttacatggtagaagaggcaaggcagatctctgaggcttcttctataagggcagtgaccccgatctctagagctctgtcctcatgatctaatcacctcccaaaggcccagactctgaataacatatgagtttgggggttagggggtgggggtgggaggactagaacactcagaccatagcagggcactagagatcaaggagttgtggtaaaacatttagattggaaaatcagctgggcgaagaaagttgaaggtgggaagttttaatagataagatgcaagaattttaagaaaaaagtttgaaagacatttctactcaagtatcataaaaaggagaaatgattcaggctggagataatgcaggctaagagaagaaacaagaaagaaaagccttaaacaatctaaagcataactatcagagagctgagaataaaaagtacgttgaaattggaactaagatgtcattgacagatttgttttggcagagtggcttggacagaagctcaatagaaaaggaatgaataaattttttaaaaggcaatagcttttaagaggaaatgggaaaattagtgcttttaaggtaggagcattgttagagatagaggagaaaggacatagggaaagaactgaaagaggacaaatatttattgagtatgttctcatagtatcaaaactcacctataacagttaccttcccaaaatcaaagcaaccataagctctgtctctgtttctactgttgtttatagaagcctcttgatgttctgccaactgaacatactagctttttcctgccagcctgccattgcaaagcctttgatgttggttggtttcttgccactcaacacatatgcccctatggacttgacaccttggattcttccattgaatctcaactttgctctcacctgacaattagtttttctatttacttttacttccaatgctgaagccatggtgttggatcccagcaatttatatactaaacctggtacctgctatcctagccatagcaaaaccctctgggaaaatattttgtacactgtatatagaggaaaatattttgtacactgtatatccatgctggataactacttaatttgttctcaaaatcttcttatgacatctctacactatttttagagatcataaattaacttgtccaaactcacatagatagcaagtaaaagctgaaatttgaactcagaactatctgactccactgcctatgatcagtgctcaaatttcaaatggaatatatgttttttcaacttgacagtcttccgtgaaaaagaatggtgccagagtcaatctatgacctgagatattatgtaatattttcattagtatttaatttgtgaactggagcaaaacttggttgaaattggtgttgacataatactgagttaggtgggtggtacattcttttgaagtaaaggtcagaggtcattacaaatttagcaagctataaaattagtcaaatatgattatacatctatttaatttttaatgttatcacttctttataaaataaagaattttgccaaatagttcatattgacattgtttaagagctaagaggatccatagattctgttcaaatgacccaaatacagtgtatatataactttcacaaagtaggaaataatttatattttataagtatacaaataatttaaaatataattatttttctggatgcattcataaaatatttctaaaacaaatttagaaagattttaaatatttatttttatcaaattattttaaatgagaagaagctgccatagagaataggttgtcattatttcccagaacttttaaatgcggaaagactcattttcaaactaactcatcagattacatgaaaagtgaattttattaacttcctgaggcaaggcagagcccaaacccaattctgaataggaggtctctgtagagaaaatgagagaacaaattgtattgtttatctcttagactcttaagtcttagagtgggataggtggaggaagtcttcgaattaattgatttcttaaggtgagaaatgatgtaagcaaggtgagttctgaggagaaaaaggattgttgctagggacataacacattctgccactgtatttccatagctgatgatgatattaatagttattctggtttttagagagcacagcttgttcattccattaaaaagtacggatggctatgcttcagtttgacactcactgtaaaggaagacaaaatgttggaattattttgacctacccatgaaaagaaaagcctctggtgtcctgcttcctcttcctgctataattttgctaccagaatcaagttttttgaacttgcatgaaacgttgaacatcaaaaccctgaagacaaagcatagcatgggtacaaagtacttttgaatatcagaagataataataaagaaattgtgaatgaaagacatgtttactggctattagaagggctcccttaacaattttgtttctctatgtatgtgtccttgttttcttcaaaacatctcagttgtgtttctctaacattctgaggtggagcttaatgtgcttgcattttttttatacttgttttctgcagttgttttaagtgagtagatttcctgacctcttggattcaagaatgaaaatcaattatctcctaatgaatctttatacctcacatatttctgcagtcacaaaattaattgggtttaaattaacaagttatttatttttcttcaaatactaattacatatttggtctaaggagttttgcaagatgctctgagaattcattttatggaaatttttttaaaaactgtcagtcctgaaatttcagcgtaccctgaggatgacctttatgaagtccagtagtataaagctatatttctaaaatatgatgtcttgggtgacaaatgaaactttctcttctactagatataatataaaaacttattttcattatatatgatgcaagaaaccaatatgtgcagaatatatatttaatattgtgtacatgattcatatgctgaagaacttctattttgaagaatttagtgttacttaacatacagaaactgattattttcaacgtgtgcttcaatcatat

SEQ ID NO: 316 - DNA, 15089 bp, Homo sapiens; identical to SEQ ID NO: 315

SEQ ID NO: 317 - DNA, 1255 bp, Homo sapiens
gtggaaggcagttgattatgggggtggtttccccatgctgttctcatgatagtgagtgagttctcatgagatttgacagtttataacggacatttccccgctttgcttgacacttctccattgtgctgccatatgaagaaggacgtgtttgcttccccttccaccatgatttttagtttactgagaccttcccaaccctgcagaactgaagttcaagctgctagatggacaggtcaaatgaagaaacagatgcctgaccactactaagctgtaactgatactgcagttgagatacaagatgtgaatctaaaagaaatcacctcggatgtctagccctgtcctcaaataatttcagctcggctgtctcatgactacaaccatacaagaaaccccaacagccaacatatggaaacaacctaaatgtctgtcgacaggtgaatgaataaagaaaatgtggtatatacatacagcagaatattgttcagtcttaaaaaagaaggaaaccttacaatatgcagcatcatgaatgaacatggaggacattatgctaaatgaaataagccagtcacagaaggaacagacactgcctgattccaatcgtaggagataactagtattgtcaaatttataaaattgacaagagaatggtagttgctagtgggtgagcagaggggaagatgaggagttattgttgaatgtgtataaagttttaattatgcaagatgagtaagttctagcgatctattgtacaaccttgtgcctatagttaacaatgatgtattgtggatgtaaaaatttgttaaagaggatacatctcatattgttttcttaccacagtaaaaaaaaaaagaaacaaataaacaagaatgtatatagtactgaaaactgtatgtctgatgattaaaaattaagaatatcctcaataccacataatttacacaatagatacaaaaggtgttggcaacaaagcatgtctgtcaacttggcttaaattttaatcataatctctcaaagtcttgagagaaggctatgttttgttcgtgtcattgttattgttgttgtttgactctaaagaataaatgagatcttggtaaatttttgttatatgcaatacgtatctaaggaactacaaaaatcaacttctattactcttgcctaattctttcttagtacatgattagatctgtgtagtacttcattgatcgtctgctgtgtaggcagcataggctcaatgtttattgaatgcagatttacg

SEQ ID NO: 318 - DNA, 13866 bp, Homo sapiens
attgtgacccccactcctgcccgccagacaacaaccccgtttgactgtaattttcgtttacctacccaaatcttataaaacagccccacccctatctcccttcactgactctcttttcagactcagcccacctgcacccaggtgaaataaacagctttattgctcacacaaagcctgtttggtggtctcttcacacggacgcgcatgaaatttggtaccgtgacttggatcgggggacctcccttgggagatcaatacccagtcctcctgctctttgctctgtgagaaagatccccctacgacctcaggtcctcagaccaaccagcccaagaaacatctcgccaatttcaaatccggtaagtggcctctttttactctgttctccaacctccctcactatgcctcagcctctttctcctttcaatcttggcaccacacttcaatctctcccttcttttaatttcaattccctttattttctggtagagacaaaggagacatgttttatctgtggacccaaaactccggccccggtcatggactgcaaaggcagccttcccttggtgtttaatcattgcagggacccctctgattattcacccaggtttcagaggtgtcagaccacgcagggatgcctgccttcgtcattcagccttagcggcaagtcctgcttttctggggtagggtcaagtaccccaacaccttctctccatgtctctaccccttctctgcctttctgaggggcaagaaaccacaaaccccttctccttcaccctgagcggcaagtcccgcttttctgggggagggacaagtaccccaacctcctatctctgtgccctgatcccttatttccactccccgacatcttatatctctgagccccgatctcctatttccacagcccaacctcttatatctctgcgccccgatcccgtttctgcgccccgacctcttatatctctgcaccctgatcccttatttctgcaccccaacctcttatatctctgcaccccgatcccttatttccgtgccccatcttatatctctgcaccccatcccttatttctgctccccaacctcttatatctctgcaccctgatcccttatttccacacctcaacctcgtatctctgcgccccgaccccttctctgcttttctggagggcaagaaccccccaccccttctccatgtctctactctcttttctctgggcttgcctccttcactatgagcaagcttccaccttccattcctccttcttctccctagcctgtgttctaagaacttaaaaacctcttcaactctcacctgatctaaaatctaagcatcttattttcttctgcaatgccacttgactccaatacaaactggacagtagttccaaatagctggaaaacggcactttcaatttttccatcctgcaagatctaaataattcttgtcataaaataggcaaatggtctgaggtgcctgacatccaggcattcttttacacatcggtccctctctagtctctcttcccaaggcaactcatcccaaatcctccttctttccctcccgcctgtcccctcagtcccaaccccaagtgtcactgagtctttctaatcttccttttctacagatccatctgacgtctcccctcctccccaggctgcttcttgccaggccaagctaggtcccaattcttcctcagcctcggctcctccaccctataatccttttatcacctcccctcctcacacctggtctggtttacagtttcattccatgactaaccctcccccacttgcccagcaatttacccttaaaaagctggctggagctaaaggcataatcaaggttaatgttcctttttctttatcccaaatcagatagcgtttaggctctttttcatcaaatataaaaatccagcccagttcatgactcgtttgacagcaaccctgagacgctttacagccctagaccctaaaaggtcaaaaggccgtcttattcacaaaatacaatttattacccaatctgctcccgacattaaataaaacaaaaattaaattccggccctcaaaccccagaacaggatttaattaaccttgccttcaaggtgtacaataatagaaaaaagttgcaattccttgcctccactgtgagacaaaccccagccacatctccagcacacaagaacttccaaacgcctgaaccgcagcagccaggcattcctccagaacctccccccccaggagcttgctacaagtgccagaaatctggccaccaggccaaggaatgcctgcagcctgggattcctcctaagccatgtcccatctgtgcaggaccccactggaaatcgcactgtccaactcacctggcagccagtcccagagcccctggaactctggcccaaggctctctgactccttcccagatcttcttggcttagtggctgaagactgacgctgcccaatagcctcagaagccccctagaccatcacggatgccgagcttcagataactctcacagtagaagattcagcccatctgcacccaggtgaaataaacagctttattgatcacacaaagcctgtttggtagtctcttcacacggacgtgcatgaaaaatatatcaaaagagtattcgcattcctgtgtttattgcagcattattcaaaatagcaagacgtggaacaacctgagtgttcattgacagatgaatgcatcaagaaaatatggtacatatacaccatggaatattattcagcaataaaaaataatcaaattctgtcatttgcaacaacatggttggaattacaggtcattatgttaagtgaaattatccaggaacagaaagacacatcttctcactgatatgtgagaaaaaaattaaattgaactcatagagagtagaatgattgttaccaaaactgggaagggtagtggggagaggtaaataaagtgggaattgttaatgagtgcaaaaatacaattaggtggaagaaataacatgtagcattttgtagcacaatagggttaatatagctaaatatttagtttatatttcaaaataactaaaagaaagtaattggaattttcctaatacaaaagagatgataaattgtaaggtaatagatatcccaattaccctgatttgatcattgcacattgtatacttgtaacgaaataacacatgtaccccataaatatgtacaactattatgtatattaaaaaacatctttttattgtagtggttgccctaaatcttgcaatatacttttatgaataagtcaatttccaaaactatatggcttcacgggtagtgctagtactttataataacaaagtattctgaatttctccctccactccattgtagcattgctctcattcacttcacttatgcatatgctatgataattgaatacattgtttctattgttactttttaaaaactgttatctcttagattgaaccagaatataaagaataaaagttttattttcctttacttattctttctttagcacttttcctttatgtagatctaagtttctgacctagatcctttttccttgcctttaaagagtattttcctacatttctagcaaggaaaatctactggcaataaattttctcaattgttgcttattttagaaggccaatttatccttcactctagaataacttacagactacagaattgtatgttgttcctctccgcaaccttctccacttaaaatatttcactctgctctattcttacttgcatgatttcgagtaaaagtcggatataatttttatccctgcttttctataggtaaggtgtttattcctgtttgttttctttatctttcggttgctatagtttttacataatatgcctaggtgtagatttttggcatttttttcctgcttggtattctctgagtttctgatactatctgtggtttggtaaatgacattaatttggggaattttttcaattattattcttcaaatgtttcttctctgcatgagccaaaatagctcaaatgtttcttctgtcctctttcctctatgttctccttctggtatctgtcaggcctctgggcccaagctaagccatcatatcccctgtgacctgcacgtacacatccagatggctggttcctgccttaactgatggcattccaccacaaaagaaatgaaaatggcctgttcctgccttaactgatggcattatcttgtgaaattccttctcctggctcatcttggctcaaaagctcccctactgagcaccttgtgacccctactcctgtctgccagagaacaacccccctttttcctttatgtacccaaatcttataaaacagccccacccctatctcccttcgctgactctcttcggactcggcccgcctgcacccaggtgaaataaacagccttattgctcacacaaagcctgtttggtggtctcttcacatggatgtgagtgaaatttggtgccgtgactcagatcagcggacctcccttgggaaatcaataccctgtcctcctgctctttgctctgtgagaaagatccacctacaacctctggtcctcagaccaaccagcccaaggaacatctcaccaattttaaatccggtaagcggccactttttactgtcttctccaacctctctcactatccctcaacctctttctcctttcaatcttggcgccacacttcaatctctcccttctctcaatttcaattcctttcattttctggtagagacaaagaagacacgttttatccgtggacccaatacaccggcgctggccacagactgggaaggcagccttcccttggtgtttaatcattgcaggggcatctctctgattattcacccaggtttcagaggtgccagaccaggaagggatgcctgccttggtccttcacccttagcggcaagtcccgcatttctaggggaggggcaggaaacctgacctcttatctctgtgccccaatcccatatttccatgccccgacctcttatctctgctccctgatcccttatttctgtgccccgaccccttctctgcttttctggagggcaagaaccccccaccccttctccatgtctctactctcttttctctgggcttgcctccttcactatgggcaagcttccaccttccattcctccttcttctcccttagcctgtgttcttaagaacttaaaacctcttcaactctcacctggcctaaaacctaagcgtcttattttcttctgcaatgctacttgaccccaatacaaactcgacagtagttccaaatagccggaaaatggcaatttcaatttttccatcctacaagatctaaataattcttgtcttaaaataggcaaacggtctgaggtgcctgatgtccaggcattctttcacacatcgatccttctctagtctctgttcccaatgcaactcatcccaaatcttccttctttccctcccactggtcccctcagtcccaaccccaagcatcgctgagtctttctaaatcttccttttctacagacccatctgacctctcccctcctcgccaggccgagctaggtcctaattcttcctcagcctcggctcctccaccctataaatccttttatcacctcccctcctcaaacctggtctggcttacagtttcattccatgactagcccctcccccacctgcccagcaatttactcttaaaaagctggctggagctaaaggcataatcagggttaatgctcctttttctttatcccaaatcagatagcatttaggctcttattcataaaatataaaaactcagcccagttcatggctcgtttggcagcaaccctgagatgcattacagccctagaccctaaaaggtcaaaaggccgtcttattctcaaaatacattttattacccaatctgctcccgacattaaataaaactccaaaaattaaattccagccctcaaaccccacaacaagacttaattaacctctccttcaaggtgtacaataataaaggcagccaagtagcaacatatttctgagtggaggcaattccttgcctccactgtgagacaaaccccagccacatctccagcacacaagaactttcaaacgcctaaaccgcagtggccaggcattcctccagaaacgcctcccccaggagcttgctacaagtgccagaaatctggccaccaggccaaggaatgcctgcagcctgggattcctcctaagccgtgtcccatctgtgcgggaccccactggaaatcggacgttcaactcacctggcagccactcccagagcccgtggaactctggcccaaggctctctgactgactccttccaagatcttctcagcttagcggctgaagactgacgctgcccaatcgcctcggaagccccggagaccatcacggacgccaagctttaggaagttcaagctgctagatggacaggtcaaatgaagaaacagatgcctgaccactactaagctgtaactgatactgcagttgagatacaagatgtgaatctaaaagaaatcacctcggatgtctagccctgtcctcaaataatttcagctcggctgtctcatgactacaaccatacaagaaaccccaacagccaacatatggaaacaacctaaatgtctgtcgacaggtgaatgaataaagaaaatgtggtatatacatacagcagaatattgttcagtcttaaaaaagaaggaaaccttacaatatgcagcatcatgaatgaacatggaggacattatgctaaatgaaataagccagtcacagaaggaacagacactgcctgattccaatcgtaggagataactagtattgtcaaatttataaaattgacaagagaatggtagttgctagtgggtgagcagaggggaagatgaggagttattgttgaatgtgtataaagttttaattatgcaagatgagtaagttctagcgatctattgtacaaccttgtgcctatagttaacaatgatgtattgtggatgtaaaaatttgttaaagaggatacatctcatattgttttcttaccacagtaaaaaaaaaaagaaacaaataaacaagaatgtatatagtactgaaaactgtatgtctgatgattaaaaattaagaatatcctcaataccacataatttacacaatagatacaaaaggtgttggcaacaaagcatgtctgtcaacttggcttaaattttaatcataatctctcaaagtcttgagagaaggctatgttttgttcgtgtcattgttattgttgttgtttgactctaaagaataaatgagatcttggtaaatttttgttatatgcaatacgtatctaaggaactacaaaaatcaacttctattactcttgcctaattctttcttagtacatgattagatctgtgtagtacttcattgatcgtctgctgtgtaggcagcataggctcaatgtttattgaatgcagatttacgatttgtgaaccaagagatacaatgttctttaatagtattagagtttagatttcatgtgtcctcagtgtcaacaaggacagtgacatttctccaagacttttattagtgaggtatagcatccgtgatgctcagtaaatggaaaagcagttacaatgtcaggctgaaggaaaacattgaaacccacttaggaaacttcatgtataaagacacctgactttattttctatttcaaacctgggcttgccaagtgtggatttactgtgcataaaagcagcagtttatttgaattgtgaagtactcctttaaaatgaatagttctaattgtattatacaatttagctctaaaaggctattatattagtgtgctagggctgccataacaaagtaccaaagactgggtggccttaacaacagacatttattttctcacaattctgaatgctagaaatctgagctcaaggtctaagtagggttggtttcttccatggtctctctcctggcttatatatagccttcttttctctttgtttccacctggtcaatcctctgtatgtttttgtcctaatttcctcttcttctaagttcactagtcattaaattaaggcctattcatatgaccttgtttaaccttaattacacctttagagacctatctctacatatagtcacattctgaggtactgagggtaggaagtttgttgtggcactattcagccagtaaaaactacccaccctcaactgttgctcaatcttgtctaccatagtcatctcttataagtcagatgacccacaatttaggaagctgatcctgtggtaaatcctgttctccttaaattggtgaaagcatagatgtcaaaaatagccatatagtaaaaattaagtgaaggcataaaataccttttcaaaggcttccaaaaggtaagacctttctaaatatttctaaattgatctaccctattttgcagttccaaccatgaggattaataactgctgtggaattttttataagggccagactagaatttttaaatgatacctcacataattattttatgaaaacactgtaagttattaatcaaattaggttagctgtttttcagcaaatattctattcttggacattgtgaatgaagaatgctaacctttgattggggttatagggctttacaacatccgaagcatactagtgcaaattaaacagtgtatcatcagaaatatatttgggaaaagggaaactataaaggcaaccaaaataggctgcgtaaactttgcaaacttctgtggctggctagagctgatgtactcaggatctcccaatatcctgttaatacctcagtgtctgtcttttccccctacattcaaagaatctatgcaaccccctgggggcaaacctgttctaaatcatattagcctttatcccattataattccctgtatatcctagtctaaaggaaatttaattgccttattcagtcacataaattcattttaatctgacacataatgtacaaaacatatatattgtaagataatgttcatgaaagacttatttatcaagggagaaaatataatgtatacatatggggtaatgacacaagatataaacatggtaacagcaatgaaagttaaaaaatatataggatcagaattctgaaaaaaaaaagctattaccactaattcggatatttgggaaggattgatgatggaaatggcagtggtagcgagttttgaattgtgaaataggtgtattttaattccaggccaaaaaaaaaaaaaaaaaaaaaaaacaagtagcatgaggtaaacataaagagaagagtgagacctccaggaggaaaagtaggatttgtttggctcaagtaaatggtagatgaaaggcaacagaattcagacatgggaacataatcttatgaaataactccatcctatatgtaaaggagaaagtgaaagtttcagagaaggaccgaaatatgcttcagaagaattaatgctgtaggaatacgttaaatggatttgaacaggatgtgccaacagcggagtaccatggcacaggtaagctgcatggtaggagcctcaggaataagggggaaggccctgaaaggatacaattacaaaaaaattacaaactatgaagtcaattggttatgatgatgaggcagagattttggtcctggctgactaacaagatattgcctttaataaaagcagcaagaaaggttaattttggtacgaaaaacatgagttcagttctaaatattgtagtagtcaatatttttagatgattgtcaagactcaccacccctggtgtgcaagttgtgcataatctctcagactgtgaatgtgattaattttattcttatgattagaatatgctgtgatatggcacaattgactttaagaaagggagattgtgcatttgggcctcacctaatcatagaaaccttttacatgtagggcattttgtctggctagtagcaaaagaggaagtcagaggttcaaaacatgagaaagactgaatggttcagtgctggcttgaagattagggtccacatggcaaagaattcaagtggcttctcaaagctgaaagcagcaaggaagacctagcaaagaaatggggacacttagcaaggaaacggggacttcagttctacagcctcaaagagatgacttttgctaatactaagaacaagcttggagtggatttttctctagagccttctgatgagaactcagcttggctcgtaccttggttttggtcttttgataaccagtaaagagcccactcatgcttagccagacttctggcccattgactgtgaattaataaattacttacattttaagctgctaaattcatggtaacttcaatagaaaataaatgcagatatattgccctttagttgtatggaaagcattgaagatagaatttctcaaccttggcactattgacatttttgtactggataattatttgttatggcggtctgttctgtgcattagaagatgtttagcagcattcctgacctctacccctagatgccagtagtattcaatattgtaacaaccaaaaatgtctccagacgttgtcaaatgccctcttgagagcaaaatttcctcggtagagaagcatttatcttagggtaaaaactagcggtcatttataaataggaggtgtcttagtctgtagtcaggttgctataacaaaatatcataaacatagatagcttattcacaacataaatttattatgtgcctggtgaggacccatttcttatacatagcgtcttcttgctgtctccttacatggtagaagaggcaaggcagatctctgaggcttcttctataagggcagtgaccccgatctctagagctctgtcctcatgatctaatcacctcccaaaggcccagactctgaataacatatgagtttgggggttagggggtgggggtgggaggactagaacactcagaccatagcagggcactagagatcaaggagttgtggtaaaacatttagattggaaaatcagctgggcgaagaaagttgaaggtgggaagttttaatagataagatgcaagaattttaagaaaaaagtttgaaagacatttctactcaagtatcataaaaaggagaaatgattcaggctggagataatgcaggctaagagaagaaacaagaaagaaaagccttaaacaatctaaagcataactatcagagagctgagaataaaaagtacgttgaaattggaactaagatgtcattgacagatttgttttggcagagtggcttggacagaagctcaatagaaaaggaatgaataaattttttaaaaggcaatagcttttaagaggaaatgggaaaattagtgcttttaaggtaggagcattgttagagatagaggagaaaggacatagggaaagaactgaaagaggacaaatatttattgagtatgttctcatagtatcaaaactcacctataacagttaccttcccaaaatcaaagcaaccataagctctgtctctgtttctactgttgtttatagaagcctcttgatgttctgccaactgaacatactagctttttcctgccagcctgccattgcaaagcctttgatgttggttggtttcttgccactcaacacatatgcccctatggacttgacaccttggattcttccattgaatctcaactttgctctcacctgacaattagtttttctatttacttttacttccaatgctgaagccatggtgttggatcccagcaatttatatactaaacctggtacctgctatcctagccatagcaaaaccctctgggaaaatattttgtacactgtatatagaggaaaatattttgtacactgtatatccatgctggataactacttaatttgttctcaaaatcttcttatgacatctctacactatttttagagatcataaattaacttgtccaaactcacatagatagcaagtaaaagctgaaatttgaactcagaactatctgactccactgcctatgatcagtgctcaaatttcaaatggaatatatgttttttcaacttgacagtcttccgtgaaaaagaatggtgccagagtcaatctatgacctgagatattatgtaatattttcattagtatttaatttgtgaactggagcaaaacttggttgaaattggtgttgacataatactgagttaggtgggtggtacattcttttgaagtaaaggtcagaggtcattacaaatttagcaagctataaaattagtcaaatatgattatacatctatttaatttttaatgttatcacttctttataaaataaagaattttgccaaatagttcatattgacattgtttaagagctaagaggatccatagattctgttcaaatgacccaaatacagtgtatatataactttcacaaagtaggaaataatttatattttataagtatacaaataatttaaaatataattatttttctggatgcattcataaaatatttctaaaacaaatttagaaagattttaaatatttatttttatcaaattattttaaatgagaagaagctgccatagagaataggttgtcattatttcccagaacttttaaatgcggaaagactcattttcaaactaactcatcagattacatgaaaagtgaattttattaacttcctgaggcaaggcagagcccaaacccaattctgaataggaggtctctgtagagaaaatgagagaacaaattgtattgtttatctcttagactcttaagtcttagagtgggataggtggaggaagtcttcgaattaattgatttcttaaggtgagaaatgatgtaagcaaggtgagttctgaggagaaaaaggattgttgctagggacataacacattctgccactgtatttccatagctgatgatgatattaatagttattctggtttttagagagcacagcttgttcattccattaaaaagtacggatggctatgcttcagtttgacactcactgtaaaggaagacaaaatgttggaattattttgacctacccatgaaaagaaaagcctctggtgtcctgcttcctcttcctgctataattttgctaccagaatcaagttttttgaacttgcatgaaacgttgaacatcaaaaccctgaagacaaagcatagcatgggtacaaagtacttttgaatatcagaagataataataaagaaattgtgaatgaaagacatgtttactggctattagaagggctcccttaacaattttgtttctctatgtatgtgtccttgttttcttcaaaacatctcagttgtgtttctctaacattctgaggtggagcttaatgtgcttgcattttttttatacttgttttctgcagttgttttaagtgagtagatttcctgacctcttggattcaagaatgaaaatcaattatctcctaatgaatctttatacctcacatatttctgcagtcacaaaattaattgggtttaaattaacaagttatttatttttcttcaaatactaattacatatttggtctaaggagttttgcaagatgctctgagaattcattttatggaaatttttttaaaaactgtcagtcctgaaatttcagcgtaccctgaggatgacctttatgaagtccagtagtataaagctatatttctaaaatatgatgtcttgggtgacaaatgaaactttctcttctactagatataatataaaaacttattttcattatatatgatgcaagaaaccaatatgtgcagaatatatatttaatattgtgtacatgattcatatgctgaagaacttctattttgaagaatttagtgttacttaacatacagaaactgattattttcaacgtgtgcttcaatcatat

SEQ ID NO: 319 - DNA, 1006 bp, Homo sapiens
aaggaaaaaaccctcatctggaagaaaaaaaaatgagatatttaatcaacggtcttcaaaataaggtgaaaaaagattgtaaagattcaatgacaaagttttattaaataccaatactggctaggcacaattagacacattattatctcatttgctgtatctggtatcaaacaacaaagcctgaaagattaccatagattttgatggcctcattaacataattaatccgtagtgacattccctggataataaatacagttttatgtccgtgtgtcttctgtgtcttccaagttgctacagggctctatttgatctgagaaactgactgctgtttacatccaggtatgcaatgtgacattagaattgaagcagaaaggaagcaaaacaaaacagggttcatgaggaaaataatcttctaagaactaacatggcctggaggtaaaatgcaaatatatccggtaataagaagcccagattactgcagataaaagattaaaataggattcaattattcatctccatttgcaaatctacaaactaggaggaaggactaacccttttcctgggattagtaactaaatttaatgattacagcaaatataaagttcttttgtaaattattgttggttaaggattgacttgcattgacaacacactttagctctcgcccctttcattctccccctgcaagaacaaaggcaaaatgaacagtgaggaaaacctggaaacaggaccgagtgtttgctatcacttgattcctttgaaggagcaatgctttctcataatataggttttatagtatcatcaagtacatcagttaagcaaatcaagtgctttgtgttctgtatataaattacataatacaagagtctgtggcagttaagaatctggttctgcactttgggaggcagttccttccctcaggtttgttagtagaaaccaaaaagtagcctgagagggttcaggtgccaccttggaggcactaccttatcttttgtccttttag

SEQ ID NO: 320 - DNA, 1006 bp, Homo sapiens; identical to SEQ ID NO: 319

SEQ ID NO: 321 - DNA, 288 bp, Homo sapiens
gccgctgctcgtctcggctccccgcctcgcctcgcctcgccgcaaccgcccgccctggccgcgcctcctcccgccctccgggccggcgctccgcttcccccttcctcctgcgcctccgcctccttccacacaaataccaactcctcaacccgagcccagatctcgccgccgccgccacactctgctcgggcccggcctcgcgagacttccgcgctggcctcagcccgccccgcctcgctgccactcgcccgttcgccctctcgattctcctctcggccaatcgatctg

SEQ ID NO: 322 - DNA, 2435 bp, Homo sapiens
agcagtttgctgcaggaggtgctcccacacattagtttccaagtgaaacagctataaaggaagtaggatggatactgaaggtgcgaaaactgaaaacgagagaaaggaaacgctgtggccaggtccatctgatactgtgaaatatttcttatcttgattttctcctggataagatcctggagcttggctggagccaagatggctgaataggaacagctccggtctacagctcccagcgtgagcgacgtagaagacgggtgatttctgcatttccatctgaggaacgcagctcctcaccagcaacggaacaaagctggatggagaatgactttgacgagttgagagaagaaggcttcagacgatcaaactactccgagctacagaaggaaattcaaaccaaaggcaaagaagttgaaaagtttgaaaaaaatttagacgaatgtataactagaataaccaatacagagaagtgcttaaaggagctgatggagctgaaagccaaggctcgagaactacgtgaagaatacagaagcctcaggagccaatgcgatcaactggaagaaagggtatcagtgatggaagatgaaatgaatgaaatgaagtgagaagggaagtttagagaaaaaagaataaaaagaaacgaacaaagtctccaagaaatatgggactatgtgaaaagaccaaatctacgtctgattggtgtacctgaaagtgacagggagaatggaaccaagttggaaaacactctgcaggatattatccaggagaacttccccaatctagcaaggcaggccaacattcagattcaggaaatatagagaacgccacaaagatgctcctcgagaagagcaactccaagacacataattgtcagattcaccaaagttgaaatgaaggaaaaaatgttaagggcagccagagagaaaggtcaggttacccacaaagggaagcccgtcagactaacagtggatctctcggcagaaactctacaagccagaagagagtgggcgccaatattcaacttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccgctgcaaaatcgtgccaaattgtaaagaccatcgaggctagggagaaactgcatcaactaacaagcaaaataaccagctaacatcatcatgacaggatcaaattcacacataacaatattaactttaaatgtaaatggactaaatgctccaattaaaagacacagactggcaaattggataaagagtcaagacccatcagtgtgctgtattcaggaaccccatctcacgtgcagagacaaatataggctcaaaataaaaggatggaggaagatctaccaagcaaatggaaaacaaaaaaggcaggggttgcaatcctagtctctgataaaacagactttaaaccaataaagatcaaaagagacaaagaaggccattacataatggtaaagggattagttcaacaagaagagctaactatcctaaatatatatgcacccaatacaggagcacccagattcataaagcaagtcctgagtgacctacaaagagacttagactcccacacaataataatgggagactttaacaccccactgtcaatattagaccgatcaatgagacagaaagttaacaaggatacccaggaattgaactcagctctgcaccaagtggacctaatagacatctacagaactctccaccccaaatcaacagaatatacatttttttcagcaccacaccacacctattccaaaattgaccacacagttggaagtaaagctctcctcagcaaatgtaaaagatcagaaattataacaaactgtctctcagaccacagtgcaatcaaactagaactcaggattaagaaactcactcaaaactgctcaactacatggaaactgaacaacttactcctgaatgactactgggtacataacaaaatgaaggcagaaataaagatgttctttgaaaccaatgagaacaaagacacaacataccagaatctctgggacagattcaaagcagtgtgtagtgggaaatttatagcactaaatgccccacaagagaaagcaggaaagatccaaaattgacaccctaacatcacaattaaaagaactagagaagcaagagcaaacaaattcaaaagctagcagaaggcaagaaataactaagattagagcagaactgaaggaaatagagacataaaaaacccttcaaaaaattaatgaatccaggagctggttttttgaaaggatcaacaaaattgatagactgctagcaagactaataa

SEQ ID NO: 323 - DNA, 2435 bp, Homo sapiens; identical to SEQ ID NO: 322

SEQ ID NO: 324 - DNA, 2435 bp, Homo sapiens; identical to SEQ ID NO: 322

SEQ ID NO: 325 - DNA, 2435 bp, Homo sapiens; identical to SEQ ID NO: 322

SEQ ID NO: 326 - DNA, 2435 bp, Homo sapiens; identical to SEQ ID NO: 322

SEQ ID NO: 327 - DNA, 3209 bp, Homo sapiens
aaagaagtgcccggggctccactctacgccgcgccagcccaccaggggtcgcggtgacgtcgcccgtttaagagccagcctcccttaactctctcttaacggggcgtcccggcggggctcgcggctcccggcagccgccgcctcccctcgcggcacttccggaccccggcgtcgcccttttaaggggcagcccccagcagcgctctccccgccccctgttgccggcgcgcgaggcgggggagccgggctggagcggagcgcgcggtccgcgcggccactggagaccaggcggccggcggccgggcaggcggcggcggagcgcgcggcggcgtggcggcggatggggacgcggagccgggcggctgtggcggctgtggcggctgtggctgtggcggcggcggggaagcagctgacgggccggcggcggcggcgcgcggggccgccgggaaccgagggcgccgggccgccccctgcccagtccttgcaggccgccaggccccctccagccggggccgtggagcaccggggcaaaggccggggcccccccatgaaggagcgcgacgcggccccggccgagcggggcaagccggccacctacaccggggacaagaaggcgaagatggcggccaagaccaacaagaagtgggtccggctcgccaccgtgttcgcctacgtgctctccgtgtcgctggccgccatcgtgctcgccgtctactacagcctcatctggcagccggtgggcgccgggacctcggggggagccgctggcccgccccccggcggctccaacgccactggcccgtctgggacttcgggggcggcggcggcggggcccaacaccactgggtcgtcccgccgcgaggcgccgcgcgacgttcccccactgcaggcggcgcgaccggcgcctccggagccccctgcggacagccccccggccgggccgctcgagcggcctcgggggccggacgaggacgaagaggaaacggcggcggcgcccgggagtcgttgaagccctccgcgctgggggccgccgggaaccattctccccaagcccagaggcaggacttcgcagcaggatggggtggagagcccgcgggagtgacccccacgagagtgaacgcccctcacactcccaccatcgccggctggccccggagcgggaggcccgcagccagatcttcagccaagggaccacgattcgccggggggctgggggtttgctgcccaggaccgtgctgcaccagggccctgagccgtagggggatggggggaggggtggggagatcccggcaccaaacccttctgcgccgctcgctctggtgtatcctacatgcaggggtgactggggctttcccccaagactcaggggaaggatggagctgtaggggctctttttaagtaagctgaagctctcgaaaggaggagggcaccaaaagtagtggagctcaggtacgtcaacctagttgcagtggccagagatgcattaaatttctagatccctgtatatagttgttgacatatgcactagaagctataatcacatagaattctatgtatatcctcccacaccctgggtagctactgactgaaggggtcaagcaagggctatttgctgtcccccaaaaagtacacctggccagaagggcacaaacacggcttcttaaatcactcactttctcctgttcccctcctgtttctgaaatataagtttatgacgttctttcacaaaagagtataatcattcttagactgttgacatggctgtggaaagccttaggagaagtagaaacaatttagggagggtggggaatgtactcatcccctcttctttccatcctagtgcccccaccaaagaggcttcttgttgcagccctcagtatctggatatgggccagggaggaaggaagggaaagagcaatgctgctgtgcttcaatcctggccttcccctcacagaattcttttaggaagagcaagcttttgtaagtagagtggcaagtgtttttatctttttttttttcctgctcctcaaaatgttgtcttgttccggcaatcacttttgccttccctctttcctgagcctgtagtgacaaagcccggcgatttgggatgaaatctgttgtaacaccagagctttgattacacatcctctggttttgagttattctacagaatcagaaaggctggaaggtgggcttcacactcaggattgtgctttgagaaccagctaatagaccagccgagggaaggttgaattggctgtctttacttttcccgataagccctacttaaatgcagcctgtaattgtataaaggagatgagaaacatcaagagaaatgacatacatgtagctctggggtagcaagaactagacttcctcaatttggattccatttccttctgccatttgcttttaggcaattgagtgtgggtagtgatgagatatcaaatcccttagtgtttccattttgggaaatgaggcactatttttttttttaaaagacaacttacccacctgagtcctgaaacagtttgtctctccagttttctggcctatactctagttagctctgatccaagtttacaggacaacagccttgctttaagccatgtcctgttgtgggcacgataatagcaactgagctgtcacagcctaccagcaggctggtaacacctccagggtctcttggctagagcagatttcttagcagctgactaggacttcagtcattgggaagcctatgaggcctttacatttttggtgtgagatggggaagaaacataaaatgccactttacaacttcaataatagcctgtaatttatatttactgtgtgaatttttagtcctatattttaataatttgtaaattgatctcttattccaagaatcctttgaacttgtagaacatctgggagtccacttccctgtcctcttcctgatccctgctttctggactgtttaaatcctctttgggatggatcagagagtctagagaggccactcataggtccagctgctggcctcctgactctccaaagccttcactggaattgggacatttgctccagccctagctgtgaacatgaccagagacattatttataattcagccatttaagatatacctgtactcaaaaagtcctgtatatttttaaaaagttttatttttcaggtgaacaaaaatacatcctaagaactctgcctaagc

SEQ ID NO: 328 - DNA, 3209 bp, Homo sapiens; identical to SEQ ID NO: 327

SEQ ID NO: 329 - DNA, 3209 bp, Homo sapiens; identical to SEQ ID NO: 327

SEQ ID NO: 330 - DNA, 3209 bp, Homo sapiens; identical to SEQ ID NO: 327

SEQ ID NO: 331 - DNA, 3209 bp, Homo sapiens; identical to SEQ ID NO: 327

SEQ ID NO: 332 - DNA, 850 bp, Homo sapiens
atcatcaaaacaaacagccaatatgtctctagaaacattgcgttctaaactggaagtgctgacaagccttcatcccagaccctgagtggcagattttcatgaaaatcagcttctgggccagttaagtcttcatgaagttatcttttcataactcagccctcattcccctctgggtcagtagcagtggaaccaggaaacccaagggccagatttccttcctcaatgaaggcacaccaattcctctgcttaaggacttctgttcacaatgaattgtattagttattcttaacattcaaaagagaaagttctgcatcagagcccacccatgtccagccattgtgccctgagatcccaagactgtggggatgagggcagagcccattaacatcagggattctggtcactggggtcacacttgagcatgattttcaaccccaatccctttttaaatgtttcaaaggcctccagagctttctccagaggaaacctatgggtgacgaggggttttacattcacagacttggacgcaagcatcgaaatcgccactggccacctgtaaaagagcacgagcattatattcaaccttcaagaggaaagagccaggtgccccaaactaccaagcactagatcagcttggccgtatttattgatagcactgtggttctgcaaagccaattttacaggccaacaacccaggaaaggaccttatggcttatgattcaggggtacagagcctatttgcaattgcccccacccctcacccacccgctcactctgccacgtctgccatggagcctagaattcctgtggcatgaaggtacaaggcacatggtggaggccactgggaaaa

SEQ ID NO: 333 - DNA, 850 bp, Homo sapiens; identical to SEQ ID NO: 332

SEQ ID NO: 334 - DNA, 850 bp, Homo sapiens; identical to SEQ ID NO: 332

SEQ ID NO: 335 - DNA, 850 bp, Homo sapiens; identical to SEQ ID NO: 332

SEQ ID NO: 336 - DNA, 850 bp, Homo sapiens; identical to SEQ ID NO: 332

SEQ ID NO: 337 - DNA, 1229 bp, Homo sapiens
ttacaatgttcaggaactcccaattttctgttttaggaaaaaagtaaattgaatgttatatgtggggtcggtgtggaggaaaagttaaatattaaatttgaattcaattaaacatggacaaaaacaatgatcaccaattcccagaacaggttgtgtgagccccttgagacgttcatccgcactgtttcggagaaatctctatttcaatctattcctatacgttagttattgaaaaacaatagacaatcacaaaacaagttcacctttttgtgttccttgagctcagtcaggaagggccctcatgactgggcctcatgccaaaaaactagttacaaagaagctagagttccagactgcgcctaagcttcatgagacctctcctcgtctgcacagacgagtggccaacactggagcccaggctattgcttcccagtctggtggtgaatcgtccatagtctgggacaggcaggggagcccagcggcatgctggatatgaatgtatcttcagccttcaagttaccattggccagagggaagagtggccccaaactctgaagagcgctggcaaggctccccatcttcctctccctagcctccacaggaacatcacagtatggcttggcattttttttttttttttgagacggagtctcactctgtcacccaggctggagtgcagtggtgtgatctcagctcactgcaagctctgcctcccgggttcatgccattctcctgcctcagcctcccgagtaactgggactacaggcgcccgccaccacgcccagctaattttttgtatttttagtagagacggggtttcactgtgttagccaggatggtctcaatctcctgaccttgtgatctgcccgcctcagcctcccaaagtgctgggatgacaggcgtgagccacgcgcccagcctggcttggcatctttagggcagatctcagtatgccttgcattccaattcatctccagaatcctacacttcctccaaggtcagtcctcatgcgagtctccaacctcatccccacttcattttcctcattgtacttaccatcttttattcgtatcccaccaaattttggctttgttagctatactgcaaatagtagatgctcaataaactactagtgaatgaatgaacttggaaaaaaaagcttacacagaaatctgtactggatgttatttaaaagatgaaatttcatggttcaaatgtatttttctccc

SEQ ID NO: 338 - DNA, 1229 bp, Homo sapiens; identical to SEQ ID NO: 337

SEQ ID NO: 339 - DNA, 6162 bp, Homo sapiens
aacagaccaaaataatgctgcctttagtgtttctgagaaggtaacacatgaaacccagtttcccctggactgtgggatattgttttgagaacctatttgtgggggaaggcaggtcagtcacacgttcaaaagttcacaaattaagaacatacaaatgacaggaccaccaaatttagaaaatgtcctacaatgtgcattttattccatatcattatacaatgtttacatatagttaaaactctcaagaaaacgtcctttaccagttgtatgtggtgtctaaatctttaacatgaaggactgaaaagagtggaaatccacactgattgttatcctacagattgtcatgagctgcacgtgtgccaatcagaaaggaatggaagtctcggaagagcagcgtggcttacagacccttggctttagtgaattcagacaaccaggggcttctggcatgagttcctgttttcaaaagctattttgcccaagcataggtacatttaatcatatttcaaacactataccagatatttagaagttaggaatatgagtatctgataggaatatatacacacacacacacacacacatatatatatatatatacatacttaaagtaggactcatggctgtcaggaaatagaaaacattttttgggggggctcctcattatttatcagttcaaacaagaggacctgctatttcaaggagcagtgctgaattgatataagtattctaccataaaagctgttttgtgattaaagagaacgtaattattccagccatatagagaaacaagcaggcaaggccagcctttcagccaattccttgcatttgcatttctgcagaaagcaactgttttcaactctattagttgaaggtaggacagtcttagattttctgcacatgggctccacgcctagaattcagcccaagttttttcactcttaagtttaatcctcattcagggccagctttagttcattagtgaggcggcgattttgctcaagttgctggtagagttgatctgtacaggtcagcaagcaggttagcagaaaagaggcagaaggaagacaggttagcagacttggtgagaggcagttaatagagaacacaaagagacctcaagcaggacagcaactggtcacttgctgagcagtttactcttaccccatagtcacctgtcctgtatccaggaagggtagaccctaaaaagcttggtagacttaggaagtgtcagaatttctctcttggtgaggaaaggaggggaggaggagcaacaggataagaggaggaagaagagtgaatgttcctcttatacctcactaaaccactttgtgagctgagccatacatggtttctggcaatagatttgggaatgcaggcctggctggaggcgagcccagcgtgacatccaccccttgctagggctcagtgttgaacttaagtgaaacatcaacctgcccagtgctgcccacctcttccagaacccctttcctctccgttcacagggcaggctttcccctcaggtaggaccaactgggggttactgcttttgctgcactgaaattttttgaaatttggaattaagtctctgtccttcccccagtcaccacaatacagggtacacattctgactcctgtctagctttgatagtgttatccattcaaacagcaaaagaacaagcacttgtcaccactcaacactgatttagaatttatctgcttgctttttttgttttttgagacttagtctcgctctgtcccccagcgtggagtgcagtggcgtgatctcagctcactgcaagctccacctcccgggttcatgccaatctcctgcctcagcctccctagtagctgggactacaggcgcccgccaccacgcctggctaattttttttgtattttttttagtagagatggggtttcaccgtgttagccagaatggtctcaatctcctgacctcatgatccgcccgcctcagcctcccgaagtgctgggattacaggcatgagccaccgcgcccagccctatctgcttacttcttgaagaggatggcattcatgtgtggtgctaatggatgtgtataaaatgaacgaaacttgcaacacctacatgaagaccagcgtgatatacattttacacactgacacgtgatctgcttacgggggaaaacaagtgcaggagtcagtctgtatctgatgatccaggggacatccaagctatgacaagcaagagcccggtatgcactgggaacagctggaggatgcacggtggctttgaatgctggtgacaacttggacctaaaaatacttcatgatcttgaaaagctaacagacctacccctagggaaaatgtgcctgcagcccccgggtctgtcaggagactgagcagttctcacattaacattctcttataaatggtaggacatgggaggatgctatgctcgttatgttttctcgcttggaatatctgctgctctgtcctctttgctcatccacattttttgaatatgccaaaccccagtcaaacgtccgctacctcctccagggagctcccagtcagaatggttctctcttccttgttgcctccaaatacacatgcctattagttcggactcgcttcactcctctatctccccatcagatgcccagcttattgaggacaaagagcctttccagcccatctctttaccacacccccactgcttcccacggtgttttgcacgtgacatatgcttgggggttccaagacatatatcccattactacattcacactatggacataggaagtgtcgccatgggtggggagcttgtctcagtttgctgagcccaaatgtttggccaggctagaatggaagaactttggagaaaatctggagaatccagagggtcagtatgaattcagcaggaaggacagtggtccctccgacagcctcctctggatctgctctgcttcagctgctgtggagctggtgtgcatgggtggcccaaaggcagggacaagacatgctcatatccttggaagtgttttcccttccggttctatggagactcccagctgtctgaaacttcaagtgcccaaactcagtgatgcttttggtttggcccaccagagcagctgtagctatggcctggccctttgaaccagaagcctggttcaaatcaacagttgaacaagaaatcaacaatttcttgataaacttgagtttatcaagttttcctcttgcacatgcataccttgggctactcctgacctgccctcccagtccattagtgccccacttccccttgtagagtgtacttatagaaagtgcgaaagtctctggaaggatttccaaaacacagatgtgcctccagaattacatgaacatctgctcagcagaactttcagacttggcattttgtctacatcaggaagcaggatttactcagagaagggtacacttctcttattctgaatttaaaaaagaatgaggaaggaatcatagtcagaagcaggcccaaggagccttaagaaaagaaaagcatgaaatcatggaagtctttataaactcaagggagagacattgtccagattctaaaattccaccatactatgactaaaatactttaattcacagctttctttaaaaaaaagtatttcctctatgctttgaagtctctgtagagtgagaatgacactatcttctgagtttgtccaaatttatttgagtatggtggtatatcagccctctcgggctaaaaaaactatatacaaaacatgcagatcatccatgttaaaaaaaaaacaggagaaatatatagctagattgttgaggaaggagaaatgttgggaattataacactaaagtccatattagttaaagttctattttttgcaatgtatttttttaaaaaaatcacttaattgctgtttgtgaaataaaacagaagcccaaatgaaatacaattgtcttctgaacaatttccaccaactatctttttgggaaaaaaaaaaagaaactttcattgctatattttaaaaatgtccacaaatgaaaacacagccattgaacacaaagattatgtacaatccctcccaaagagtatgtgctaaaaagcacaaaacaaatcacgactaaacagagtaatcatatttagaaaacctaagatgtcattttcatgatcaaaataaaggtggctgagtcatgaatatacttcaaaaaagcttgaacttttctttgtgctataaaaggatgatcgacaataaccaaaacttacattgtttgaatccaagttctttttcacccttctcaatgtataacttcctagtaatatgggacagctacagaaccattcatcatgagcctttcattagttagccaggtcctcccaagtaaggccaccgaaataatcaacacagaggggtcactacatcccgagctaaacctccagcaaaggaagacactgatcaagccagacctttcaactctcaacaagcaatgtcccctgtgtgacccagactgcaaagcagagccatcacaattcccccaaaacccccccagatgtccagacctcattctaacctttgaaaatcagaactctgagagggaatgcaggcctgggtatttttttgaagttcaacaaggaactactgctttagaaactcctgatataattctgtatagtgttcagtatttaaaaagaaaaagcagcagccaaacactaaccctcatatgtgtgaagcagctttgtagttttattcaatgttgaaactaaaatgtcaataaataagaagtaaaaagaatagcaaacagaaatagcttacacagtgtttatttgacactgaaacgaagagcttctgtacaatagaaagcacagtgtgtgcctggctctaaggcaggatgctaagagagagaaccagggtcagctggagaatagacaaatgcagagctcagagaggtgggacatccagctcgacgagggagtcttgggagaagtgaagcaaagaaacttatctgcgtgaagataaaaaggtgggaggaaaaaaaaagtggcacaatgagaaaaaaaaaaaaaagaaaggaaaccaaaccaatagatgagagcacttgaaacacagacaagaagcagtcatgcaaaccccactgccagccacacccttggaaggacatccatcttcccacctgaggccgtcacaggccgcctttcggcaagggtccattttaagaagacccatgaacagaatttaaaaacaaaaaaaattttaagctacactcgtctttcagaatatttaatcatacttgatgcaaaaagtttttcccaaagaatcaccacattttagcactgaaaaagaccttagagacagatgatctgctccaccccctcatttacaaatgagggatgagaagacacattttctctggtttccatggcaacagtcatgtctctagaggcttttttgttgactgtggggattctataacctctaaggcagcaggcacatgccactctcttcaagttaccattttttctgcatgggtaaatgaatgacaggtgggcttggaaaatgacatttccagcttcaatggaattcagggtgatattagaatgaagaactctgaaacattccaggttagaatttaaagtagtagaaaaagtttaatgtttaagtttggttagtaatatgtaaattagttgtatctgttcaaggttcttctcatgataacaagactacctactccaactcttactgcctaacagtaaaatctgggccattaactcccaagctcacattgtacaatctgtgtttaatttcccatttatttgacacaggttgtggtaaatatttatcgtgggtattttaattcctttcataaaaacacaaaattaaaggcttggttactcagcagagggttctttttactctaccattcttttttttcttgagacagagtctcgctctgtcgtccaggctggagtgcggtggtgcgatctcggctgactgcaagctccacctcccgggttcatgccattctcctgcctcagcctcctgagtagctgggactacaggcatccaccaccacgcccggctaattttttttgtatttttagtagagacagggtttcaccgtgttagccaggatggtctcaatctcctgacctcgtgatccgcccgcctcggc

SEQ ID NO: 340 - DNA, 6162 bp, Homo sapiens; identical to SEQ ID NO: 339

SEQ ID NO: 341 - DNA, 6162 bp, Homo sapiens; identical to SEQ ID NO: 339

SEQ ID NO: 342 - DNA, 7244 bp, Homo sapiens
aacagaccaaaataatgctgcctttagtgtttctgagaaggtaacacatgaaacccagtttcccctggactgtgggatattgttttgagaacctatttgtgggggaaggcaggtcagtcacacgttcaaaagttcacaaattaagaacatacaaatgacaggaccaccaaatttagaaaatgtcctacaatgtgcattttattccatatcattatacaatgtttacatatagttaaaactctcaagaaaacgtcctttaccagttgtatgtggtgtctaaatctttaacatgaaggactgaaaagagtggaaatccacactgattgttatcctacagattgtcatgagctgcacgtgtgccaatcagaaaggaatggaagtctcggaagagcagcgtggcttacagacccttggctttagtgaattcaggcatgcgggatcccaatccacacctgattgtgtttccaacattaaccttcctgttgactctatcattggcactttgaatggaacttcttctgctttagtgaggattcctacgctgactaagcacactgtgttgctaaactctctacaaagtgtggcagcatcaacccgggaaatggcacatttgaaccaggatcgccctgacatgggcttgcctttttgtatgtgttttccccaccccctgacctagctggtatcttgtggatgtttctgtgacagtggtaaaagtaaataaattgcatttaaggggtaagcaggtgtttaaaaacaaaacaaaacaaaacgaaagaatgtggtcgcagctaaggaggttttcacatgttgtttaactccagtaaagtctgatccagcatctgatgcatactaaggttttcttctttggcatgagccactttctctgtggtgagattagaaaattaagtcatgaatagctgtgctttggacacaatggtggtttgtacatttaggcaggcaaacatcaatcacaaacacaggatgagatgattagaactaggcatgcttgtaagacattactcatttctagacaagaacctaagacggaggggagggcatctttgacccaaaggagccatggcacggattctcacagagcagtcaggtgcacctccaccaacaattcactgaggataaaatgcacgtggggtttggtgaaggttcactgacggtgtgccgtgggaacagggagaggtaaaaaccaaatacagctgcagcactgttatacaaactgaagaagttacgaacagcagacatttccaaggtacaggcagttaaaagtctgggagttgtgcggtaacacaaactcacaaaagcaaagatgacataaataggttttctgagaacttttaaaatgatttatttctgttgctcataaaaaattgtcaacatgtttcatgcacacttcattaggacattctcttaatatttttatagtgttctatttattagcatgacattctccccagactccaacagcaccattagactgagtaaagcatacctttcagacaaccaggggcttctggcatgagttcctgttttcaaaagctattttgcccaagcataggtacatttaatcatatttcaaacactataccagatatttagaagttaggaatatgagtatctgataggaatatatacacacacacacacacacacatatatatatatatatacatacttaaagtaggactcatggctgtcaggaaatagaaaacattttttgggggggctcctcattatttatcagttcaaacaagaggacctgctatttcaaggagcagtgctgaattgatataagtattctaccataaaagctgttttgtgattaaagagaacgtaattattccagccatatagagaaacaagcaggcaaggccagcctttcagccaattccttgcatttgcatttctgcagaaagcaactgttttcaactctattagttgaaggtaggacagtcttagattttctgcacatgggctccacgcctagaattcagcccaagttttttcactcttaagtttaatcctcattcagggccagctttagttcattagtgaggcggcgattttgctcaagttgctggtagagttgatctgtacaggtcagcaagcaggttagcagaaaagaggcagaaggaagacaggttagcagacttggtgagaggcagttaatagagaacacaaagagacctcaagcaggacagcaactggtcacttgctgagcagtttactcttaccccatagtcacctgtcctgtatccaggaagggtagaccctaaaaagcttggtagacttaggaagtgtcagaatttctctcttggtgaggaaaggaggggaggaggagcaacaggataagaggaggaagaagagtgaatgttcctcttatacctcactaaaccactttgtgagctgagccatacatggtttctggcaatagatttgggaatgcaggcctggctggaggcgagcccagcgtgacatccaccccttgctagggctcagtgttgaacttaagtgaaacatcaacctgcccagtgctgcccacctcttccagaacccctttcctctccgttcacagggcaggctttcccctcaggtaggaccaactgggggttactgcttttgctgcactgaaattttttgaaatttggaattaagtctctgtccttcccccagtcaccacaatacagggtacacattctgactcctgtctagctttgatagtgttatccattcaaacagcaaaagaacaagcacttgtcaccactcaacactgatttagaatttatctgcttgctttttttgttttttgagacttagtctcgctctgtcccccagcgtggagtgcagtggcgtgatctcagctcactgcaagctccacctcccgggttcatgccaatctcctgcctcagcctccctagtagctgggactacaggcgcccgccaccacgcctggctaattttttttgtattttttttagtagagatggggtttcaccgtgttagccagaatggtctcaatctcctgacctcatgatccgcccgcctcagcctcccgaagtgctgggattacaggcatgagccaccgcgcccagccctatctgcttacttcttgaagaggatggcattcatgtgtggtgctaatggatgtgtataaaatgaacgaaacttgcaacacctacatgaagaccagcgtgatatacattttacacactgacacgtgatctgcttacgggggaaaacaagtgcaggagtcagtctgtatctgatgatccaggggacatccaagctatgacaagcaagagcccggtatgcactgggaacagctggaggatgcacggtggctttgaatgctggtgacaacttggacctaaaaatacttcatgatcttgaaaagctaacagacctacccctagggaaaatgtgcctgcagcccccgggtctgtcaggagactgagcagttctcacattaacattctcttataaatggtaggacatgggaggatgctatgctcgttatgttttctcgcttggaatatctgctgctctgtcctctttgctcatccacattttttgaatatgccaaaccccagtcaaacgtccgctacctcctccagggagctcccagtcagaatggttctctcttccttgttgcctccaaatacacatgcctattagttcggactcgcttcactcctctatctccccatcagatgcccagcttattgaggacaaagagcctttccagcccatctctttaccacacccccactgcttcccacggtgttttgcacgtgacatatgcttgggggttccaagacatatatcccattactacattcacactatggacataggaagtgtcgccatgggtggggagcttgtctcagtttgctgagcccaaatgtttggccaggctagaatggaagaactttggagaaaatctggagaatccagagggtcagtatgaattcagcaggaaggacagtggtccctccgacagcctcctctggatctgctctgcttcagctgctgtggagctggtgtgcatgggtggcccaaaggcagggacaagacatgctcatatccttggaagtgttttcccttccggttctatggagactcccagctgtctgaaacttcaagtgcccaaactcagtgatgcttttggtttggcccaccagagcagctgtagctatggcctggccctttgaaccagaagcctggttcaaatcaacagttgaacaagaaatcaacaatttcttgataaacttgagtttatcaagttttcctcttgcacatgcataccttgggctactcctgacctgccctcccagtccattagtgccccacttccccttgtagagtgtacttatagaaagtgcgaaagtctctggaaggatttccaaaacacagatgtgcctccagaattacatgaacatctgctcagcagaactttcagacttggcattttgtctacatcaggaagcaggatttactcagagaagggtacacttctcttattctgaatttaaaaaagaatgaggaaggaatcatagtcagaagcaggcccaaggagccttaagaaaagaaaagcatgaaatcatggaagtctttataaactcaagggagagacattgtccagattctaaaattccaccatactatgactaaaatactttaattcacagctttctttaaaaaaaagtatttcctctatgctttgaagtctctgtagagtgagaatgacactatcttctgagtttgtccaaatttatttgagtatggtggtatatcagccctctcgggctaaaaaaactatatacaaaacatgcagatcatccatgttaaaaaaaaaacaggagaaatatatagctagattgttgaggaaggagaaatgttgggaattataacactaaagtccatattagttaaagttctattttttgcaatgtatttttttaaaaaaatcacttaattgctgtttgtgaaataaaacagaagcccaaatgaaatacaattgtcttctgaacaatttccaccaactatctttttgggaaaaaaaaaaagaaactttcattgctatattttaaaaatgtccacaaatgaaaacacagccattgaacacaaagattatgtacaatccctcccaaagagtatgtgctaaaaagcacaaaacaaatcacgactaaacagagtaatcatatttagaaaacctaagatgtcattttcatgatcaaaataaaggtggctgagtcatgaatatacttcaaaaaagcttgaacttttctttgtgctataaaaggatgatcgacaataaccaaaacttacattgtttgaatccaagttctttttcacccttctcaatgtataacttcctagtaatatgggacagctacagaaccattcatcatgagcctttcattagttagccaggtcctcccaagtaaggccaccgaaataatcaacacagaggggtcactacatcccgagctaaacctccagcaaaggaagacactgatcaagccagacctttcaactctcaacaagcaatgtcccctgtgtgacccagactgcaaagcagagccatcacaattcccccaaaacccccccagatgtccagacctcattctaacctttgaaaatcagaactctgagagggaatgcaggcctgggtatttttttgaagttcaacaaggaactactgctttagaaactcctgatataattctgtatagtgttcagtatttaaaaagaaaaagcagcagccaaacactaaccctcatatgtgtgaagcagctttgtagttttattcaatgttgaaactaaaatgtcaataaataagaagtaaaaagaatagcaaacagaaatagcttacacagtgtttatttgacactgaaacgaagagcttctgtacaatagaaagcacagtgtgtgcctggctctaaggcaggatgctaagagagagaaccagggtcagctggagaatagacaaatgcagagctcagagaggtgggacatccagctcgacgagggagtcttgggagaagtgaagcaaagaaacttatctgcgtgaagataaaaaggtgggaggaaaaaaaaagtggcacaatgagaaaaaaaaaaaaaagaaaggaaaccaaaccaatagatgagagcacttgaaacacagacaagaagcagtcatgcaaaccccactgccagccacacccttggaaggacatccatcttcccacctgaggccgtcacaggccgcctttcggcaagggtccattttaagaagacccatgaacagaatttaaaaacaaaaaaaattttaagctacactcgtctttcagaatatttaatcatacttgatgcaaaaagtttttcccaaagaatcaccacattttagcactgaaaaagaccttagagacagatgatctgctccaccccctcatttacaaatgagggatgagaagacacattttctctggtttccatggcaacagtcatgtctctagaggcttttttgttgactgtggggattctataacctctaaggcagcaggcacatgccactctcttcaagttaccattttttctgcatgggtaaatgaatgacaggtgggcttggaaaatgacatttccagcttcaatggaattcagggtgatattagaatgaagaactctgaaacattccaggttagaatttaaagtagtagaaaaagtttaatgtttaagtttggttagtaatatgtaaattagttgtatctgttcaaggttcttctcatgataacaagactacctactccaactcttactgcctaacagtaaaatctgggccattaactcccaagctcacattgtacaatctgtgtttaatttcccatttatttgacacaggttgtggtaaatatttatcgtgggtattttaattcctttcataaaaacacaaaattaaaggcttggttactcagcagagggttctttttactctaccattcttttttttcttgagacagagtctcgctctgtcgtccaggctggagtgcggtggtgcgatctcggctgactgcaagctccacctcccgggttcatgccattctcctgcctcagcctcctgagtagctgggactacaggcatccaccaccacgcccggctaattttttttgtatttttagtagagacagggtttcaccgtgttagccaggatggtctcaatctcctgacctcgtgatccgcccgcctcggc

SEQ ID NO: 343 - DNA, 7244 bp, Homo sapiens; identical to SEQ ID NO: 342

SEQ ID NO: 344 - DNA, 477 bp, Homo sapiens
gtgagcagtggccacatgtcacttcatcctggcccaggtactgcagctccaaatcgtggggattctgtaagagcttgctacctgttgactgaggaggcccacgagttgagcaaaaagaatgattcctcagcagtcattgtgaaattttgtgggccacaagtattgtgcacacatgatccttgatttagagtcaacctgatgtccattatagctgtggaaaggcagcaggcagttgtgtcgctcttcacaataaggaacacatcttgctttcagcatgtgagaggaacaaaagcattgatgtaaatgtgcctcaaagtgagaactgaaaacattaacataaaataaaaaagtcaaataagactaagttcttacaactacctataaaaattgaattattacaactaaagcagcaaatcaaaacatctgctgaggttttctggtagaacaacaacaaaattagttggtgcccatgttcag

SEQ ID NO: 345 - DNA, 477 bp, Homo sapiens; identical to SEQ ID NO: 344

SEQ ID NO: 346 - DNA, 477 bp, Homo sapiens; identical to SEQ ID NO: 344

SEQ ID NO: 347 - DNA, 6771 bp, Homo sapiens
gtaatttactgaaatgcacagcgattacctgctcacccagccctgatgtaattaaaaatggcaggctaggggctctgtttcccccggctctggcagagaaacctgggtttcgacttgtgaagcttgaggttggatgtgggaattggcttggagtcataggcgatgagagggacattaggatattatgaagcccgtgaactcaactcctgagaaggacgcagcagagcgagagaaaaggtatcttcaaaagaggctgatgttcagtgggtacgggcttttcttttgggatgaggaaaaaaatgttttagaacttgtgagaggtgttggttgtgcagcatcgtgaatggactaaatgccaaagaatcgttcactttaaaatggttaattttatgttgtgtgaatttcatcgaaaaaaaaaaaataaaaagggtgaatcccaatgaacccgggtcgtttacatttcagaagctctaatgcctaactcagggtttggctcagagtaaatgcttaataaatgtttattgaaagaacaacctaacatttgcacagtcaacaaagctctttgttatacattagctcatttcatttttaaagaatcctctgaggtgggcaggggtaagcattctcgtgttgtaaaggggaaactaaggctttgagaggagtgtggcttgcacagtgtcacgtagctagtggcagcactgccagaattcaaacccaaaagtctctggctccaaagtctgtgcttgtaaagcgatactattttgtctacctcatggctttcaggatgggaaagaaagcaatagggttttaaaatatgttctctccccttcttttttttaagggtatttattactaaaagtgttttaaaactggaccactgagtaaagtcactccatctcctactgttcctagcacagtgcttgataaatatttgctggctcattcagctgcagctgcagagacctacctgtgtttgctgtggcgactgtccgggccaaagctcaggcagctggaagtatcagtgaagccagaagattctagctgttcagggtctgtgaggaggagtcaaggtctggggtttgtgtcctctggcatagcaatggcactgcaatgggggagcctgttgctgggctgggccatctcgccactgtcacctgcctgttgaggggtgacggtggttgttgagaggctggatcagaccccagaggtgacatggatgtggcatatttgttggacttacacagccttgcattttattttcatctctgttccttcctcccatgagatcttgggtggtgtttatcaaccctgagtaatcgtttctttgtctgcaagatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcagaacagagctgagtgcagaaatgaaaatctatggctctgtgttccaaaacgatgaagaatttcaagatggtggcagtggtaaaatctttctccaggaaaaatctgtccttggcccaatgtgtaaacacttgctgaggaacttggaataacttgcagtgtcttgcagtattgtgaaaccagcaacttgttcacaattcttctgaatttcttgggaaatttgaagtggagtacctgtaccaacatgaaatgacacgaatttaagtgacgctcaacaacgaaaagcaaaaagaaccaaagaggaagcaactgaaacaacatctggatgtatttaaaaatatacaatgcctccaaaatcaggtgtcattaatgaaaattctgaagaaatgccaccggacatagccaacgcacctacgctgttgttattcatttcctgcttttcacagaaaacaattttgttgcatggaagatcgtgaacttcaaagggcagaggggaaactgtcccttggcctctacccctccaaggccccacttttttgtcaacactccttggacgcagcagaagtatgaacataatatggtcctgaatgaggctgagtctttgggcgcagaagacccgggttaataaaaataggaaggtaagaaaagaaaagaaaaatcaagacacatcataggactaaattcctattatttatccactcaggattgaccacccctttgggccagatagttgtacccccatgtaccaggtgggcacatgaagacacaagaagtgctgtgatggttcattttgcacgtcaccttgcgtggagtatgccaactcattgtttggtcaaacactagtctggacatggtggtaaaggtattttttagatgagattaacacttaaatcagtaaagcaggttacccaccatactacgggtgggccctgtccaatcagttgaaggcattaagaacaaagattgaggtttcctaaagaagatggaattctccttgagactacaacatagaaaccctatctgagtttccagcctgttgccctgtggaattcaaactcaggactccggtctatgacattaaccctcacttaacttttcagcctgccagcctgccctatggatttcggacttgccagccacacaattccttaaaataaatctctccgtctctgtctgtttctctctgtctatatacacacctgcatgcatatatacatatatatatgtatgcatctatatatttatatctaatctcgtattgcttattggttctgtttctctgtagaactctgcctaatacagctgaagatgtattctctttagaaagcttgcaattactggggaacaatcagtacagaagtcgacaattacagaaaggggactagggtaatatggtggccaatgtccttgtgagtagtggtgacagagggcaacaagttagagactgccaagggaaagtcaagagcaagggaaacagagatgaagtaggttcagccaggccccaccacctacccagactaaacctggagagtctcttttccctttagtcttttaaaaatattttatttctgtacttcaatggatgcaagcccctaagtcctgaaggatctgttgtttgttgtgttactccaagcaagtattagcctagaagggacctcacctcccaacaatgaaatgcaactcttacattttatagattgggaaaccaagtctctgagagctttctattaaagtgacaaaggtactggatcatggtaagcaggaatatgtacccaaaggagtaatagcagctgttcatatgcattttattctaatgcgccttcctgtgatcatgttaaatgaattcctgggtttttaccaaacttgactcttttgagaaagaaccaaaggagctaaaccaaacaactcttggggatggatctgcaaatgttactcctgagctatgggggctccaggtccacctcacattgccccctgcagtcaccctcatccagccctagcccccaggcagattgtccctgcagactggcaaagtcatttccaggtgtggtctcagagaacctctctctggaatggtagaagggtttgtagccataagagctgatatcaagggggcttctagaaatctagaaaatttaattccccagaatgtgcctgagagttagtttctcctctagagtccttttcttaggaagcaccggagtccatgcttgctcttatatttttatccaaatatcacctctattaaggcatcaaagtcccgtgagaaacaccagctcatgccctcttgtcctccccgactcctactggatagtagggacagaaaagtggagattattccgcattttatagaaagagaaaccaaggtgcagaggagggtggaactagcttctgatcctaggctacacccctggcaaactgggaaaggtgtgtcaggaggagttgccacaggcattggccccaggaaagccctgctttgtcactttgagaggacagggcaccacctaggctggccttgccaattagaaccagctctgctgctccaaagacacccaggccagtgaggggtccacatgtggacaagctttaaaatcataattcttccctctgacagttccctgaggtccaagacaacctgtttggtagtgatgctctgtgaccctctggctccctatcccagggatgtggggtagagctgcaccctaagtctcttcttactgtgggcgataaggattgcagccattagccagagtaggggggagagacatcatctgctaaagtaggaagggcatgtggtctgaatacctgaaatttaatcccaatcctttttttttttttttttttttttgagatggaatcttgctctgtggcccaggctggagtgcagtggcagaatcttggctcactgcaatctccacctcctgggttcaagtgattctcctgcctcagcctcccaagtagctgggattacaggcatacaccaccatgcccagctaatttttgtatttttagcagggacagggtttcaccatgttggccaggctggtcttgaactcctgacctcaggtgatctgcctgcctcggcgtcccaaagtgctgggattacaggtgtgagccaccatgcctggccatttctttttttcttctttaaactagctgtgtgaccttagataagttactgaacccctctgagtctcagtttgtgcctctgcctctgtaaaacagaaatagtaagaataactacccccaggggctatcagtgacttcacacaaagtcatgaatgtgctcatattctgtagactgtaaagcactctaccaacattcactgccattctttcttgatatgctttaaaggagatgggggaaagaaaggatccagagctgggaaattctgctttctcaaatcctttcttgttacagtgaggccgtagtccagagagtttaagcagacagctctaagtcacagagggcaggaggcagggtttgcattgagcagtgagggtgggtagggaatgaggggactgtgctagcgcccagagactggaccacgatgagaccctggaggaaccctgcaggagggtattagggcaggggcagcgaggtagggggagccaggtgggcagtgggctaaggacacagtgctgtcgagtggggatatgccagccctggttaccaaaacccacgtgggggtttctgagttcaaaggcatgtggatggtgcagccccctgctgagatatgactgcagctttggaaacatgataaaataaacacacgacgtgggtcttcagaccacccccgattagcagctaaagaggtggatgggtagaagaaaaagcagaggttttcaaagaacaaaaatacaacaaggcagcacatccgtccccgaggttgagaaatgtgggctgcactagtttccgcatcatcagaactgtgcccgagtcagcacagttctgagcacagggagaatgtagagcacgtggggcagggaggcagggtgcatgtacctacgaagtgctgcccccacacacatcccttaaaggagagttaccctagaaatgatctgaggattctggtaacaagagttgtcattcaagataggcctgactcatttcttccatgaaggaggaactgaacagtcagcagcagagattagaattcttatccaggcagatcttgagtgcttccctccctcctaccaaagtattctctcttttggcatctccctgccttatattttgccattacgggttgatcctgttggcttgtcagtctccaacagttctctatacagacgcaaatgttctggagaggcaggccacaggtcagccccagactgtgaacccagctcaggcagccaggacccaggactggttccatcaggggcatgagggcccacaggagtgagcgagggagaaggatgaggacagtgattattgttccccctgtatggatgaggaaactgagactcagaggagtaaagaaagcaatgagcagtctgaggttggggaaggccaaacctcacttcctcctcccaaatcatgtgtcttcagagtacattcaagggcaactccacgctctgtgtttcagagaaaacaatccttcatggctgtgcccacgctctcctcccacaccaccagatgtgcaggcagcgtggggtctctccagcatcccctgttcagacggcccgttcggaaactggacataactgtgacttgtgtgcctggctctgaataatcagttaggccagtgaaatgggagtctctctgtgtgtctggaatttgaactgagaccctaagttgggaccactcagaagtctgggagactcaagagtgaggtggccattacagagccacacacagcacaaggtattaagtcaggagaaactgaggcagccagacagacggggaagggagcagggcacagaaaaaaccaatgaggagagatacccaggggagaggccagagctgcctgatcaaggacgatgcccacctccaggacagggactcttaaagtctgcccagggatggcagggctgccatggagcagtatcccctgagatatggctctcatttttctgctttcctactggtgtgtttttttgccactctctagccctggctgtaccactgaggactgaattttaacaggcagcaggaaactgggattcttag

SEQ ID NO: 348 - DNA, 6771 bp, Homo sapiens; identical to SEQ ID NO: 347

SEQ ID NO: 349 - DNA, 834 bp, Homo sapiens
ctctggcttccctgcttccgtccgggcggcctcggggacactgagcagggccacgctgtagggccgggcagcattgtaaggctcagtggcaaagtccagggaggccacagcaggcgggacgccctgtgcccacagctccagagtgagactgtcacctgcggggccgggggccctcccctctggcctgcccacctccagccccagcctcccgtcctcaaggtcctgctgagtgaactgctccaccagctggctgcccccgggctccgtcctggctcggggcacgcggaccacgcggccatgccggggtccctccaggaggcggaagcgcggcacactgcctgtgcggttggccagctcgccagcatctaggacggtggggtccaggcgcagggtggcaccctggggccatggcccacctgcccacacatgcagcagagccctcacagtgacgttcactacggctgatgcattgacacccctagccagtgccaggactctgaagtggtcatgagaggaggagaagttggtgaaggcaaagaccacctcgccctggtctatctggaattggctgaaggccgaggtgggccgcccgcccaccaggagatgcccatactggggtccctggatgaggcggtatgctgcctctggctcctcccgatctgaaaccacccggagctgctgctggctcagtgaggagcgccccaaagcttggggcacctccaggggtgcccgcagctgcacctcgatggcggatggtaggatgtccacagccagggacatgggcaggggtgggcacgaaagtggaagccatcctgctgggtgcccccaccgccg

SEQ ID NO: 350 - DNA, 834 bp, Homo sapiens; identical to SEQ ID NO: 349

SEQ ID NO: 351 - DNA, 834 bp, Homo sapiens; identical to SEQ ID NO: 349

SEQ ID NO: 352 - DNA, 834 bp, Homo sapiens; identical to SEQ ID NO: 349

SEQ ID NO: 353 - DNA, 834 bp, Homo sapiens; identical to SEQ ID NO: 349

SEQ ID NO: 354 - DNA, 11399 bp, Homo sapiens
ttgcattgaccagacgtcccaaaccggccccctgctcttgcccctaactttaatggaaatgtttggcttgctatgaagcatactgcaggagaaggctttgagagggttttgctgtcgttgttgtttggggggatttttttttttaactgtaaagagaatatctgaagaaaatgcatttgaagagcatattggaatagcccagattggtttgtgcgcctgcaaggagctcttgggccccctcccctcgctgccaacgctctgccccgggggctgaagtttctctctgcgtttccgcttgaacagcgtccagctgcctcgcctttaaaatgccaggacggccgcggctccgctcagagccccctctcggctgctggcccgggctcgcccgcgccgctgggggctctgactcctgccgagccgggcctgggcagcgccccccgcgccccgcgagcccgcgcccccgtcaccgggaaacgccgtagccggcgatccgcggtcgccctgggctcggcgccggcccagccaggaccccgggagcgcacgggacgggcctcgccagtcacactccagcgcccccacgagccagcacagtgcctgctctcagtgaaaggccactgttctccttgggtgacccccatgatgcctgaccgctcctcgtgcctcctggaacagccagggtccttatgaagtggtgaccactccagtcagcaggggtggaaaatggtaccagtcaaacccgaggcggaggaggagcagcccgcagtcgctgccgcgagatggaggagcccacgcccgagcccgtctatgtcgacgtagacaaagggctgaccttggcctgcttcgtcttcctctgcctcttccttgtcgtgatgatcatccgctgtgccaaggtcatcatggacccttacagcgccatccccacatccacctgggaggagcagcacctggacgactgaggcacagcggctgtggggactggacctggcgctctgtgggtggctgtgccccaggatgcatccgtgtgttccctgccagcctgccatcccacagaggcaaggaatgaatctggccacccagggaaacagaaggtgcagcttagccctctcagccctccctcgagcaccagcgtggaatgcccgggtgccgtgggtgtcgcaaccatggaccagccaggggaaaagagccctggaccaggacccaggaggctggggttccagtgtggggagtccctgtgagatgatagggtagtcaccttcccaggttcctgggcaccttttggaactggatccagcaacagacaccccccatccatcacataacagtggtcttgtcttgaggagactctcggtcctttaaatgcaaagtagcaatggaggctcccaaccaagaggtcccacctgaaccccagccccctccccatggactagcagtggtgtggcagtgaggggggaaagcgggttgagggagtctcacctgaaaattcacaaaacgcacaggatatgggctgcttccaagcagtatttttttaaactaaaatatagagggatatatttttcctgttataaataaaatgtacattttagaaacttgggaaaatgcagataaatagaaagaaagggggaggaaataacacttataatcccacctcccggaaaccaccattttgatatattttcttccagcctttttacttgtattttttagtcaaattcatactctgtgcatgatgttgtatcgcctcatatgatagcaggaatacttccccattacatcaaacactcttcttagctgccagttttagtgaccgaagggcatcccatcggttgggtaggtcatggttaaaaaatcatctcctttggttgcatatttaattattttccactattttttcctcacacaaaatgatttcgcccggtaccctttttgggggtgcacagtccatgagatgaatattgaatggggagacctgggttctagtctcgcatttaccagtcaggttacaatgcgaccttgagcaagtcacttcacctcccagcgcctcagtttcctcattgtaagataggaaaagccttgtcatttttaaaattttattttttgcatatacctcatgtgaacgaaaggacagaaaggggagtgaatatactatgaatgtgctatagtcggagttggggggcaaggaagaagtcatcgatgatggctcttctcaggccctccctcctcccacctctttctgccctccaccccactcccactccatcacctacatctatgaccttgcagcaaaatcattagagcagagcctacaaaaccggccccaagtcccaattcctctacttccttgttagaggaccccaaataactcactcagcctctctgagccccaatttcctcacctgtaaagtgagggaataacatctacctcgcaaggttgttgtgaggacgaaatgagagaacatgggcaaacatgaatgttcttgaattcaccaccccaggagaagccaggggtctgagctgggaggagcagaggttctgggtgccccctgcccctacagagcctggcaccttcagcttttctcaacttctgagggctgcttcctacaggccaaatctcccagccggaaccacttggtcagaggaacactcacagcagcctttcccagcacctgacctcaagggatatggcgtctaccaatttacataattgcctttgtcatcagttttcccataacatggtacgaagttaaatgagagcacctgagctccccttcctctgagtgcatttattccatccctccaagctgtggccttccatccccatccaagagacctgcagctgtgaagaagctcaagacttctttctcattgcctgcctcccagccattagtccccaccacagcccaggccacctggaaaatgggttccaaagcactatcactactaggtgacccctgaatgtggacaaggccacagctcttcaggcagcatttcaggggctatccagttgtcatccctctcatacccctctcctacccacccctatccccactattgtggaatgcacgaagggacagctggcaaaggcagtgaaccaagatgcagggaaggccctgtatgatggggaggatctaaagcaaaagccttttgtgcattgcctcaggttcagcagcagcagccctcactctgaagcctaccttgagaagccaggcatttctgtgaaaagctcatcagcatgcatttacaatgcaaactagaaccaactcccagtcagctaataacagaccccaggaaaaagaaaaggtcttccagacctccccgacacactttagaaccctcaggggtgaaaaagagggtgctccagggcagtgcaacttaaactgtggttgaaggacaaacagcctctgcaatacttgaggagcttgttagaaacccaaactcacagccccctccagacctacgtacagaatgtatattagcaagattcgctaggtggtttatgtgcacgttaaagtttaagaagcactgcctgagaatcccttggtcctaattaattcttttccacactcagatttgctaatgggtttcaccttatctcttgactcttgtttgatggcaacaggaaatagtagcatttcaggaagggtggaaaatataaaaagcactcccaacccaagcctccaaaaaacagcaattttcattttgtgtccatatattcccttctaatcattgtcctcatgcaagattttttttcataaagatgatctgctacataattttatatcatactctttctcctaacattacatcacaagtatactttcatgttgctgctacattcttcacacttgtcattttaatggccataaaacatgacatctagtgcacatatataattatgtagactcctattattaaatatttggatttcttccattttccctgttgtacatgttccaagcaaaaaaagaaagatcaagatagatatgatgaagccggggagcttgcttaagacaggggagaataaatacttacagtacactctctccatttaagagacacatggagcacatgggggagggagacctgtctaagaactggatcatattaaggagaaaaaagcaactggaatctcaggcttcagttgttgcattatgctgctgaagcatagaggagatggtcctttgtgatcagagcgtctcaactcgtttctggcaagctaagatgaactttggggttgtggatagaaagataaactgatctgcaaaagaaatgcacagaagtattgaaggctagaagttggcagacaagaaatgaaaagcatttagagaatgggaggcctgtgaaggtagccacaacccaggacttaaggagaacacaggctggagaggaactctccaaagcagagaatgggtggtgggttttccaggcaatggtgcctagtggccagttttaagttgttgcttgtactgtgctcagctacactcccttcatgttgccccaagccctctctaaagtctgataaatgatccaccactctgcagcagtggtctttgggacaatgaagacacctcggtggtgggtcacttagggaaatacaatctggaaggggccaacagtcccagagacaagtggggtagcagaaatatgcagaaccaagagttcagagtgatggtcactagaagaaatgtggcctctaaggatgctcagacaggtggatatgtatagtaggaccctagctttaccatcctggcatatcattcccatcatagctatttcatttttttccaattagttgctgaaatgtctacatgttcttatcgagttgaaagatcagtgtctccctgtctcattaaatttccagaacttcagaggctaaatcaatccaaaaggggctggccctgctttcaaacaccaagtgaagagaactacaaagtttggtgtgtccactagtgtggtttcataccccctaggtcttgctgttgaggactggttctgccaggcatgatcaatgaccacccacaatgtcctgtggcccagcctgtggagaggtgcccaaacagagttatctgggtccacatccatgtgcccagctattctgtccaatcatagcacaaagacaggttgcctgtgtccagagggacacacagcctcaggcacaccagcccttacttatgagcttgatggtcatcagcaaagactctctccctttaggagggttctccttgggacttttcagtgtcttggcaggaaagagatggcacacacgaagcactgattgaagacagtttaatgaaagaatatttacagaggttgggcaagggtatggaaaacaacagggaacagtaaaacacccagggatgacaaggcaaggtagctcatgtctgtaatctcagcactttgggaggccaacacaggcagattgcttgagcccaggagtttgaaaccagcctggcaacataagcaagaatctgtttatctacaaaaaataaaataattaaaaaaaaattacctggctgtggtgttgcacacctatagtcccagctactcaggagtctgaggtgggaggatcacttgagtccaggagtttgaggttacaatgagctaggatcacactactgcactccagcctaggcgacaaagagagatgctgtctctaaaaataaaaaacaaaaacaaactacccaggaacaggcaggccaccaactgttaccatctcttgcctagagagacaaggagaaggatctagaacccagggagagctatagccatggagaaggagtcacccaatggaagccctggccacagctagaggatcaaaactcctgcacccactgcagctcagtaggaagagagctgggggaataaataccttgacctcttgcctcctgccctccaatctcctgtctgggtcttccattggccaaaaacaacagaagctaaaggtcaggggaccctgggtgatacggtccacataggcagcacactggagcaaaagaagaaaaaccagcacaattcatcttattaccacttagcagccattcacaaactttgcttagatgggagaaaaatattttgtccccggcacaggggaaacataaaatctcaccagcagccatattgtctgggggtgatagcaatttagtcccactccctcctgcaacttaaatcataatgtagccagtcccgggtaagtggaacacttcctgtaaagcacaactgctagtgcccccttctgtggctggtcatgaggcccagagtggtaactgcagtcttgttctcccaccacccattccatagcccctctactttctggcagtcccttagctgttggagaattttatctggtggaatgacccaaatcttcatccacagaggattcaaattcttagtgccgtgtcttcaatgagttgccacagtatccacagattcctaaagaacatgaagaggccttgaagatctcacctggaagctctgtaaaattatcagaaagaatagcaggtgctctagggcaacactactcaaactatggtccacggatggacagcattggcatctctggggagcttgttagaaatctaatttcatgcccccacctcaggcttacagaatgaggacaagggatacagggagtaccaagtgccctagcgaatcccagggttccaaagctagtactccttgcccctattgtgtagcagaaaccccactttcccttggatattggggttaaccatcctgacagtgcagtgatctctttctctgccaatatttcaacataaggagccccagatggcacaagatcatcttccaatttaacagacccataactatattccctggtggaagcagttcctcttggtcactagagatttccaaacccacaaaacctaaggtttcttggttaaaggccatgtttgtgggatatgctgagatgaatatgctgtggtttgaatgtgtcccccaaagttcatatgttggaaacttgattcccattgcaacagtgttgagatctggggcccaatgagaggtgattaggccatgagggcggagtgaatggattaatgcagttatctcaagagtgggtttgttatgaagggggtgtttggtcctcttttctctcttgcccatgtgattccttccaccatgtttatgatgcaacaagaaggtcctcaccagatgctggttccttgatcttgtattttgcagcctccaaaatcgtgagccaaataaatttctattcattataaattacccagtttgtgttgttctgttttagcagcacaaaatgaaagaatgaaacaccacaaatggcagggaggggcaggaatggcaaatccatatctggaatatgtgtctattcctactgccctctatgatgaaagggattcagtgtaatcaacctgctaccaagtaagcggttggtctgtctcctaccacccatctctgggaatggtgccatatcaggggcttggcattggtctcattcattggaaggctacatatccagaagttatggaaaccaatggaccttcacaagggaaagcccatagtgttgatagcctctatcccttccactatggtcactctgttcatgatgtcattgagcaaacaccagagtagacagaggaagaggctcacacccccaggttgggtcatcttatccagctgatcgttgagagtcttttctgcagtggatgccctctgataggcatttagatggctcttgaatatcttgacacccagggccccttcaaagatgtcttttcacacatatctgcccaagactgccttggaccctctcttcccatcctgttcagttgggtcaacactgtgattctcctattggagatggttaggaattccatacagcactccatttgcaacagatacttctggcactattggatctgctgatcttaaggtccaaatggcagagtagctttcatcacagtctggatataccttttctagagccctgtattattctgggccccattcaaaaccagcaatcttatgatgtaaccagtaaatccatcagacacacacacaaatgttctatatattgcctcaaaaatccagagatccatcaactgctgagcctcattctttatggtggaagacacaaggtgaagcaacatgtttctcatcttagtggggatattccaacaggcctcagcctgctagaacccaagaagtttcaccaatgtgtcaggtcactgaacctccacatgtgttttcttcccctctctggcaagcatgtggcagtacagcacttgctagtcctcattcaccagatccaattagcataatgttatcaatgtagcaggcaatcataaagttctatgggctgtcaagatgataagggtctcatatcatatgacagaaaccaggagaattggcagatccctgaggtaatgcatttagggtgtgccgcagtcttgtaacaggtgaaggtgaactccttctgattatctgtattgattgtgatgcaatggaaactatttctaatatgacagttctcaaacttcagtatgcattagaatcaccgggacggctcattctaacacagctggtaagcccctagaatttttaattcaggtggtcttcagtggagttctataaattgtacatcaaacacattccaaggttaagctgctaatccagacctaccttttgagaattactgttctagtcaccaggtacaataccaggtgcacaccaggtgtcaggggctgagcggatcttctctaataaagataccacatccagaacaactcctgaaatggcattaattcctgattgtgtttatgaaaatctgtaggacccacctggcttttgcataagccagacaggtgacttaaatagtgatgtgattagaaccacctgtcctgcatctctcaagtctttgaagggggcacaattcaattgccctgaagatgcagaattgcttttggtttactattttgtcacaaagaggcagttccaagggcttccatggggccacttctacaataatagccctcactccatgggtccaattgtcacccttaataccaatgactttattcatcaggatttaagcggcaaattcaaaaggttcaatgaagagggtttaattttgggacaattttcagagggacaggtaaggtaaagagaatcagtaagggttgatgattaatccagggttaacaatgataagaagccattactgccccttgcctggggagaaaacagtggcaccagaatctagcaaagactgtggttatgttgcccacaggagcagtaggacatagtgggacacagccactgcccaaaccatggctcagcagggaaagagtaaggaggatgatgctctctgctgctttattcctctatattccaacctctgcctgcacctccactggccaatcctaaccagcagccagagagcatgagcctgggtgatgttgtccaacgaggtcagcctccaggtgcgcaaacagcagggcagggaaggatggagaatagatctggagggacaaagggagatgaatctgcagagggccctgggtgttcttcctgccaacagacctcagtcaggacccaaccagtgcacccaaaccaattttctaactttgactatttaggagggaggattggaataccagtttctcacatcccttggacttcttatgcaatttggtccactccctctccacccttctgcaccaaagagaggggcaccctggttatatccaactataccctttttccaaggaaaggagtgtccacttgcctcatctacataactaagaaggaccccagaattgagaatacttcagctgaccatacagaggctgctggtcaacatatacccccaaaaaagattacgctgtcccttagaagccacctccatttcacagcagtcatcccattaagtggggagatatgcggtttcactttggagataggacagcagctcaagctttccacgaatatatattaagggaagagagaccccagaaagctaaatgacttgatgacattcaggaggctgaaagttaggctacaaaaatagtgcttcagtgaccaaccttggtgcacacaggttttttttttttttccttttttcttctcttagattaccaaatacagcactaatatcatttgaaagaagagtttgcttgagcttatagctacgaaacggggaactttgtgagtacaatgccacacacatttagaagcaactactgtctaacaggggctttggacacaaagatgcatagagcacagccctgcccttgagaatcttgcttccacaggccgaaatcaaagtccacataccactagaccataaatggggagagtgttgtcctagatgctgaaagctctagaatccagtttcagctctgccactcactagttgtgtgaaatgaacaagtctctgctattacaaaacaaatatcagagaccgtgtggggtccaaagatggaggtaaagaagcaatattgcccttaggctggggtaaggtatggagtgggggcttccttggaactcatgccacagagggcccagcttataacagatacgcacatacaaatcaatttgttcaaattcatacaagcacctctatccctcgggcctcaggttggtgcagctcaacctgtactgcaaatatgagtaatactgtccaagccaggggagttcttctttacatccctgccctgtgtccccagaataaaagagactgtgtgaatgtcacgcaggactgtggcaggtccaaccctggaggtggacatgtcagtggaagcgcttaggtaagagaaaggaatgattattcaacttgttacacacttcctcctagccagaatgtaactgattcttccccaaacaaatgacatttcccatttatatcaaatatccactttcttgctttttttttttcttttttggcttttatatgattgaaaattggtaaaataggcaactgaacttaattatcattgcccttgaagagagttgatgggatggcaatatttggatgagaattaaagacataaattcatcaactacatacctactttataaatttttaaaaccaaactttatttccaatctgtggttctgaagggactcacaacatgtgccctcgttggcacatgggtctcataacctaaacaaagagtgatactaattctttactttggcaactaagtggacagtgaacactaagactgcaaagtagttttgtttttataaaatatatttaataagatttaattaatttttttgagctgggtgcagtgacacgggcttgtaattccagctactcagatggctgaggcaggatgatcccttgagcccaggagtttgaggccagcctgggcagcatagtgagaccccatatcaaaaaacaaaacaaaaac

SEQ ID NO: 355 - DNA, 11399 bp, Homo sapiens; identical to SEQ ID NO: 354

SEQ ID NO: 356 - DNA, 11399 bp, Homo sapiens; identical to SEQ ID NO: 354

SEQ ID NO: 357 - DNA, 11399 bp, Homo sapiens; identical to SEQ ID NO: 354

SEQ ID NO: 358 - DNA, 2795 bp, Homo sapiens
caagactccgtctcaaaaaaaaaaaaaaaaaaaaaagcaccttgagaaaatttctacttgtggatctctgtacaccgtccccattttgtttattaagtctatggtcccgtcctgtgggccccagagaatagtctgtagcattttttataaggacattgatccacctccccaaatgacagccccatagttactagatcgttctgtctagaatgtatgctgccttccttctgcatacgcatcaagcctgggcttcccagaccaaggctgtatgagggaggtggggacctggagcccagtcattccagggccaatcgcttccttctgtcatctggtacggccaggaatagaggaattctaagcatccctggtgactgagctcatatagaaagaggttgtgccttaaccaccccgaggaacaaggtgtacagggacagtctttttaaaaaatcttgtttgggtggtgggatgggggtggggcgatttctggtaaaaactggaaaacctgctaaatgaatgcttttttttttttttttttgagtcaaagtctcactctgtcacccaggctggagtgcagtgacacaatctcggctcactgcaacctctgcctcccaggttcaagtgattctcctgcctcagcctcccgagtagctgggattacacgcatgtgccaacacgcccagctaatttttgtatttttagtagagacggggtttcatcatgttagccaggctggtctcgaactcccaacctcaggtgatctgcccaccttgggatttgcctcccaaagtgttgggattataggcgtgagccagtacgcccagcctaacaaattctaaaagagctgtaacactgacagtctcttcatggtcccagttatttccaaaagggcacgttctgctctggttccttctggtgggttagcaacagggcagatccactagaatacagctctcaaaatctactgcacatggactcacccaaagtgctttacaaaaatcctgatcccaggccacattccagatcacttacatttgaacctcaggtccaaactcaggcatcagcatttaaaacattcctcaggtgactcccaacatgcagctgatttgccagccagccctctgcagtctggatcaaaggttctcaacatgaggtccctgaaccagcggctgctttgctaagaactgggaacttgtgggaaaggcagcgtctcagaccccaccccagatctactgaatcagaaactctgggggtggggccagcactttgtttcaacaagccctccaggagactctgaggcactagtctggtccagtgggtctcaaacttgactgcaacaaatggcccagagatctttttgaagtgtagagtctgactcagcaggtgtgggtggagctgagaggccagcaagatcccaggtggggccgaggctgctcatcctcctaccacattttgagtagcaaggagctaccaagagcagccgacggggtttcattctcgtctactggaagcaaccttaatagacaactgaaaaacaaaacaaaacaactgagatacctgtttctgccagaaaacccaggccattcactggtcagctgttccaaaaccagagttaagctactgcagctgttcccgcgtgcctgcctgcattccagtaaataatcccacgtggcaagtcagctcacctggttactgccaaagcatgttcccagctggtgtgactcagaggcacaccagaatttctttattataatttggcgatagggtcttgctttgccacgcaggctggagtgccgtggtccgatcacagttcactacagccttgaactcctgggctcaagtgatcttcctgccttagactcccaagtagctgagattataggcacacgccaccacacccagctaatttaaaaatatttttgtagagaccaggtctcactatgttgcctggtttggtatcaaactcctggccttaagggatcctcctgcctcggcctcccaaagtgccaggattataggtgtgagccatcatgcccagccagagcaccagaaatagctcccaactgtagaaggagcctccctgtagcgctgttggctccctccttcctgtggagtctccacagcagtccctccccaccatgaggccagagaggctaacagctttgctgtcacccaacagaaatgctttaagtactgaccactgctggagggaaaggctaccgctaacacttgggatgttttctgacagcctctgaaacttctacgaactgctgaggcataggatcctctcctaaaatttctcccagatcttaacgtcagggctgtctggccctttcatgagtatgtgggttatagtctctggcaggcacttgtgaagagtgtgactgattgacacttttttgccttggttgctgggaagctcagatctcccctctgcatgtcccttgcttaggacctcccatggtgtacttggagttgggacctcacctggctctcccttatctttccggctgccattttttcccctttctaactttctttcccatacacttatttgaaatattatctcacggtaacgaaataaagtgtctgtcacctcctgctgtgttgtcatcttgcatgagctatctaagttctctgttcttcagtttctgcatctgtaaaacgatgacaatgacagagccaacctcgctttgaggatcacatgagttaataaaggcctggcacacagttagcactcaataaatgttagttatgatttttattatattgtttacgtgatctcatttaagtccttt

SEQ ID NO: 359 - DNA, 2795 bp, Homo sapiens; identical to SEQ ID NO: 358

SEQ ID NO: 360 - DNA, 2795 bp, Homo sapiens; identical to SEQ ID NO: 358

SEQ ID NO: 361 - DNA, 2795 bp, Homo sapiens; identical to SEQ ID NO: 358

SEQ ID NO: 362 - DNA, 2795 bp, Homo sapiens; identical to SEQ ID NO: 358

SEQ ID NO: 363 - DNA, 650 bp, Homo sapiens
ccttaggcctcagccctatagcctgtggcgaccagatcacttcagcccaggaagacacaataggcccagttcttcacactgctggaaaccaggactttgggagtttagtgctcagctcctgaggaccaggggtcaccagccccaccccaggggcaccagctcctccactaggggctggcgcatcctcccgccccttggaggactttggccttctgacttgggcccacatccaggcaggcaggccactgtgtaggcctaactggccccctatcctcagctgcgatgcaggagcaacggtaccacactggagactgggcctggtttgcatagtctgcacgtttaatcactttaaaacctctaacattatctcatgtccattaaatagaaccagcaatgctgggcctgtttaaattacaagaaaaaaatcactgtgcaccaacccagcatcttacaaaaccagccgggctggccacgagggcagggggatgggagaggaggggaggggagggtggtcaggacaccagcacagggttcagccagagcttcggccttggctgcgccagcctggtggccagtggtggtggaggcacggagcacaggggtgggtcatgggacacaggccacaggaatcccaacaagcaagggctgcc

SEQ ID NO: 364 - DNA, 852 bp, Homo sapiens
ttcttaggttttacaggtaggcagttttattgtctacaaataatgacaattataattcttccttatgttcctcatctggcttgttgcaggggttagtagtgccgggacactgctgaataatagcttgcccttggctagtttctgactttaatgggaatgcctgtggcgtctgactctttagaatgccatcactgttggtttctgaaacagacctttatctagattagggtgtttctttccagacttaatttactaagagttttaataagggatggattttaaatcttacgaaataccttttcagcatctatagagctatcataaattcttccctattaattgaagctgaaatgaaggctcctgcacagccatactgcctcctcatatactctacatgcccctagtcccctgtgccaggaactgaatacctctgcagatagactaaaggtgaggcttcaaggtctgcctgctaggcgtggtgctgaacgccttctcaagctgcccaagcacatggagtcttggaggctttcctttccagagaaagaaagtaggaccaatccccactccctgccataataagaaagagcccttggggacagcagcatacagagcacagaagccaaagagaattcaggcggcacttactgcaaagccatcacagaaagcagcgaggccttcagactcctaggagaaacagtgattccttctactgctccatccccactgctaactctgggtccccacccctgtcctcccagagtcactctgatcctgctcatcacaccaggacatggagtctctacataaccacaggattcccctagagcctgctgttgccacagtgaccctgat

SEQ ID NO: 365 - DNA, 852 bp, Homo sapiens; identical to SEQ ID NO: 364

SEQ ID NO: 366 - DNA, 3587 bp, Homo sapiens
gcgaagagcgcgcagagcaaggccgccgccagctctcccaggaaccgtcgcgaggcgtcccctcggcggccgcctcagtttccctggccgtaaaacgcgggcgatggcgctcgatgccccgggagacgccggggtccgcgggcccttccggcaccgggtcctccttcaggttcgggcacccggctgcctccacgcggggcgagcgcggcgatgggatcggtccgtgctgcgctcagccccgctttcgctatccctctgctccaggggcagcaaaatcagcagatgagcccccagcgcgcctgcggcccacacactgcggccgtaacagttaaacagacggggaacattcatgtgcgtagagctcttcacggggcgatacagaaatgtgtcgttctaaagcgttaacgacctgcaatttgcatatcctccaacacatggattttactgattcaattatggatgtgtgcaaagaatctgctgctcgctatatgggaacactttcagtttcccaagttaaaacatgaaattgcacatcatcatttggatccccaaagaggaaaagaaaaattcacaacctgccagtgaaatactcaggccacttggatgaagaccgaggtcctccatagaatccaggtgttatttactaactaatcagaaattaatatcaaaataggacttaaaaataacaaggctgtgttattacagcagtctttccagttgtgtacgctttactaatctaaattgggtaacagaactggagaaaaggaagactacacagacttatcataagctgttagtgaacgtgatagaaatgcgtaatttgttaaagcgaattacagctctgatttgtcaaatgaggaggtgaattatcctaggatttgctatgctgttgtggcgttagaagattggatctttagcagcaaaggtaacctcaacaatattttctgcttaagaaagtgccttggttaaggtagaccgtgatatcgtctttgactaagctctctgggctattgattctgtcatattccaaaggcagtattggtttgaagccgaatctcacggtcaatgtcaacatgcaatccacaaagaccctggcgcccttccacggtatgcactaaccaaaactttctcactgtgaaatcctttttttaaaaacaagaaaacaaaaaacaaaaaccaaaaaaccttactgtgaatcctttcccaaggaatggtcccaccttcacctcggaaagaggcgtggcttgctctgtaagcaggtccaccctgaggagaccgctggtgcaagagccctgcttgcagaacacacagggggttttcccacattcttactggagtcagattcggcaaagcatttcaagcaactgctggacacttcaaataccactccctgttaacaacgccctgagtatctcactgtctccaggatctggtttaaagggaaacacagaaatggccaacagctccctccccaggcaggactgcgatttcacagacaacctataggcatccccagtctggtgaataaacaggagagtgagaggaaaacagcaatcattcaactccagtagatgtaaagcctccagaagaatgtgtcccgggaaggtcagaaatgtcatttttttcctccagcacatttcatctgccacattccgccgtccgatgtttgaggaaggagccccgcctttccttcaggggttcttgtcgccaagtttgatggtgacagttttcacttctgtgtattcggccaaagcgtattcacctctgtgatcacagaaaagaggaaaattcaaaatgggtacatcccttagccattgtgtagaaactgttctgaggcttcatcattccatcaggccgttggaggcttatgcaaaaggttaaaatgtgacgacctcatggaataatagccaggactataacagcactagtaagtgtcagtagctgcatatgtgacttaaatgtaaatatcaaggtcttcttctgtgtgatgcttttgaaatggccaggactaagggtttccctttagagaatgaaggggattttaaaaaaagtaaagaggtgaattccctggggtggcaatagagagcaaaacgagagagcctggtggacggtggggtgtctgtgaacgagggaggggcagaaattacactgggttgataacttttagatggcaattgggagctgcttgaagaggagacagaagaggcagaggcccaaagctattggctggggatgtggccagaggaccagtgggaagaacaccaagggcctgaagctggcctcagagtgcacagctggggaccagctgtcaggcagtgaggccagcctagggggcatgagagaagcagacgttagcacagagtggacatggggaggccacagcttttgggttcacatccttggtatagttcctttctttaaatcttgcagggctcaggtgatccttccctggcaccatgggccgtcttcagggtagcttcccttccaagacccaagaggcagctttggagagatttaaatccttctaagcgcttgatctgctgtcaggtgaagaaaaatgtgtgcttgtttaggaagagatgaaggtagaggtggccactggagtctctgtagttaaaaagacctgtgacagaatcccatctcctcccttagatcaatggttctcaaagtgtggtccccagaccagcagcatcagcctcacctctgaacttgctagaaatgtagattctcaggcctcccccagccctactatcgtaggcagaataaggatctccccaggtatccaaaattggatcccccaaacctgtgaatatgttgggctacagagtgaagaattaatgttgcagatggaattcaagttactaatcaattgactttaaaagagggagactctcctggatcatccaggcagacccagtgtaatcacaagggtccccaaaactggcagaagaagagaggcagagcaaaatgagattatagaaacaggttcagagagcagcagtgctggctttgaagatggaggatggggccaccagcctaggaatgcgagcagcctctagaggatggaaaaggcaaggaagtagattctctcctgagaacctccaaaaaggaatgaagcccttgattttagctcagggagacctgtgtcagatttttatcctacagaactataagataatagatttatgttatttaagccactgatgttatggtaacttcttgcaggagcaataaaagactaataaacttactgaatcagaaactctatggtggggcccagacatctgtattttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctgccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggc

SEQ ID NO: 367 - DNA, 3587 bp, Homo sapiens; identical to SEQ ID NO: 366

SEQ ID NO: 368 - DNA, 3587 bp, Homo sapiens; identical to SEQ ID NO: 366

SEQ ID NO: 369 - DNA, 3196 bp, Homo sapiens
gtttatttttataatttgtagaaaattgacatttagatttcaaaacttaaacaaggctattataccatgttcgaaaagcaagacttgttccaagagggcctattattatacatctgcctcactgctcaggacccgtttgtgactgtgtcttcttccatctcttcttcaccatcatcagtgggccctaaagaaaaccaccaaagcaaaagtagtatcaattttagagaatccattcccttagcatgcaagtgtttgttctgtggccactgtttgttacacactgaagtaggtacaaaaagatcaaaagcagcacctgcctttgaggagcttatcgtccagggacggtctagtctgtctttggcaggtactggaagggatgctcaatttcaaaggaaaagggtcacaaagatttcaaaattgttgcctcccattgtagttgataataattcatttttggtgaaggtaaagcctatactcatgtgcttttcatggcactaccgtaggcaaagaaaccggaaatactcaaaaacatctgggcacctactacatgccatatactggcaacagttcaatgactttattgtctctaaattagggaaatatgccaacaactaccaaaaaatgttacatttgttcaacaatttatggcaggtattttgctcaatgtattccagggggaaaaaaaagttgtaactccttcaattgtttgggaaacaattgttattgttgacttaatgtctgacttaacatcagtcagctgaattattgtattggtttcatcattccatcctgtgcaatacggcattttgattgacgggcatgaagaaaatctggccacacaggcacacagttagaaaagggaggaagattttaacagcctgtgcagataatggtggatgctctttttagatactatgctaaaacttgacaaatggtagcttcctcaaggttagatggcagtgtaaaagtctgaaaccttatcaatgaacttttcatactcttacttggtttatcttgtactttgaacaaatcttttacccgtacatgatttcgtatcatttggaaaactgtggttcaccgacttttgcagatcttccaaacgttgagccatgtaattacacatcaaaaatgtcacacccattaattcacatgcacataacattactattgagttccccagaaaagtcttaaagtactgggaagctggcaggttacggcagtggatacaagttttctaaattttaatttttgctttaaaccttgaattttcaattgttttccctgaagtgacaggctcacttcatcatgtttgagaagacaggtagctgcctctcaactgaaacaactgcaccagtgcatggagataaccacctaactcaagaatgcagacatgtgcaccccctttctgtcacccagaatatcaaagagacgtgtgcccgaggagtgatatttaattatctttactgctgcatccaggacactcttaagtgaaactggtatgcacgctactgggagtgcagagcagggaagaatgtaacagctattatttaggctgctgccttgactcctactgaggtgcccgcagttctacccactattgctccatcagtgcaaatgttcatactaaagcaagtaacaccttggtgttattagatgaaaacagtcttcggccaggcgcggtggctcacgcctgtaatcccagcactttgggaggccaaggcgggtggatcatgaggtcaggagatcgagaccatcctggctaacatgtgtttttagtagaaaccctgtctctactaaaaaaaaaaaaaatacaaaaagttagccatgcttggtggcgggcgcctgtagtcccagctactcgggaggctggggcagaagaatggcatgaacccaggaggcggagcttgcagtgaggtgagattgcaccactgccctatagcctgggcgacagagcgagactccgtctcaaaacaacaacaacaacaaaatcagtcttcaccttacagactcccagaggcccacaaaccatacagtagagaattactggtcttaaaaaatttctttttggctgggcacggggctcacgcctgtaatcccagcactttgggaagacgaggcaggtggatcacggggtcaagagattgagaccatcctggccaacatggtgaaacgctgtctctactaaaaattaattagccgggcacggtagcaggtgcctgtaatcccagctacttgggaggctgaggcaggagaatcgcttgaacccgggaggcggaggttggcgtgagccgagatcgcgccactgcactccagcctgggcaaaaagagcaaaactccgactcaaaaaggaaaaaaatgtctttttaatttttagctcccagctcaaacattatttccctaggaaacttccccaagacggcagtctgagtggctgtccccagttacattcatatcaaaacttgtaagacgtatttcagtactttttatcttatatccctagtgccccacatgcagcctagcataaagcaggcattcagatgtcagaacagttaccacttatcaaaaactcgctaatgttgagccttgtgctgtgttcagtctctcagcctctcggcaaccttttgaggtttgctactattgttatctcagatttaaagatgaggaaagacttgaagaaacttgtccaaaggcagagctggtgaagctgagatttgggcctcggactgcttggctctagagcctgtgttcctaactactgaggtatcatgcacacacgcaaatatatataggtaaaagtccacatggctatcgctagtgttcggtgcactccatggctgaagtaattctagcttcaacttttacataaaaccccccacagtgctgtaacttaactttcttcatgaaataccttttttttttttttgagctgcagttttgctcgttgcccaggctggagtacaaaagtgcgatctcggctcaccacaacctccacctcccgggttcaagcgattctcctgcctcagcctcccgagtagctgggattacaggcgcgcaccaccacccccggctaattttgtatttttagtagagatggggtttctccatgttggtcaggctggtctcgaactcctgacctcaggtgatccgcccgcctcaggctcccaaagtgctgggattacaggcgtgagccactgca

SEQ ID NO: 370 - DNA, 2905 bp, Homo sapiens
actcccctctcctcccaactgtgtccattcattcctgcggagtccgcacgtgggctgctcttcctctgggttcccgcccctgaaggcgcaggaggctgtgaccacgccccttttggagccttcctgggctcagggaggggctttgcctgcggccttgtttcaagtgtgggaatggcctcctgactcccaatccgaaacaactgctgagcacagaaggcagagcagggccctgagagtcagaggaaaatgctgctgcggggactggggagccccatcgggtgactccccagagatgtgagcaggtgcagaggctggaacaacagtgctgcaggaaagtctctcccgtggatgctgtggcctggggcttgggtgacgacgtgcacggctgcctcctcgctgtcacgtgctctgctggctcgtctccaagctgtgctgctcatgttccaaagtctccctggaggctttagtgaaaagccctttccccggtgacctggagtgtcttgctagatggagctggccaagcctgacgtcttttcctggccgatgcctcagtccttatgcaaagtgtgaacttggcctttacatccttctccgcagagcactgcaagcagccagtcccactggaacataagatgaagcttttgttcccatggctggatacactttggatcttggaatgcaataattacttcagctggatctggttcgtggagtacttggccagggctctgcctcatgccatggtcctacaagatatgtgaggaggtggacatctttgcgtagccctcctccagaggcaagtggattccttccataacccagagaaggccgcttgggaatgaggctgagaagccagactttttggcacacaaagaaaaagggagttttcaaagttgccgcaaatcatgcaggaagagaaaacaggacattagtggacactgattcttcccctctgctgaactctgagtccagtttaaatctttaataacataacacatggagaaaattgcttatataaaatgatcacctttcttttaaaaaaaaaaaattatagagactgggtcttgctctattgcccatgctggagtgcagtggcttgatcatagctcactgcagctttgaactgttaggctcatatgatccccatgtctctgtctcctgaatagctgggactacaggtggacactaccatgcctaattttttagttttttttttttttgagataggatcttgctatgttgcccacgctggtcttgaactcctggtctcaagcagttattctgcctcagcctcccaaagtgctgggattacaggcataaaacaccacactcagccagaagaaattatcatctttctaaaatcaaacttctcttatattctgggaacctactgaggaaggcacagatttatcctctagatgccagaaggctagaattgggaaagcttcgaagcttaaacagggcaaagcgtaggtcatagaagaatgtattatctattgctatgcaacaaattactctaaaactttaaaaacacaaacatttattatctctcagtttttctgggtgagaatctgggtatggctttgcttgctgcttctgactcaaggtctctcacctgtcaaggctgcaatcaaagtgtcggcgggggctgcagtctcatctgaaggcttgcctggggagaacacacttccaagctcactgccatggtggatggaaagcctcaggggtactgcaattgaggggagaaaatggccaacttgagccagggtgcaatgacatcaagaggcctgggagctgaggagaaaagactaaggagcctgaggaatggatgtgggtctggaagagagctggaagagtacatggtcctgggagcctcctggggaaagtgctttaagtaggaggcagagaccaactggttcccatggtgccaatgagtcatgtgagataaggactgagagttgacattaggagtggcagtggaggggcatgtagtgactttgactagagctatttccatgggatgaggagggtgagggaagctgactagtgtgggctcagtttatgctggaggagaggactgggagaataatgctccttcatgttcctcagttatgctgtaaaggggaacgagaagcagtagccggagaggactgggggaaggggcatctaggtttcatccatgcatctgatgggaatgatcctgcaaaggggaaatgaacaatgcaggcgagagaagcaagccctgctggacacatccttgagtaggcagaagccaatgtctggtgcataggcagagggctggctttaggtgggaaggatgggtgggaagatgagccggcatagaaggggtagagggggcttgcagaagcactttctgatggtgtctgtctcttcactgaaatgggaagccaggttgtcattgtagccacctcccagtggggcaaagaggagggagtgagatgcctcatgaaaagcaatgcttggggtctggtgtagagtaataactcagtaaatccattgtcttcttgcttacctctaagttatagtgatcacattttccagaccaaatatctgaacctggaatctggcaggtgccttaggggccaatgggtgtgactgattgaaaaatcagaatgtctcagaaacacctagacttttaatttccaaacaacagacatgataagcatccagggcctgtcatgtatattatggaacgtaatgccactttctttggcccttttccaaagcagatgatatcccagcaccagggaaaatggtttcaatatcaagttgggtcagcagcatctttctacctatttctgtcttcgtggtctttatatttgaaataatcattactattttatgcattctctccccatcctgcattacagaaggaacgttccta

SEQ ID NO: 371 - DNA, 2905 bp, Homo sapiens; identical to SEQ ID NO: 370

SEQ ID NO: 372 - DNA, 1577 bp, Homo sapiens
tgctgcaggaaagtctctcccgtggatgctgtggcctggggcttgggtgacgacgtgcacggctgcctcctcgctgtcacgtgctctgctggctcgtctccaagctgtgctgctcatgttccaaagtctccctggaggctttagtgaaaagccctttccccggtgacctggagtgtcttgctagatggagctggccaagcctgacgtcttttcctggccgatgcctcagtccttatgcaattttggaggtcagaagtcccaaatcagtttcagcaggatggaatcagggtgccatgagggccgctccctccagaggctccaggggggtctgtttccttgccttttccagcttctagagctgcattccttggctcgtggccccttcctccgccttcaaaggcagtggcttagcgtcttcaaaattctctccacgctgtcttctcatggccttctcttctatgtcagatttccctctatcctctcttatcaggacatttgtgattgcatttgggacccacccatgtaatccaggataatgtctccttctcaagatcctcaactcaatcacatctgcaaagtcccttttgccacataagatacatttgcaggcttcatagattcagatctgcgtatattatttgagggccattatttaacctactacactgatgcacccctatattgtgacaagcaaaaaaattgaggatttattcttccagtgcttaaaaactgtggcctgattgattcagcaaggaagtcacttgtgacattgatgaataagtgaacttctgatattcgccttcattgtctcacttttacttgttaacataaatgaaaatatcagcctcatgagaatgaaacgaaatgaaaatagccaaccctcatgtgtaaagcacacttagtcatcatatgcaaacagacataggctgtagatacaagagtttggaaaaactcaacaaaggcattctgtgaggatcaaccaactatatgcagcttataataaaggatattgtatcattatgttttgttgtacattctttatatcagtaacatttataataaattatctcttcatttatatgtgtatgtacaccccacacacacacacacacacacacacacacacacacacacacacacacaatctttccctccagagggccagctgttgagcatttatcagcccaccactgcttaatacttatttccagtagggaggtagagggagcctaaggcccccgaaaaggtaaagtgctctttgcacctgagggtggaccttgcagtcccgagctctatggtgagcctgtcacccaccgtggtcagctacctccatccacagatggttaaatggatctggatcaaccacctccgaggatgcctgtgtttcagcggaagatgaggcttacctagacacaactggatgcagagcttattcaaaaggccttcaggacaagggggaaagattttgtaaggaatggagggagcatcatcagtggaaagcctgcctccacttcccatccctgtgatcatgacagacatcactagctgatcactgaccatggcattctttcccacag

SEQ ID NO: 373 - DNA, 1577 bp, Homo sapiens; identical to SEQ ID NO: 372

SEQ ID NO: 374 - DNA, 4948 bp, Homo sapiens
tgagcccgtaggtccagcaggccaggaagaagtagaccagcgtgaacaggccgagggtcagggggttgtaggagcctaggagagaagaggggctgacggggcctccacgactcccgcctccgcaggactgccctgccccgctgcccagtctcgggcctcacagtcaccttccaggagcccagcaacctgagctcccgagcccagcggtccccagaaggctccctgttctcagcctccctgggaagcagaaaggctaaaaggatcccatggggaggccacaggggaagaggctctgcggggccctgatgccagcagaagcaggagccgcgtccagcggggcggcccagctgggtctagcagcgccaggtctacactccatgggtgtgcaccgtggtgcagctcgcagcctggctccgggaagagggtgccccccacagcctggggttcctttcctggagcaggcagcactgtactgcgtgcagggcgggtgagaccgccagggacacaactgcagaggtgaaaggccggcactccaaggtcgcggtctgcgcttccgtgaaacacttgtggtcgagcgaggccaggccgtggtcttggtgtgggagtcaccaggctgggttttcttttgttttttgagagagggtctcgctgtgtcacccaggctggtatgcagtgatgtaatcacagctcattgtggcctcaaccttctgggctcaagcaatcctcccggcccagcctcccaagtacctgggactgtgggtgtactaccgtagccagataatgttgcttttttgcaaagacagagtctcgctaagttgcccaggctggtcttaacctcctaggctcaagtgatcctcctgccttggtctctccaagtgctgggattacaggagtgagtccctgctatgatccatgctagggatgaccccccagcccagggctgcaacctcagcccacaggggacactcagccagaaggcatcacccaggccctgatcccagggcctgcccagcggcactgcccacacacacctggcgggtcgtggaagaggctcaccacgctcttctccggggtgttgaagaaggccgcagccatggagttgtactcgccatctgcacaaaagagctgtggggtcgggagagagcacacgttgggaggggagatgagctggtgggctgcaggcacaaacctggtgtcgccgtgagaggccgtgtaccctgtgcctggccagcatcaggcgcgaaaccacacgatcctgccattgggtcagggccacggtcacagagggcaaggaggacacacaaggcccaagccatggtcacggagggaaaggaggacacacacggcctaggcccagcagggggccgtgtctagccctggggggtgggttagcaggaccatgggctgagacgctgtccatccctggtgccggggaaggtgggcccaggcgctcacatgagctcctagaagaggctgttggcgccccggtgccacaggcccagagcctcctgggctccagcagcacagggggtgttatccacggggctggagcagagtgtagcaaggctggtcaaccccatggccccgggcctcccacgtctctaacggttcacacctgacccgtcccatcctgcccactcccgccgtggcacccactggtctgctgggcctctaggctctccctgttctggatgtttcatgttaatggggctacgtcgcgtgacctcacgtgtggttcctctgagcgtagtgctttccagggcaaccgtgtcacagtgcagatggacgcacggacggcggtgagccgtgagcgccaggcacaggtccagttgtggacggaggtttgcatttctcctgggtccacatctatggtgcccccatagggcgcctgaggctcgccccgtcaggctgccattctgggaagaggactggggggagcctctggcccccataccaccgcccattcccctggcacctcagcagacacctggcctcctctgagatctgggtggacaggactaaccctctttgagacacgccagcccatgcgcttctggaactcggcggggtgggcagccctcctcccgtagcctaagcgagcctcctggaggccgccctgtggctgccctgcctgctggaccccgcccgggcccagcctcccacctgcagcgggtaggacatggagcccccctgcaggggctggcaatcccgcgacgagtagatcagcacgaaggcaactgtggccgtgacggcggccaccagcacggcctcaatcacctgcaggcagggccggtggatgtacctggaaccaagaatcaggctgcatggcaggcaggacggcagcgcggcccctccgcaggccccatggcaactcgagtccctgatggaggacactgggcccgtggtgctttttgtttgtttgtttttgtttttgagacggagttttgctcttgttgcccaggctggagtgcagtgctgcgatcttggctcactgcaacctccacctcccaggttcaagcaattgtcttgcctcagcctcccgagtagctgggattacaggcgcccggctctacatctggctaatttttttttgaattttttagtagagacggggtttctccatgttggtcaagctggtctagaactcccgacctcaggtgatccacccgcctcggcctcccaaagtgctgggattatagtcgtgaggcaccgcgcccggccaggcctgtgtttaatcatcaatcaggcacccaaatgtcctggggtcgtcctcttccctggggtaaagactcctcggcagcaacttctccagatgtgtgggaagtggcgctacccgtgccccggctgtacccgacagtattgaaatcagcacagaccaagaaggaagaagccggggggccccggtgtcccaggacagctgcggttgctaccaggcagagccaggcggtgaaggttgggcatgcctcgcccaggcccgatcccacgcagggcctcacttcctacccaggggccgtcctccaggagccctcgcactcctagccttgggctagtccgtcaccctccaggccccgggacacatctctgaccagctccaccggggaaaccatcaggaaggacgctgcatacacagcctttctttcggctgtggcctaggagtgtaaaccccattccaccacgtccgctttcaaagggcctgtgtggccacgcctgccaacgcgatatgcaatgcggtttctcctcacctgattcgaaacatggtcagccagtagttcaaggcattgaacactgctccaagcacaccgcctgcgaacaggggaaaggccagtcagcgacaccggaggaaaagtgcgggcctccgcccgccggctcccagatggcaggagaagctggagggtttgcagagggaaggggacggcagggggctagggggtcctggtaagatgcttcctccacatcatcacaccctgagggctgggggagctgtttctcaaaggctctgccttccttccagggcaaaggtgtccagcagagcaataaatactggtgggagcaattctatctcttacaggaaatcccatccatccctgcagccctgtggtttttgccaacagagataaacaacgggaagccacagaagcgaagctttgggctccccactccccacgtgtactgcccatggaagaatctggaggcccccgggtggccctgggatgagggcaggctccagggagccacagcctccagtcctcgtctctatggccacgtcacagctgagccaggcccgcaggccgtccctgcggtgctgggagaagcccttacccaccacgcccatggcgatgaagaccgggatctcgtggatcgtgtaggccattttctgtgcagagagagggagaaggcagaggatgtgagggaaaaggcccacagctcctttctgctgaaactcaaggaccaccatcttaagagagctgtccccacagagagccttcccgcccttccacgcaggctgcggaagtccacaggggagaaacacactgggtgttctgagcaggcctggcccctgcctggcggggtggccagcgaggctctcagagaccctgccaccctcagcacccggggcggggagggccccaagcactgggaacatagcccgtggtcccccagtttcctgcgcacagagccgccctatcgatggcacggagagtctccccagcccaggccccaggctaccctggaaactaggcctgagcccacctgccccgagagcggctgctgcacgtgcccccaggccgtgggaggccccatgcacgcagcaactgtgtgacatcccaggtgccctgctggtcacatggtgccctgacctgaggggcagcttggggtgtcttcctgcagcccctcggggccctggagcttacacaagagctctcagctccacagctatcaaccagagttttctaaaggaccaaattctcaacctgggccttaagcaaacagggtcctggaccaggatacgaggtgggcgaggtgggcgatggggcaggttacctccgagtcaaaccttccgaagttgatgaggcctgggctggacaggtcccacatgttcccgtggtaaatgctcagaacaaaattcagggtgaacgtggagatcatggaagcaaagaactgcggcagagggcaggaaaccagcgccctcagagccacgctcccagcccagggctcacggaccagcagggaccatcgcccctcctgtcagccccggggccaggagtctgcagaccccgcccaaggcagaagggaaggggctggagccaggggtgggcgcactgtgcgggcaaggagcggcccagccctctctggacttgccagtggagagcaagaggggaaggtggggcagggctgggttcccggctgtttgatcccctacccgggagccacccagggctggcaatgg

SEQ ID NO: 375 - DNA, 1442 bp, Homo sapiens
gcaggtatggatgcatgcacagaggcggggatggatggacagatgcatgcacagaggtggggatggatggatggacagatgcatacacagaggcagggatgaatggacagatgcatgcacagaggcagggatggatggatggacagatgcatgcacagaggcagggatgaatggacagatgcatgcacagaggcagggatggatggatggacagatgcatgcacagaggcagggatgaatggacagatgcatgcacagaggcagggatggatggacagatgcatgcacagaggcggggatggatggatggacagatgcatgcacagaggcagggatgaatggacagatgcatgcacagaggcagggatggatgtacggacagatgcatgcacagaggcggggatggatggacagatgcatgcacagaggcggggatggatggacggacggatgcatggccagaggcagagatggatgggtgggtagattggacggacagatgatggtaggttgttcttgtcctggaggaggtgatccaggctgagtcctcacactgggcagagcaagaggcaggaggtgagcatggggagatgcagctgtgtgccccagtgcaccggaagttacagatgacatcgatgtcctgtcctgatgaaacaggaaacacatttgtcatttgagagttagtggctggggctgggtggaagcttgaggggctgtgggcctggaatggggctgaggggagcgtgcaggagctgcctgccaaagcctggagcaaggatgacaggaggtgccggggcccctgtggactgccctctgggaatcttgtggggctgggtctgcacagctgtggttgtgtaacttcccccagatgcatggcgtgacaagggtgcaggaaggggtgcagggcccggaagcccagtatggccaaggagagacaaggcagggaagaaggtgagagatgaaagatatcgccctgattgaaacaccaaactacccccagtttctcagaaaaaggactcagagcaacaagagaacctacagtcgacagggaaattcgtcagtgcggatgtgatttgagcaagaccattgaagcccctgctgaaaggcaggctggcagagccagggtacctggccatctaccttgaagtctctgtgcctcagtttcctcctctgtaaaatgggcataggagacaggtttggtgagaagtgaacgaaaacgtgtttgctacccctcttaggtctcacgtttcatgcttagacgctcagcgagtggctttagggaccgagagaaatttgcttttcagttcaccaggtcgttacctatgaacctgccctgaacagtgctgaccttagttagagatggccatgaaactcatccgcatggggtaactggggcctccctgtggtgctgcggggctgtgtctctgtcttggtctcttcag

SEQ ID NO: 376 - DNA, 1672 bp, Homo sapiens
ccacaactactgtttcatcatggctgcaggtttccctgggcttctacctggctctggggctctgaacaacccttagtctccaagattctatctcctgctaagcctggtggtttttcgtattagcaaatgtttaccatttcgcaagggcctgagggcctaagagatttctggacaaaattcttgagccacaggccaagacgtaaattgtgtttgggtatgtgtgggggagcaggggtgggagagtcaggcagagaggagaggtgggggcagaaggttctaggccaggaagacttgaagattcaggattccagggagcacacctgtagcattgtgaactagcatttttttcccacctgtatacagagctaattctacacaagaatgatccccagccttaatgcatgggaaaagtttcccatacacccagatgctcaaagcagttgaggcttgtgcaaggaactacaagccagcacaggcacaggctgccctccgggaagacgaaagccctccccagatctgacattcagtccagaggtttctacaagttcctttattaataaagcaaaatagaaaagaacaaggtccccaaatgacccacatgattcaaagtgcaaatttactccaacctgcaagagaaaacgaatggcaggtcttgactgtgggggccatggaaatttggggtgattaaattgcctttgaatcatacaattgtagcagctgaaccatatctgattaactctttggtctctgttattggaacaaaaccgacgctatgcctgcagccgccagactgcaaccaaaaacacagtttggggtcagaagacattaaaaatcacaataaaataggatgaatgttctaagtcacgcaactgaatcaaggcacctttttttttcaaaagcaaaaagttgtttaacaatattccagaatagtagatacttcaaaaaccagattacagtatatatcattttgctgcacattttagtctattttctgtatacatagtcacacattctttaccctctcccaacttatacatgctttatccccccagtcatgtgctatgtaggtataaaaaaataaagttgtatctaaacaagtgatttaaaaaaaaaaaaactaacgaatgccacgatgataacactgaacttgtttccctcttgaaggacattggaaatgttaccgaggttcattttccccaccactgaatcatcttcctccatgtagacagggatgagaagtcaaagtcttcatcaaggtcaaaagccacatgttacagaaaaagtgacttactccatagaggttacatgagatgctctggaagcacttaggttaattccttcacagtgtttgctaggatgtcaattttggtggagctgctgagtcagaaaatgatagaggccggccgcggtggctcactcacacctgtaatccctgcactttgggaggccgaggcaggaggatcgcttgagcccaggaggtcaaggctgcaatgagctgcaatcttgccactgcactccagcctgggcaacagactgagaccctgtctcaaaaaacaaaaacaaaaacctgtgttcttggtagttgaaatggtatgagcctaagaagcttgcaccccaaatctagccaccaatcatccctgtaaaggcacgagctaggataccactaaccccc

SEQ ID NO: 377 - DNA, 1672 bp, Homo sapiens; identical to SEQ ID NO: 376

SEQ ID NO: 378 - DNA, 1672 bp, Homo sapiens; identical to SEQ ID NO: 376

SEQ ID NO: 379 - DNA, 1672 bp, Homo sapiens; identical to SEQ ID NO: 376

SEQ ID NO: 380 - DNA, 605 bp, Homo sapiens
gaaaggttaatggctttttttttagtagacattactgagaaaactggctcattatatcacaaaaagtgaaacttggatctcatatataaaggtgtatttcactgaatttttttttttttttttgagacagagtttccactcttgtcgcccaggctggagtgcaatggcgcgatcttggctcactgcaacctctgcctcctgggttcaagcgattctcctgcctcagcctcccgaagtaactgggattacaggcgcctgccaccacacctagctcatttttttttttttttttttttgtattttcagtagagacaaggtttcagtcttgaattcctaacctccggtgatccacctgcctcagcctcccaaagttctgggattacaggcatgagaaaccatgcccagccgatttctctcatttttttttttttttttttttaagagacaaggtctcgctgtgttgcccaggttcctagggaggaaggcaagagagactaccaaaaaaagcttcttagaagacaggatgcttcacacctggaatcccagcactttgggaggtcaatgagggacgatcacttgagcccaggagttcggaaccagcctgg

SEQ ID NO: 381 - DNA, 1853 bp, Homo sapiens
agcaaactggaattcacatgccacctagacaggctggctgttacgcagctccagctgattggcactgtgtgggaacgtgggccagtatgacatcttcctatatttttcttttttttttttttgagacggagtttcgctcttgttaaccaggatggagtgtagtggcgcaatctcagctcactgcaacctccgcctcccaggttcaagtgattctcctaccaggctggtcttgaactcttgaattcgggtgatccacctgcctcggcctcccaaactacagggataacaggtgtgagccaccgcacctggccacatcttcttattttttaagagaagccagaaatctggaccttttttttttctttctatttttagtagaggcgggcttcaccatattggccaggctggtcttgaactcctgatctcaggtgagatctgaggcagagtctcgctctttcatccaggctggaaggcagtggcaccatgcccagctaatttttgtatttttagtagagatggggtttcaccatgttggctaggctggtctcgaactcctgacctcaggtgatctgcctgccttcacctcccaaaagtgctgggattacaggcgtgaggcactgcacccggccagaaatctggacctttgtatgaaatcacccatcacaaaggtgacaacaaactcgtatatttttaaagcacttggtcaggcatgatggctcacacctataatcccagcattttgagaggccgaggcgggaggtttgcttgaggtcaggagttcaagatcagcctgagcaacaaagcaagatcccatctccatttttttttttttttaagagacaaggtcttgctctctcacccaggctgcagtgcagtggcatgatcacagctgactgcagcccccaactcctggactcagaagatcctcttgcatcagcctcccaagtcgctgggactacaggtatgtgccaccatgcctggttaatttttttatttttagtagagacaaggtctcactattttgcccaggctggtctcgaactcctggcctcaagtgatcctctcaccttggcctcccaaagtgctgggattacaggaatgagccaccatgcctggcccccatctctatgtttaaaaaataaaataggccaggcacggtggctcatgcctgtaatcccaacactttgggaagctgagacaggggaacacttgagatcaggagttcaagaccagcctggccaatatggtgaagccctgcctccactaaaaatacataaattagtcgggcatggtggcgggcacctgtagtccaagctactcgggaggctgaggtgggagaatcgcctgaacctgggaggcggaggtttcagtgagcagagatcgtgccactgcactccagcctaggcgacagagtgagaccccgtctcaaaaaataaaaataataaaaaataataaaataaaataaaataagtctacaaagaaagcagacacactgttggaaaagccatgggctgccagtttgcagcctctgccttagttgcttgactgatgcactgtgcatcagtaatggtaatgtctgttatcattcctggtgttgaaacagggtcatccctacaaaaatatcaggcttcgccaggaagctggtggagttcagggtgactgagtgacatctgctgtgtccagggcagtgagagcaagcccaggagggaagcccaggttcctagggaggaaggcaagagagactaccaaaaaaagcttcttagaagacaggatgcttcacacctggaatcccagcactttgggaggtcaatgagggacgatcacttgagcccaggagttcggaaccagcctgg

SEQ ID NO: 382 - DNA, 2864 bp, Homo sapiens
cgccccctccctgccccttctcacgcgcgcctccaggagagacgcctccttcttaagtccccggcccctcccgccaacggtcaccgggattcctggaagagacggggatttgggggaaacggagagggttctgcgaggagacgggaccagtgagacaggcaggaccgggtggaggcgtctctacgagcaggagggcaaggaagatggggcaagacgcggggaggctgcagaggaggagcagggtggggtttggagagaatggagcctgcagaaaggagcggcagaaactggcgctggaaggctcaaaaaaggggccctggaaaggacggagcggggacaggaaagggaattccaaggggcaggaggagctgggcagaggagcccgtgtaaacacagagtggcccatgcccaggatgagggacaggtgcagctttcattctctacctcgctgctcccagtcctagggctcggactccccagcctttccgcagccgcatccacccaccatggcctcagggccgtgacgcgcgtggggagggatgcggctgggggctgagcagcggccatgagtgtggacgggggagggcggcattcccgtctggcagctctgtttgggtttctgacggggcctcttcaaacctccaggggctattctgggcctgtccgagttgggaattccccagagacctggaacttgctctccacagccacagccttggccccgccctgtatctgtgctgccgccagtaaggctgcccctggggagggcggagccagaacctcacagcctcacagggcagagcaaggctggattgacggacaccaggccgagaagaaacccttggggttggcggcagttcttagtgagggcaattcattcaatccagagccagaaacaggattttatttaaaatttattgtaatggggtccgcgcaaaaggaaggggtggagggtggggtacatgcaggggacacaggaacacgatgacatggccagggccacaacttcttctgtcgtggggaagagggatgaaaagacaagaccagggctggagctggggtggaagaggggagggggacactggctgcattcccccgcccccaggaagcacctctaggccctggacccctcgctcaccctggcccctaagactccatctcttctctgcctctggccctcctggctcttcctcctgctccccttgactttttcccctgacagattctcaagtaggacgatgttcagggcctgaccccaaccccccataccaccttatgaaggtacaacctttgccggccctgcttctgcccctcctcaaacctcaccgctttccctctttgggacagctctgatccccctccttcctctcctccctccccctggaaaaaaaaaaaaaaggaaaagaaagcaccaactccccggggaggggctgcagacagcagggggagaggactggaaggagagaagaggaccgtcgagggaagaggctcacaagtccctgggaagacagggcatgggcttacagagaggagagggggtacgggcagtggctgctcgtgtcctctgccacccctgcccactgtccaggggacttcaacacaaccgaggggacaggtttgtgtggggtcaggtctgacagaagaggagcaggagaaacaaatcgttaaaacctagcgaattcccctaagaaaacatttcttcctcctttccttctggaggctccttggttggtagggaaataggagttggtgggaaaagaggggggagaggagcttgtaccaagggactctactccattctcccctctcccccgcaaccaacttggagctcaccagggttgggagggaagtggctgagagctcacaggcaccccctccgcccccgagagggagcccacagctgtgggaggggctgctactgctgccgctgctgccgctgccgccgctgccgctgccgccgccattggacaaacctcaccagtacctgcacaggagaaacaccacggatcacagcgcgatctgaatgggtgcgtgctggtaaagcccggcccgtgtactccacctgccccaggagctggagacaagaccttgtggctgcgcagcggaaaccttgccttgtgacccctggaactggctttcttgactactccttccccagagcagccaagttccactcccgctttccccacacattaccaggaggttcaacctctctggcagatcatctcttccaaccaggacttcttagagtctaatgatgttcattcaggtgtccccccgctgctcccttgacctcttgtaggaatctagacgccacgagctcttggctacagcacccttaacccgtatccgtggcaaggcgtctggccaggcgcccaccctctgcccctggccctcccggcagccctcggcatgtacctttgttgcagagctcacagacatggtgaggaccctggctgtgcaccttcatgtggtccgaaatataagccgagctcagcatcttgccacacacgtgacatggcactttctcctcgtgtcgtactgtgtgcgcccgcagccgatccttcgtggcgaaagctgcctcacatttctgaggaggggggaggggcgtggggggtgtcacaggagagttaaagcttggtgggctggggaggggggagcaagagattaaaggaatcagagccttggggatctttgatctgtaggaaatgggagtgacatgatgaggccttgaagaagggatgagaaaatggagcaaaaaggcaaaaagaagagagagaaaaagggggtctgagagactgactcagacagctaccatgaggatcaaaatcatgaaaaccaagacaggaggaggcgggcttcct

SEQ ID NO: 383 - DNA, 2864 bp, Homo sapiens; identical to SEQ ID NO: 382

SEQ ID NO: 384 - DNA, 2864 bp, Homo sapiens; identical to SEQ ID NO: 382

SEQ ID NO: 385 - DNA, 2864 bp, Homo sapiens; identical to SEQ ID NO: 382

SEQ ID NO: 386 - DNA, 2864 bp, Homo sapiens; identical to SEQ ID NO: 382

SEQ ID NO: 387 - DNA, 2864 bp, Homo sapiens; identical to SEQ ID NO: 382

SEQ ID NO: 388 - DNA, 1519 bp, Homo sapiens
ctgggcgcggaaaaggcgggaaaatagactgctccgaggttagcaaccatctaacctggaaaagggcctccaagtgcgaggaatctttgcgcgtcgacgctgggaaaactcaatcggtcaaatctcttacggaaattgaggcgctgcaggttgcaagacttgccaagaagaaaacaagacaggtgtttaccaaagccaagtcaaccatggggagagctcaagtaacctatgccctatgccaacctgtgtccaaactagagagtcaacaggaaagagtcccccaaaacttctaagcctgcctaccctaaaatccccacctcaatccaacccccaataaacaccatacacgccactgggcaaaaaagctttttattttcccccacattccagctcttcactttttctaaaaccttttccaactcagagccaaggcccaagaagttgattcacacctggggagaaagaaaataaaacaacaaaacaggtcgaagagctgctagaggaagctctgagatgtgtgcagaaattgaggaaggagcagagggagtgacagctagagaccaatacgggcatttaatcccaactaaggtagcctcaggaccccagggtctgtcaggggccaggaagccctcctttcccagtccaaggttgagagggtcctgtcatttcctgtcccaagtaggtggttggggcatttaggcccagccatcagcaaaataagcacagttgatcttgagcttccacttcctctggcctgatcagttccctgggcctcaactatttccacttttcccatagtaacttcctagggcactgcagccagctgaagctgagaccagttcaagagctggatgcataacacatggctctcaaatttcatgcacccccctctgacaagtgaagattttttgcagaaatattttttcctttagtgagctgatgtgtgaactggttaaccaacatgacccccacccactgctacgtttgtgaagctgattccctccaaagatcttgttaacggaatcagctttttctaaaggtaacgatgactaaatggaagacagaaggtgcatgtcaagttcttgggcacatactatgtccccagtaaatgagtatcatcagttagactcttctgagcggttcaagttgaattttacaaaatttccatcataaaactgggtattggaatttcaggacaaaagcaagacaaacatggttcatattcaggacaaatcatcaaatgtgaaccctcttaactcaccattgttacccaaatgcttggatgtgaactagttatgagtcttaaaatcacaatgttgcttgaaagaagtcagccacaaaagaatgtgtatgattctgtctacatagtttcaaaaataagtaaaaccaaactatattatttaggaatacatacatggcaatacattataaagcaggacagtaatttctagggagagagagggcattgtcaggaaggaagggaccatggggggtttctggacagctggtaatattctac

SEQ ID NO: 389 - DNA, 1519 bp, Homo sapiens; identical to SEQ ID NO: 388

SEQ ID NO: 390 - DNA, 2653 bp, Homo sapiens
aatgagggggcgcgtcacacggcggccggcgcaggccccgaccgcccctcccccgccgcccgctcccgccggcccggaaatgcggctgcggcccgcgcgccccaggcctgctcgcattcctgcttgtggcccgcgcaggggcggggtcggaaggtctaggccgggcgcggagcgaggaagcgggtggcgctgggacgcatgctctgggggagatgagtataatgacccgcgtttgtccgccgcccgtgccccgctcaatccccgcatcaatcccgtgaggccgtttctcccgttggctccactgtaccgggggctgaggcccagggaggtctcgcggctccctaggttatccagctagtaagaggcgaagctggaattctcactgtgggcccattccatggcttttgccagagcgccagggacacactcagttcaccttctagcagggaagacccaaagatgcgcgcccctggcagccagggcgtcggaccaggcaattcctactgtccagcatcacctcctccaggcctctcggatgcctctgttgggacagctaagttcctcttcaaagactcaatttcctggtcataagctgtaaacagattctactcccgctttttcttctttgtcgcacgtctaccctatttgggaaagtttaaaccttagccaatcgggatcagctcagattgtgcggtccaaccccccagccaatggggaaaggacacagaaacaggaactgcgttagggttaaaaaccacttccctcctttgttggcgggtgctcttgggattgcaaccagcgcaagcagcacccttctgcagaagtaaagatgccttgctgggaagtcttctgtctcagtgctggtttttcttgactacactgagcacttgttttcaacaaatttgagggtcttctgggatcccattctcctttgggaggggtagcgattacttttcctcgtgagacacgtcccactgccttgttgcagtggcccaaggagcggaggatcgggtccacccaaagtgaggaataaatccggactttcagcaacgtgggcaggaaggagccttaaaattcccaggcaagtgggtaactctgtgcacagaccaagccgccgacgggaccatcacaaaagctttacaaggccttaccaccctggcaaatgaattagccgaaaattctggactagataacccttttatgggtctcatggaaaagtggtttggaaaatggaaaggactcctggcttcaatctttacctctcttgcaattgtaacaagtgtacttatccttgtgggctgccgcatcataccttgtattcgtgggttaactcaaaggctcatagaaacagccctcactaaagccttcctctcttctctccctccatacttggacaagctcttgctcctggataatcaagaagaacaacgaagccaaatcctgttaaaattttttgcagaggaagaagtatcaaatagaagagaggaaattgttgggacagctaagctcttcaaagactcaacttcctggtcataaacttctccccgtttttcttctttttcgccagtctaccctgtttgggaaagtttaaaccttagccagtcgggatcagctcagattgtgcagtccatccccagtcaatggggaaaggacacagaaacaggaactgcgttagggttaaaaagcccttctctcctttgtttggggtgctcttgcgattacaagctgcgcaagtagcaccgttctgaagtaaagatgccttgctgggaaatctgtctcagtgctggtttttcttgactacactgagcacttgtttccaacacccctgtgctccaggctgggttaggtctgatctcagggaatgtctgtttcaacacgtgtctgcagttctttggcttgtgttgctcactgcagtgggcccagcctggtctagaggaggcgctcaggaagtatctgtgaaatgtgaatgtgtagttccttcagtgaatatggccctggggctgaagatggcagaagcattctgggagcttctggagaaggagacctgggaggagaaggttggaatggcgggggcagcagaggggctgggtgaactcagctgtcccacccaggcccatcctctgcagcccgagaaggaagctcacagggcaagacatggaagagatcaagttccctgcccggtgcctgggctgttgatggcctcaggaaaatggaaccattacctgttgctgtcaagtggctgggggccaggatgcctgggttggccgtgagaggacattgctgaggagagtggaggccaggctggggtggggtgtggcaggaggacaggaatgcagtggaaccagtgggtcaggctcctgagggccccaggctccagcctcagggctggcctgttccctcctaagctgccatcttcatatcttcaggacccacccctctactcctcaccctcagcacaacgatgtgatcgaaaggcaaatatttatttttcaggaagagaaacaggagacctcgaggcttctggacttaggaggtccgggcagctggtccatggttgtccagggacgaagaaactgaggtgaggtcacctgcccgagtgatgcagctagttggcagcagagtgggaccggaaccctgctgccaggtctgtgtg

SEQ ID NO: 391 - DNA, 2653 bp, Homo sapiens; identical to SEQ ID NO: 390

SEQ ID NO: 392 - DNA, 10743 bp, Homo sapiens
cgctattgtcatggagacgggaagctggctgcagcggcggcggggaccgtggggccgaggtggctgccagccggccaatgtctaagcgaggcggagcggcccaggcggcccgagcctgggggagcgcgcagccggccagtggcggcctcgccggcggcctcttcccgggctcgcagtaggcccgagtcgtcgccgggagctcctgggagcagcgtccccgccctgctcccctcgctcccgcctcttgcggccccacggcccctcagcgcccgcccccggctccgcccgccgcagccgcagcccctggcgctaacggtcggtaacggcccgcgcgcgccgcccgccgggggctcgcgccagccacgagggagcgtccgcggcccgcgcgcccgcgcggcggaggagaggtgttaagtgtgatgcttccataatacatttggatgctgtcagctaagttcacttctgaactaaggggttcctccaaatgttggctgaaattcatcccaaggctggtctgcaaagtctgcaattcataatggagctactgtactggctattggaaggaggagattctgaagataaggaggtaatattatctcttttaaaagaatactttcctctgtaatcctgaatctttattacatgtaagaactttgtgcagtagacagcaatttctttgaatttggtatatggaaacaattttattttcctctgctaagtttttgagcctgcctcttctagtgccatggactgcattggtagagctgagaaatatcatttagccatactcagcacccttaaaatagcttctttctgagaattagatctgtgaaggtgtcctgcacagttcttgtagatgtcattttagtttgtggttgacgtgcatgcatttagcatgttgcttaaccgtcctcattcgcctcccagttctttgttgccttcatttggggggatgtgttttctgctggatgatttactgctagacatgaccaaactctgagtataagacttggtgtttggcagctggttccagtgctctgctgagaagtagttgggcccagcctggggcattgtagtgtcctggaggccgggagctcctgcacaggggttcttttcctggttcagagccttaggtgcctttccacttttcacgtaatcttttcctaggttggcttgctgcttactttgcagctgttgcagggattcacatggaatggagggctcccttttattgtggattatttctttgataatttacccatgtgctttttcattttcaaaaacccagtggtgtttaagaatgaaagattcttgaagaacaaaaattgggttaaatttgtatctatcagaaaagattctatcctctgatgctatgtaggcacattgaatatgcaggctaaattaaaaacagagtaaaacctttttataatatgccaattactatatctaagaatgtttatacaggctgaaattttgtaatggtatttatatctgttttcctttttaaggaaaataatatacttttctaggcatcaaaaatatctgcccctttcactaatgctgatgtaccaccttcccccaacccccaacgctaaatttgactggcttaaaaacatctgccccctgaactatatctggggaggaatattaataaaacaatgaaggacttcatggtgtctagttatataattaggaaattggttagaaacgtggctaaaaccagtttctttcattaaaagaactagtgtacatttaaaaacaaaaaccttcaggaaaaagactctttgatctttaagtcaaatagtatttttggttaacacagcaggaaggggaaatataccaatttcagattcttttatttatgcctaagtagaggttgtaagcagctaaggaagtgattaaaatgtagtctagtaaaaaatggtgctgattacttggaaagcagtttacatttgcaaaaaaattcagtattatgaccttcaccaacttttacacatcatatacttgggttattacttatggtatagcttgtgtatggaatgcaagggtattttcaaattgactaggtcttgctggtcatcttaaaatatgttacaatattacaaaattgaaatgtaatattttttaatagaaggaaaatataaatttaatatctgggcaattgagacctttaaacttactttaaaagtatgatcttgatgtatatgatactgttttgtctttgctatattaacagaattagaggggtgttctgcaattcaaataccttatatattccaaattttattctctataatggacttttaaaataaaaggtatatgtgcttcaagagggcaaaatttgaatcatgagctaatttgctaagcatcagattatagaaaagcatccttgattaatttggaactgtgaaagggggcgggtaaaactgttttctgcagaaatttactagtgcagcaaccatttaaattaaatgtttgttaacataatagtgatggcattttctcctccccctccttgtggttttgtccaactagatgttacagtggcagttgcactgactgttaagtgtttaaatgatgacaccattatgtgaagtgattttgaaatgagagattccagccaagaattacatctgctcccatctccttcaaatcatactctctggcagtacagattatgattgatttgtttgtgacagattgcaggaaacagtcattgatttttcaatattttaccttaaaattatttacagttgtaaccatggggaggtattttcatgggctgtcagcccctgaaagactaggataatattccctgctctctgacaagacaaattacctgtaatgagtgcagtagctgaagggtatacttttattttaaaatatgtcaataaccccagtgactaaacgaatattgatttagcataatgaagcctgagtaacgtgaaaatgagctttttcaaggggcatggtaaagtctttctttttagctggttgtaagaagcttttgattcttttcagccagctggtaggaatatagaattttataagcaaaccatcaggaatgatagtgttgtttctgataagcaacatccaaatattttgaccctgcttttagtggtttttttcaaatcttattttgagtcttacttttagtcatagaatagctactgatttgatgcggtctttaactgacttaatatttttacaatttcaatatattttgcattggaatctccagtaatgaatattaaaatatatgtacaatcatttgtagatgatatcaattatattaagacatttcagatgggctattgtagtatttaatgtgccgtattttatggtagaataattctcagtctctggacatcaagattgctttcagtgggaatgaagattaatttacttcagtcctgattttttaggcatcaatgcatgttttcatttttgtcagacttttaccctcttttaatgtaattctcaacttcttatggatttacttcccaatacataaaatccttcaaaacaagaatgataataatttttatactttttataaaaataaatttatttttagtccatcaaggtgtctgaagattttatgcctaggtatctccatatctaacttgataaggaaaataggataaacaatgctggtaatagcaggaaagtaagtatttgaataagatgtcaaactgatatttcatgtgaacctaactcattttatggtaactaataattatcttatttaaatcaataggtaaaacctgtttagaaattaaaaatgagttacgatttaaagaaaattcagatgactcattgtgagtgctagttctcttgtaggatgccactggaaatgttgaaatgaaaaatgtaagtatatcttttggtggaaaaaaggatagtctctaggacacaaaattactgttttatttttttctcaggagtttgcctaagggtgtgacagatgatctctgtcacttgtcttagttgtgtcctgcaataaactggatgctttataaaatactagacctgtgatttcgtatgctgtaatatttcatttctccatcacccctccaaattatttcttagtttggagtaaaataataaatgtattatagtcaacatctcttgacccctctttagtttcagctaaactaagcatgtgtgtttgtgtgttcattttatagttcatgtgtagaactatgtgaattaaatttaagaaacatgtaaagtagaggaaatagttttctggagaaatttttcctttttggatattatgcccttttccattgcttttctctgcttgaaagcaaaaaaaagtaccctacccctgttctcctttagggaaaaactattcctataaagtatttttaaatcgtgcaagtcattgcctagggttagctaaaacatttctttttaaaaaggagaaaatgccctggctttaacattttcttgtatttgtatctattaagataaacagtttactttgatacagtacataccaatctacttaattttttttccaggattccttttactatgtttggtctgaccttttatgataacttaatatgggaacaaattagcatataattctattttccatgtgacctcaaccagttgcagaattgtaccactactttagggggggcaatttgacagtttatgtagactatagcattaattgttcccaaatgttcagtgcatcctggctaatgtgttattgaaggtgttttcacgtaagcagttagaggaagcacttcacccctattactaagttattaaaatgcctcctaaaggtagcattttaaattagtatacataattgattagtaatttgtcttctcccaagcataaaacagcatagcagagttaagtgtgaccagtgaagtataagatattagggattgatggtgacaatgatcatagcaactaaatggattttttttttcttttagattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttgacttttttctaaaatgtctttattggattgaatgaatgtttatacctgaaaaaaaaaggttcaaaaaaattcctttttctatcagagtcattcttttgacaatcagatattagactaggtttaaaataactttctaatatgactcatatttatgggaggaaaaagacttgaaagatattcctatgtgtactttaattttctgtaatagtccctctggaatagaatatctcttcctcaaacaaatctattggctcatttcatatacaagaaaaagttgccctaaatggcagagtttcatctctgtaaagaaggctgacatccacttccttcacagaatccctgcatttgggtaattgagtaatgatagattaccttgccattgggaaataccttgttgtggcctttgtagcagctataggaagatggaagaattcttttgtatagacaggtctctagcctctttggtgtggacactgtgaaggggtacatctggtgagaaggagtgcttagggaaggaactgggaaggtccacaaaggctgatgatgacaaagaatccaagggctatgatgaattcttaagcttagatctcagagtcataaagtaaatttattaggctagagagatttccttttttatttttgatcaaactttattttttcagattgttaagttcacatgcagttgtacaaaataatacagagatctttgaacactacccagtttctcctaatagtaacttcttgcaatatactgtatagcacagcatcacaacctggatactgacattgatgcagtcaagacagagaacatttatatcatgaggaggatccctcattaccgccctttgatatccacccctacttccagaccatctcactcctcccttaaccctggcaaccactagcatgttctccatttctataaatttgcctttataggaatgttatataattgcaattaaagtgtgtaaccttttggggtttgactcacccggcatcattttctggagattcagcttatatgtgtcaatagtttgttcccttttttttagttcagtagtattctgtggtacgtgtgtaccacatcactcatcaattcggacttctgggttgtatctggtatttgattattacaaatagaagtactatatatatattcgtgtagaggtttctgtgtgaacataaactttcattttcctgggacagatgcccacgagtgaaaattgtgagtcatatggtaattatgtagagtattttttttttgagacgatttgtttatgattttaaaacataaaaatataagttgtagccaaatataaggaaggatttttccacaatctagactttattcttattttagagaaatacttttgaaaaaattgctttattggcaaacaattcctatgtaaaggaataaaagacgcatatactctaggaaagatgttgcaaagctgacaggcaactttgagaaagatgagggcagttttccagtgttactggagacttgacattcaaggatgtattatgatagtttctgaattgatagattctttagcgtttgtcactaccctcaggcctgcagtttttatttgtagaattaactcatctttacaatgctttgttgagtgctgttgcagaaaatgctcatgtaattcaattatatgcagttaggaaaaagaagtatctttttctagtacatggcccctaaaatgatgactttccacaatgctgaatggaggaaacagctctgtttccatcaaactctggtggaaattatacaaagttatattatgctttatgagacatagtgaggtagtacacaaccatatatgctatattattggggagacccactgaaagaattttcaaggataatttttgctctgattttctatcatgtatattgactttattgattgattgattgagatggagtctcaccccgtcacccaggctgaagtgcagtggtgcaatctctgctcactgcaacctccgcctctcaggttcaagtgatcctcgtgcctcagcctcccgagtagctgagactataggtgtgtgctacgatgcccagctaatttttgtatttttagtagagacaggatttggtagcctggtctcgaactcctgacctcaggtgatctacccaccttggcctcccaaaatactgggattacaggtgtgagccaccgtgctggccaagtatattgactttaaaacgttaccggctgggcgtggtggttcacgcctgttatcccagcactttgggagcccgaggcggatggattacctgaagtcaggagttcgagaccagcccaacctggtgaaaccccgtctctactaaaaatacacaaattagccgggcgtggtggcaggcgcctataatcccaactactgggaaggctgaggcaggagaattgcttgaacctggcaggcggaggctgcagtgagccaagactgcgccactgcactccagcctgggcaacaagagcaaaactcagtctcaaaaaaaacagaaaaaaaaagttaccacgggtgaaacattgggctggtcacagtgatccttctaacagcagtcaatattataaatctagcttttttttttgagtgagatactaggcccagggaacccgagtctttcaatcctcatgaatatagtttaatctttagctcattatggtcatgaccatagttaaataaatgacacgagataataaaatagtctttgcccttaaaactgacctgggtaaaaggatgtacacttgaatctttgaataccagaatagtcattcattcattgagccgtgttgtagcatcccatcttctggcacttccagcactgggaacccatcataaagaaggcactacaggccaggcgctgtggctcacgcctgtaatcccagcactttgggaggccaaggcaggcggatcacctgaggtcaggagttcgagaccagcctggccaacatggtgaaaccccatctctactaaaaatacaaaaagtaactgggcatggtggcaggcgcctgtaatcccagctacttgggagggtaaggccagagcatcgcttgaacccggaaggcagaggttgcagtgagccaagatcctgccattgcactccagcctgggggataagagcgagacttcgtctaaaaaaaataaaaataaaaaggcactacagcacctgttctcttagtgtagctctattagctcttagactagggggtagggatgggaaaaagtaaaaagaaactgagaaaccaatctaattacgcataatcagaaatccaaagcttccagaattcatgaggaaaaagaactgcagctgatggagtaggcattacagagaatgagaggcttgctttttttttaagtttcattttatttgtaattgacacaatagcacatatttacgggatacagtgtgacattttaatacatttacatattgtgtaatgatcaaattaggataattagcttatgtatcacttcaaaaacataatttctttgtgatgagaacattcaaaatcttctagtattttgaaatacataatgcaatattgttaaccacaatcaccctactgtgcaatagaacaccagagtttactcctcttttccatctgtagcttcagacccattgaccaatctctccccttcgccccccaccacccccccccccgccgtcaccactctcctcccctccccagcaagaggcttgaatcttgaaggagcacatcagatagaaagagggaaatcaactgggacatggtttgttggaagtggggtggaatctggtttgtttacagtttcagagtttgaggcatcaaaagtgtatgtcattgcccaaaagtatttaacagctttctatgttttaggaattcactagaaataaggcatgctttttaaaaaagaaaaaaaatagtaatctttgaatttaaatatgtgggtttccatgaaaaacaaatgagtacccttccttgaaaaactactactttgaagagtctcgtaggttctgaggctcgtgtgtgtgtgtgggtgtgtgtgtataaaacattttcttttatatttggtaagaaggaataaggtattttatacttttctggtctgttaaatgcataatctataagactataatactttaaaaaattttagtttatctgaggcttaaaataacaaaagaacttaaagctcctgtggaagagctccaaaattaaaactgtaagatcacatatagataaaacgttatataaagcaggctttgggaccccaggcatgatggctcattcctgtaatcccagcactttgggaggccaaggtgggtggatcacctgaacccaaaagttcgagaccagcctgagcaacatggtgaaaccctgtctctacaaaatacagaaaaaaaaaatattaaccaatttttttaacctcccagctacttgggaggctgagatgggaggatggcttgagcctggggaggtcgcggctgcaatgagtcatgatcgcgccactgcactccagcctgggtaatagattgaaactctgtctccacacacacacacacaaatgacttttggtaagactgtacatagagtttatggccttattaagaaactcttttgagcaacctaagaaaacacaagtatttctgtacattactttgttaaagtgtacaggataataagagagagctaagagccttttctaaatgtgcatccaattttaagaggctaaaataggaagctttcatatagccaaggccccattaacttgggaatctggaaaacagaagacgtaagtttctatcagagtttctttaaatttatgtaaatcataaatttgagcaaggcagttataaaagacattaaaattaagatactcaggattttatatgtaataatattgattccaatatcttcaacactatggcattgccaatgaggagaccaaaatgaattgtattttatgaaagggctatattagaccagtgacttaaaagttccaagtacatataatgacaaagcgttgtggaatcatcttgtactactgtttatgtagtagtttaaaaaaaaaaagaaaaagaaaatggtgcaattttagacagtttaaaaaaattttacaaatactgcaaatcataggttggttaccactagacttcctgactgcagtggttgctgtattcactgtacattcttttaaaacaccaggcactttataattttgtctataattgtttatatattttttcttcacaacatgttttagaataacttattgctaagttacttcaacgtatgtgccatctttaaactttatatatgagtatactaaagtgtcatttgcaagacacatctatgcactattttttttttcaggagcctctttattcaaaatacttttaaatgcagtgcataaaaatagcaggccacttccacttgcaggcttttgaagctggagaagacttgtttttcacatgaggaaactgagtcccagcaaggtgaaatgacttgcta

SEQ ID NO: 393 - DNA, 10057 bp, Homo sapiens
ccccccctctcacccctcctctttgcctccccttttcccctccccggtctctccctctctctcgctttctctcagactctcgagcgccggccccaggatgacaatcacatcccaggagcgccgatctcttccaactttcctcttctgctaactcggggcggagtggcagtcccgccgccccgaagcacaaagggaacgaggccgcgggctgtgcgccggcgaacgctctgcgctctcctagccacagtagatcgcggacttagcggatttcttgttctccggcaggctgggctccgaggccattcgttgcccacccccctctggcgtcttccccaagccagggggcccggagagccagctggagatccggaatgaaagtctctgggagagccgatggatggcccgcgcccagggcgcaggaagtccgggatgactgcccctctgcgccggcagcagcaggtgggcgagagacaggcctcagacgtctgcacgtctccgcctcgccttccttctaccgaccccccgccggacggcgagggagaagacactggttcctggaactaccggggtagcctttttctagagtaggggtggtgggcaagaactgccagacagagaatcagctacacccgaggagatctcgggaccgtccccagctccactcccacgcctcgcagcctctttctcccggttttcccaccgcacgcagctcgcaccgccaagtcggtggtggtggagggtgcgggtccccttcccttttgtttaactaagtcgccttccccttcgcacgcactctcgcatccgcccacgctccactgcaaacactgggcagagcagtgcccaacccaaccactgtttgttcagcgaggcgctggcgaagcaaacacacacaactgagtcagaggcagagcccttgcccacgacggccacacagttagaatacaaaacagaccctctcctcttctctccacctcccgccaccacaagccacggacgcactcgaactctgggacagacaggggcgctggtgaaccaggacagaagatggcacaggtttgggcacgccgcggaagctcgggatatcgggaacttcgcataatggggccacacgcaagccgaagcataactatatacaaagtttctcgcattgactttgacgggcgagatgtactttatttcgcgatctcacactaacccagcgccgcaccggcacccgctcggtgctgcgctctcgtgcacgcgcgttggctcctcccctccgtctgctcccctcccccagacaccgcccaccaagaggcctgagcggttcagactacattctccgagagcccctgggtccgcccagcccagtgcctgacacctccttcacctatgattgggcgctggcctccctgggctccgccccctggtgacgtaaccccgctttcctccgagtctcggcgccagaggggcggggaggggcggggtctcgatcgcgctattgtcatggagacgggaagctggctgcagcggcggcggggaccgtggggccgaggtggctgccagccggccaatgtctaagcgaggcggagcggcccaggcggcccgagcctgggggagcgcgcagccggccagtggcggcctcgccggcggcctcttcccgggctcgcagtaggcccgagtcgtcgccgggagctcctgggagcagcgtccccgccctgctcccctcgctcccgcctcttgcggccccacggcccctcagcgcccgcccccggctccgcccgccgcagccgcagcccctggcgctaacggtcggtaacggcccgcgcgcgccgcccgccgggggctcgcgccagccacgagggagcgtccgcggcccgcgcgcccgcgcggcggaggagaggtgttaagtgtgatgcttccataatacatttggatgctgtcagctaagttcacttctgaactaaggggttcctccaaatgttggctgaaattcatcccaaggctggtctgcaaagtctgcaattcataatggagctactgtactggctattggaaggaggagattctgaagataaggaggtaaaacctgtttagaaattaaaaatgagttacgatttaaagaaaattcagatgactcattgtgagtgctagttctcttgtaggatgccactggaaatgttgaaatgaaaaatattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttgacttttttctaaaatgtctttattggattgaatgaatgtttatacctgaaaaaaaaaggttcaaaaaaattcctttttctatcagagtcattcttttgacaatcagatattagactaggtttaaaataactttctaatatgactcatatttatgggaggaaaaagacttgaaagatattcctatgtgtactttaattttctgtaatagtccctctggaatagaatatctcttcctcaaacaaatctattggctcatttcatatacaagaaaaagttgccctaaatggcagagtttcatctctgtaaagaagatttccttttttatttttgatcaaactttattttttcagattgttaagttcacatgcagttgtacaaaataatacagagatctttgaacactacccagtttctcctaatagtaacttcttgcaatatactgtatagcacagcatcacaacctggatactgacattgatgcagtcaagacagagaacatttatatcatgaggaggatccctcattaccgccctttgatatccacccctacttccagaccatctcactcctcccttaaccctggcaaccactagcatgttctccatttctataaatttgcctttataggaatgttatataattgcaattaaagtgtgtaaccttttggggtttgactcacccggcatcattttctggagattcagcttatatgtgtcaatagtttgttcccttttttttagttcagtagtattctgtggtacgtgtgtaccacatcactcatcaattcggacttctgggttgtatctggtatttgattattacaaatagaagtactatatatatattcgtgtagaggtttctgtgtgaacataaactttcattttcctgggacagatgcccacgagtgaaaattgtgagtcatatggtaattatgtagagtattttttttttgagacgatttgtttatgattttaaaacataaaaatataagttgtagccaaatataaggaaggatttttccacaatctagactttattcttattttagagaaatacttttgaaaaaattgctttattggcaaacaattcctatgtaaaggaataaaagacgcatatactctaggaaagatgttgcaaagctgacaggcaactttgagaaagatgagggcagttttccagtgttactggagacttgacattcaaggatgtattatgatagtttctgaattgatagattctttagcgtttgtcactaccctcaggcctgcagtttttatttgtagaattaactcatctttacaatgctttgttgagtgctgttgcagaaaatgctcatgtaattcaattatatgcagttaggaaaaagaagtatctttttctagtacatggcccctaaaatgatgactttccacaatgctgaatggaggaaacagctctgtttccatcaaactctggtggaaattatacaaagttatattatgctttatgagacatagtgaggtagtacacaaccatatatgctatattattggggagacccactgaaagaattttcaaggataatttttgctctgattttctatcatgtatattgactttattgattgattgattgagatggagtctcaccccgtcacccaggctgaagtgcagtggtgcaatctctgctcactgcaacctccgcctctcaggttcaagtgatcctcgtgcctcagcctcccgagtagctgagactataggtgtgtgctacgatgcccagctaatttttgtatttttagtagagacaggatttggtagcctggtctcgaactcctgacctcaggtgatctacccaccttggcctcccaaaatactgggattacaggtgtgagccaccgtgctggccaagtatattgactttaaaacgttaccggctgggcgtggtggttcacgcctgttatcccagcactttgggagcccgaggcggatggattacctgaagtcaggagttcgagaccagcccaacctggtgaaaccccgtctctactaaaaatacacaaattagccgggcgtggtggcaggcgcctataatcccaactactgggaaggctgaggcaggagaattgcttgaacctggcaggcggaggctgcagtgagccaagactgcgccactgcactccagcctgggcaacaagagcaaaactcagtctcaaaaaaaacagaaaaaaaaagttaccacgggtgaaacattgggctggtcacagtgatccttctaacagcagtcaatattataaatctagcttttttttttgagtgagatactaggcccagggaacccgagtctttcaatcctcatgaatatagtttaatctttagctcattatggtcatgaccatagttaaataaatgacacgagataataaaatagtctttgcccttaaaactgacctgggtaaaaggatgtacacttgaatctttgaataccagaatagtcattcattcattgagccgtgttgtagcatcccatcttctggcacttccagcactgggaacccatcataaagaaggcactacaggccaggcgctgtggctcacgcctgtaatcccagcactttgggaggccaaggcaggcggatcacctgaggtcaggagttcgagaccagcctggccaacatggtgaaaccccatctctactaaaaatacaaaaagtaactgggcatggtggcaggcgcctgtaatcccagctacttgggagggtaaggccagagcatcgcttgaacccggaaggcagaggttgcagtgagccaagatcctgccattgcactccagcctgggggataagagcgagacttcgtctaaaaaaaataaaaataaaaaggcactacagcacctgttctcttagtgtagctctattagctcttagactagggggtagggatgggaaaaagtaaaaagaaactgagaaaccaatctaattacgcataatcagaaatccaaagcttccagaattcatgaggaaaaagaactgcagctgatggagtaggcattacagagaatgagaggcttgctttttttttaagtttcattttatttgtaattgacacaatagcacatatttacgggatacagtgtgacattttaatacatttacatattgtgtaatgatcaaattaggataattagcttatgtatcacttcaaaaacataatttctttgtgatgagaacattcaaaatcttctagtattttgaaatacataatgcaatattgttaaccacaatcaccctactgtgcaatagaacaccagagtttactcctcttttccatctgtagcttcagacccattgaccaatctctccccttcgccccccaccacccccccccccgccgtcaccactctcctcccctccccagcaagaggcttgaatcttgaaggagcacatcagatagaaagagggaaatcaactgggacatggtttgttggaagtggggtggaatctggtttgtttacagtttcagagtttgaggcatcaaaagtgtatgtcattgcccaaaagtatttaacagctttctatgttttaggaattcactagaaataaggcatgctttttaaaaaagaaaaaaaatagtaatctttgaatttaaatatgtgggtttccatgaaaaacaaatgagtacccttccttgaaaaactactactttgaagagtctcgtaggttctgaggctcgtgtgtgtgtgtgggtgtgtgtgtataaaacattttcttttatatttggtaagaaggaataaggtattttatacttttctggtctgttaaatgcataatctataagactataatactttaaaaaattttagtttatctgaggcttaaaataacaaaagaacttaaagctcctgtggaagagctccaaaattaaaactgtaagatcacatatagataaaacgttatataaagcaggctttgggaccccaggcatgatggctcattcctgtaatcccagcactttgggaggccaaggtgggtggatcacctgaacccaaaagttcgagaccagcctgagcaacatggtgaaaccctgtctctacaaaatacagaaaaaaaaaatattaaccaatttttttaacctcccagctacttgggaggctgagatgggaggatggcttgagcctggggaggtcgcggctgcaatgagtcatgatcgcgccactgcactccagcctgggtaatagattgaaactctgtctccacacacacacacacaaatgacttttggtaagactgtacatagagtttatggccttattaagaaactcttttgagcaacctaagaaaacacaagtatttctgtacattactttgttaaagtgtacaggataataagagagagctaagagccttttctaaatgtgcatccaattttaagaggctaaaataggaagctttcatatagccaaggccccattaacttgggaatctggaaaacagaagacgtaagtttctatcagagtttctttaaatttatgtaaatcataaatttgagcaaggcagttataaaagacattaaaattaagatactcaggattttatatgtaataatattgattccaatatcttcaacactatggcattgccaatgaggagaccaaaatgaattgtattttatgaaagggctatattagaccagtgacttaaaagttccaagtacatataatgacaaagcgttgtggaatcatcttgtactactgtttatgtagtagtttaaaaaaaaaaagaaaaagaaaatggtgcaattttagacagtttaaaaaaattttacaaatactgcaaatcataggttggttaccactagacttcctgactgcagtggttgctgtattcactgtacattcttttaaaacaccaggcactttataattttgtctataattgtttatatattttttcttcacaacatgttttagaataacttattgctaagttacttcaacgtatgtgccatctttaaactttatatatgagtatactaaagtgtcatttgcaagacacatctatgcactattttttttttcaggagcctctttattcaaaatacttttaaatgcagtgcataaaaatagcaggccacttccacttgcaggcttttgaagctggagaagacttgtttttcacatgaggaaactgagtcccagcaaggtgaaatgacttgctacttctgcagcaacttcgtcttttctcattggaccttgagaacaatgcagagattgcattgtcccccatgtcagagccaggagatcaggggtgcagacgtgtgaagtgacccatcctagatcccaccgctgttcgcattctcaagtttgagcttagatcctctgcttccaaggttggtggagttttctcactggcttcacgtactggtgttggtggataatagcgtgattaatttcactttctgtgtcttactccatgagccctaatgcttctgctgagattcctaattcagtgaaacctgtttaggggatcatctctgttaggcagacagctgctgaaaaggcattcactttccaagcatggattttagattatggccaatcaagactccggcctggaagaacacctgtcagagacgtttttctacaaggagatggtctctttaatcatatttcattgtacttcagaaaaaggttcgttttaaaatggagcaaagtttgtcatcttgatacactagatctttgatgatatcaataaggaaacatccacaccctttggttaaaagactctgagacttcaaggactgctggctgttcagaagaggctgtggtggttcaagtgaggctcaaggctgtagttataccaatctgttactccatgaagagtccaaggctgctgaacagagtgaacctcagaacagatagcagtggcacctagaagatataatctcaacagcagatgagttattgagggatgattgctgattatggattcctcttcatctctcttaacttatattccaagctgttaacctagaataaatcctactatatctaattaatgcattaatcaaactttgttttgaatggaaggggggagaatatgttgattaccccggctagtgggatacaaaatatacctaaagcagaatatctttctccatcatgaataacattaatctctgcagttcttacaagtgaataattattatatagtttgtttcctatttgtctggcttggtatttatcctttatgagtttccaggtgacaatttgtttcaggaagaattctccagaaacaattttttaagattatcgtcaaattccttaataaagagttgaaagccaaactcactaggtgaaatgcaacaacaaccaatgggcaacagactgatctccaacttcctgaattctttttttttttttttttttgagacagggtctctctctgtcgatcaggctggagtgcagtggctcaatcttggctcactgcagcctccacctcccaggcccaagcaatcccgagtagtagggactcaggcacgcaccacgacacctggctaattttttgtatttttggtagagagagggtttcaccatgttgcccaggctggtcttgagctcctgagctcaaagtatttgcttgcctcagcctcccaaagtgctggggttacaggcgtgagccaccgtgccaggcctttaattcttaattgccgccaggattgattggtaaggctgtagaagagttgctgtccattccaagtcttcccatctgaagcaaccaccatgccacagccttattctgtcccatggctgttttgtgcatctccaagtgtaccagtgtgaggccctcaaacacacccatgccctctgatgaaataatgttggtcgtgataaccacagggatgtcacagccgccgttccacactctaactaattcttattttgttccaacaacaacaatttgaaatgggaagaaccaccccattttagacatttcaaaacgagggcttggatagattatgtaccttgtccaaggtcacacaaccaaatggcaaggtacggactcaacctagttccatctgcctccagtccaaaacccagagctctcaactgccaccctcattgtctctactagatacgggcttccctgcggtaactgttgaggctggaaaacacaggcctgagagaacttttaaatatgaaatgataactctttgcctactgagattcttatttttaaaaacccagaggaagatcatatttatatatttattcaacattcacgtatgatatttagatttacaaaatgctttatagtgtaacagaatgggcagaaatttttactcgggcttataattgtcttttctttcatattcatttattcctttgatttatataatgtgttctctgcttggtcttctgagattacgtacaatggtaacaaatcgaaaataatattaataaaagattattttgtatcactcacagggaaaactgactggggccatgcgcctctctgttctttagaaacgttatgcgagagaacataatattgtccccagaatactgtctgtaatgccggctatgcttattcgtggtgctttaaaaataaatttaactcctgttcttcat

SEQ ID NO: 394 - DNA, 5165 bp, Homo sapiens
acagtgcggtaaagccaagggagattatccagacccccaggagcgaacagcaagcagcaaccgaaggcgcaagtgccaggattacagcctaggctgctccaactatgagcccttcctcggaccctgggactcggctacttggggtttgggggtcttccacaccacagaggcacaaagctgactttaatcactttttttcctttaaacttgattctgccgcagtggagccagcacagcggatgttttcacacccagcaagacaaaggccgtcgtctccgccatgacactgttccgttccaagcagaggccgggattctggactcctcgaaaaatcaaaaagaaacaaggaaaacaaacaacaaatacagcaacaaacagaaaaaactgaaaaccaccaaaatcgtttgcccgtttgcccgtgccaggggtgatctgggcatctgttgcagcagaaggcgcttgtgtggggctaatttttcttttggtgggggggacaagctgttggcttgtttgctatttcaacttcgtttataattaacttaaaaaaaaccccaccattcagcctagtcaacaacaaacaaagaaaaagcagacatcggaagagaaatgccataggaagcggcatgaatacatgccacagccggtgccacttgccactcggaaaacctcagggaaagatgccaattctacagctgcgaagaaggcagagaaaggaggataaaggtctacaactagaaatcataaggaaagaatactgcttgtataatcctggattgcaattgcacacagcctctgctgggagaagagagggaatatttaaatggagatatagatgggtataaattaaaagataggcacctatcgattgcgtataaacacatgtgtaaggttgtatgtgtatataaatatgcatattttcagacaaacgtttagatatgtatatattttgtgctacaggtatgggtatgtatataggtgtatatgtttatgcatatacacacatatgtaggatgtatgcatgtgtgagaaaaaggagggagagagaggagagagaaggaaatatgtgtatgtgcatgtatgtgtatgcatacatcccactttttgacccaggtatacacagaagacaaaataaaaatcatactccagcagcaagcaggcagccagagatttatctacattcactgctatcaccagggagatgaatggggccgatctgaagcccttttacaagatccactatgggagtgaaggaggaggagggatgccacacagacatgcacaaacttgaaggcagagcgatttggaaggggctactgaggaaacactggtggcataacgcaggggagaagaaggggaaagaggcttgtctctctctctctatgttttaggtggttgtttttaaaaaatctgcaaaagggtttcagggaacggctggtacttacgttgtctgcgttgctgtggatcctgaaaggtgttctgttggcaccgggcgctgagccaggggcaggcgctggaaacaaaagggagagacaaaaaaataaagtgattcaatgggaatattaattgctgctcttgtggattttacaaaacacataaactgttttctttttctttcttaaaaaaaaatgtggattggcgcgtgtcccttttgcatggaatatacaagtagtatgggatttacagcccagttacgggactcaggattagctgcgctggcatcttttgggcatattcttccttttaatgaatgagctttcgctgttaatgaggaataatcgtttggctaatgagctttgaaacattaagagaaaagaggttttttccgttaatcgctctggtgcgactgcatggatggattacaaaagacagcaataggaacgcagtacaaagggggggacctctcctgcagtgggagaagcaccgagatgggtgatgtgtccctgcgtctttccttccttctctctttcgctctctctgccaactgctatgggtttccataactctgcaatcaaagtggatggtcgggaaggattattacacagagtgaagcctccgctgttaatgtctccagtgtttaatcatcatacagtagaatggttttatgcatatttcatttgcatatcattaaactgtgttagtgaggggcattcagaaccaggagaagtacaaagttggggagagagggaagaaaaaaaggtccctatgatgcttatcttcaaacggggacttgttccatgatctgtcttctacttttgctaaaatcattatgacttggaaacctttgaagttggatacaaccttggattcttctaattcctgcagagcagtgtattttacaaaacagcagaaatgttcctgcactagacaattaaaggaatataaactccagtgggctgaaactagtagctctttggggaatgcagtagcagaggcttctacaaataccaacacttaaaaatatataataaacagcatcatattagaaacaaagaaaacgaagacaagaaatattaacacgtggattatatttgtttcttttggggggtaatgaactaaagagaatgaagaagccatcggtaatttatcccttcattaatgaacagtcacctttttgtatgtgtttgtttttgtcctttctttttgaagagggatgttgttacttttgaagcaattagtcaattattttgtagctctgatcttttccccctgcacccgacaggacagaaaggtggtggttagggaatatgtgagtacttggggagggggggacttggtggggagagaaagaatacagtgagttctttgtagatcttatacatgcacaacatattaattgggggcttttaaagctccctcaatgggctatttcattcctggtaaaacagcagctggttagccactactggtgactcttcaaatattacttcatttttattctgtcgccgttgttgttgtcttgctttgtttttcctcagttaagaatgaaaatgtagtatcaccccctctttagtgagtctcttctccatcttcttcactccaatttccaaactgtaaaacaatgttggcttaatactgagtcctggtgcacagtctaactggcacaacttgatttggaaatgagatgctgctttatatttaaattaccccggctccccccttatcctccaaagctttgtctctgttatgaatatgcagatgaggcctgatgtgattacactgtacaattactcctatccatggtggtgtcaggggctgctagggagacagagagtcagacagcctccaagccaatacagagttttgttttcggtatttttcctatctccttggcactgcggcacatgcagatgtcgctgttgttctttataaagccctaatgtatgcaaaagcataacgatttggtttggacgcaaagcatcaacgaaatattatggatgtcttcaagaaagggggagagaaaatcctgactgaaggaatgtccacataaattatttttatttaaatgaattcaaaggatgggatgagggcaagtcagacggagtcgcgtggaaaacatgaataatattaatatgcataaagaattctcaccaacgaggagaagctcctcactacagctcttgggacaaacaggttcattaggaaacagctcagagcgactacagcattttgctatttcaattttttcccttattttaaatgaagagtcagacagatgtgttttctttgcatggcagcattgagatggatccaatctgcgaaatttgctgcccaaatagcatttctaatggaaactggaactaaacaagggcacggatatgggagggaggggagaagagagaatacacgaagaagagtatattcagagccactgcatggcattttgagtacaggaggttttcaggaacgatctttgcttcattagtctcccctgtgggctcctgatgtagggagctatcagggtataccaagatgagcactgagacaggcctttctaggtctgaggctgaggaaagcagcggcaacttggtgcctgtcccccagagctgtctacagttcagaagccaaaagcacagctacttctaatttggggatgcagtagagtgcctactgatccaggtatttgtgaaagatggaattcttggtgctatcatagtatacattgctaaagagcagatgaaatcggctgcttaaggaggcctgataatatttatgttggttaattctcatgataatgataactgcacttgtctagtattttcagaatgttaaaattaccagtgtggcttaatgcatgtttacaataaatagagagggacaaagagtgaatgagcctattgggtggattcaaaactgataaaatatttggactattactcatggtctccaaggattaacaaagaaagtcaaagaagcagtagtcggaaaaaaagagattttgttacttcccttgggcaggtggacagagttcaaattactttcataattcagctaaaagaattttatacttcagttgaaattacatgaagacatttttgatctgatatacatatctgcataaatttctattatgacatcataacgttgacctggaactggtctgattataagcatgttctaaatactgttgctcttcacctataatctctaaaacttccatttataagtttcttttaagactccccctccaataatttccaactgttacacgattctcaactgttggtacagtgtacaaaactacagagtacagtgaattgatgattatttggagaatggctatttaatctgaattattcatatttaacctcttatactttccatctctgttgccagaattacggatatagaattttgaaagaatacatgtaaagaattaagcacagtatctgcacataacaagctctaaataagtgttagattttattactgctatcattactattattacttcagtgtgttggttaccatttgagagaaataaggaaaagaaaataaaattcaatttaaaattcaacctttactttcactattaaatagcaatgcaggtaaaaggctgagtggaaaagcattaaatagatattcatggtgaatagactgtgaatgatctgtaatcagaagtcaaactacagcttatgtcaatgcacactagacccatgaaagagttc

SEQ ID NO: 395 - DNA, 5165 bp, Homo sapiens; identical to SEQ ID NO: 394

SEQ ID NO: 396 - DNA, 7095 bp, Homo sapiens
acagtgcggtaaagccaagggagattatccagacccccaggagcgaacagcaagcagcaaccgaaggcgcaagtgccaggattacagcctaggctgctccaactatgagcccttcctcggaccctgggactcggctacttggggtttgggggtcttccacaccacagaggcacaaagctgactttaatcactttttttcctttaaacttgattctgccgcagtggagccagcacagcggatgttttcacacccagcaagacaaaggccgtcgtctccgccatgacactgttccgttccaagcagaggccgggattctggactcctcgaaaaatcaaaaagaaacaaggaaaacaaacaacaaatacagcaacaaacagaaaaaactgaaaaccaccaaaatcgtttgcccgtttgcccgtgccaggggtgatctgggcatctgttgcagcagaaggcgcttgtgtggggctaatttttcttttggtgggggggacaagctgttggcttgtttgctatttcaacttcgtttataattaacttaaaaaaaaccccaccattcagcctagtcaacaacaaacaaagaaaaagcagacatcggaagagaaatgccataggaagcggcatgaatacatgccacagccggtgccacttgccactcggaaaacctcagggaaagatgccaattctacagctgcgaagaaggcagagaaaggaggataaaggtctacaactagaaatcataaggaaagaatactgcttgtataatcctggattgcaattgcacacagcctctgctgggagaagagagggaatatttaaatggagatatagatgggtataaattaaaagataggcacctatcgattgcgtataaacacatgtgtaaggttgtatgtgtatataaatatgcatattttcagacaaacgtttagatatgtatatattttgtgctacaggtatgggtatgtatataggtgtatatgtttatgcatatacacacatatgtaggatgtatgcatgtgtgagaaaaaggagggagagagaggagagagaaggaaatatgtgtatgtgcatgtatgtgtatgcatacatcccactttttgacccaggtatacacagaagacaaaataaaaatcatactccagcagcaagcaggcagccagagatttatctacattcactgctatcaccagggagatgaatggggccgatctgaagcccttttacaagatccactatgggagtgaaggaggaggagggatgccacacagacatgcacaaacttgaaggcagagcgatttggaaggggctactgaggaaacactggtggcataacgcaggggagaagaaggggaaagaggcttgtctctctctctctatgttttaggtggttgtttttaaaaaatctgcaaaagggtttcagggaacggctggtacttacgttgtctgcgttgctgtggatcctgaaaggtgttctgttggcaccgggcgctgagccaggggcaggcgctggaaacaaaagggagagacaaaaaaataaagtgattcaatgggaatattaattgctgctcttgtggattttacaaaacacataaactgttttctttttctttcttaaaaaaaaatgtggattggcgcgtgtcccttttgcatggaatatacaagtagtatgggatttacagcccagttacgggactcaggattagctgcgctggcatcttttgggcatattcttccttttaatgaatgagctttcgctgttaatgaggaataatcgtttggctaatgagctttgaaacattaagagaaaagaggttttttccgttaatcgctctggtgcgactgcatggatggattacaaaagacagcaataggaacgcagtacaaagggggggacctctcctgcagtgggagaagcaccgagatgggtgatgtgtccctgcgtctttccttccttctctctttcgctctctctgccaactgctatgggtttccataactctgcaatcaaagtggatggtcgggaaggattattacacagagtgaagcctccgctgttaatgtctccagtgtttaatcatcatacagtagaatggttttatgcatatttcatttgcatatcattaaactgtgttagtgaggggcattcagaaccaggagaagtacaaagttggggagagagggaagaaaaaaaggtccctatgatgcttatcttcaaacggggacttgttccatgatctgtcttctacttttgctaaaatcattatgacttggaaacctttgaagttggatacaaccttggattcttctaattcctgcagagcagtgtattttacaaaacagcagaaatgttcctgcactagacaattaaaggaatataaactccagtgggctgaaactagtagctctttggggaatgcagtagcagaggcttctacaaataccaacacttaaaaatatataataaacagcatcatattagaaacaaagaaaacgaagacaagaaatattaacacgtggattatatttgtttcttttggggggtaatgaactaaagagaatgaagaagccatcggtaatttatcccttcattaatgaacagtcacctttttgtatgtgtttgtttttgtcctttctttttgaagagggatgttgttacttttgaagcaattagtcaattattttgtagctctgatcttttccccctgcacccgacaggacagaaaggtggtggttagggaatatgtgagtacttggggagggggggacttggtggggagagaaagaatacagtgagttctttgtagatcttatacatgcacaacatattaattgggggcttttaaagctccctcaatgggctatttcattcctggtaaaacagcagctggttagccactactggtgactcttcaaatattacttcatttttattctgtcgccgttgttgttgtcttgctttgtttttcctcagttaagaatgaaaatgtagtatcaccccctctttagtgagtctcttctccatcttcttcactccaatttccaaactgtaaaacaatgttggcttaatactgagtcctggtgcacagtctaactggcacaacttgatttggaaatgagatgctgctttatatttaaattaccccggctccccccttatcctccaaagctttgtctctgttatgaatatgcagatgaggcctgatgtgattacactgtacaattactcctatccatggtggtgtcaggggctgctagggagacagagagtcagacagcctccaagccaatacagagttttgttttcggtatttttcctatctccttggcactgcggcacatgcagatgtcgctgttgttctttataaagccctaatgtatgcaaaagcataacgatttggtttggacgcaaagcatcaacgaaatattatggatgtcttcaagaaagggggagagaaaatcctgactgaaggaatgtccacataaattatttttatttaaatgaattcaaaggatgggatgagggcaagtcagacggagtcgcgtggaaaacatgaataatattaatatgcataaagaattctcaccaacgaggagaagctcctcactacagctcttgggacaaacaggttcattaggaaacagctcagagcgactacagcattttgctatttcaattttttcccttattttaaatgaagagtcagacagatgtgttttctttgcatggcagcattgagatggatccaatctgcgaaatttgctgcccaaatagcatttctaatggaaactggaactaaacaagggcacggatatgggagggaggggagaagagagaatacacgaagaagagtatattcagagccactgcatggcattttgagtacaggaggttttcaggaacgatctttgcttcattagtctcccctgtgggctcctgatgtagggagctatcagggtataccaagatgagcactgagacaggcctttctaggtctgaggctgaggaaagcagcggcaacttggtgcctgtcccccagagctgtctacagttcagaagccaaaagcacagctacttctaatttggggatgcagtagagtgcctactgatccaggtggacaaaacaaatcttttttggaaaccaacgaaacaaaaataatctggagctgtcttggttgaagcagcgtgcgggattcagacacctcccactcagacccctgcccttccttcaacattggcatctaaagaatctctccagcgtttggaggaaatcaagttggaagttaagcaagaagcaacacaaaaaactgagtaactacaaagaagtaaaaagtaaaaactctgcaagttgaattgttagctggcaggctaccatgtgatattggctcagaattgtcttgtgttagtaaagatacaaacatttgaattctatttatgaactttgaattctgcttctgtaattagacttttttttttttttttggacagagtctcactctgtcgcttaggctggactgcagcggaatgatctcagctcactgcaaactccgtctcccgggttcaaatgattctcctgcctcagcctccccagtagctgtagctgggattacaggtgtggatcaccacgcgcagctgaatttttttttgtattttcagtacagacggggtttcaccatgttggccaggctggtctcaaacttctgacctcaaatcatccacttgccttcgcttcccaatgtgctgggattacaggcatgagccagtgtgcccagcctgcatgttttttgtttgtttgtttgtttgtttgttttttgagatggagtattgctctgttgctcaggctggagcgcgcgatctcagctcaccgcaacctccgccttccagattcaagcaattctcctgcctcagcttcccaagtagctgggactgttacaggtgcatgctgccacgcccagctaatttttttgtattttagtagagaaggggtttcaccatgttgcccaggctggtcgggaactcctgagctcaggcaatccgcctgcctcggcctccgaaagtgctgggattacaggtgtgagtcactgcgccaccgcatgttttttttttttttttttttaaagagaattattctaaattcaagatctacctctaatttatgtggtctttttttattatgtacttggattaggaatttttgtatttttgtttgtacaacaaaaaatatgtaaacatccccaaataaaaaaataggtgccctagatctgtgacactggaagtgctgttttcctggctcaatatcccttatttggctaagaaaaaaagggcagtttccaactcatttgtacttacatagccacagactcttctacttgtatggcttattaacatcaaaaatttatattctattattatatgtgatatattacactatactacattataattatccccaaaacaaaactgatcatttatttctctcaaacatatttttaatatatttaagggtaaagtagaataaaactgtggttttcagaattattttttcagaggcagacaaaataaatcttttttagaaatccaaaaaagcaaaactttcccaacttccctatttcaacttaactttgaatccccaggctgatatctctttaaactcaaattagtagcctctctttatagtcgtagctgataatgaaggcataatctttcccctttagacatgaattctggagctcctcctcctccctgctagctctttccacagctaccaacttttcttgagtcaagtctatttctcacactttttctatgtactgctattagaatagtcctcaagtgctctatgatgttatttccttactcaaaaacttagaattgttctctatagttcaacttcctctccatctctgtgtgatggttaattttgcgtcaacctgattgggccacagggtgcccagatacttggtcaaacattattctgtttttgtgaaggtgttttttggatgagattaacatttaaattggtagactagacaaagcagataatctaggattggcatccaatcatttcaaggcctgaatagaacaaaaggctgatcttcctcagaataagtgaaaattatcctgcctgatgggcctcaaactataccatttgctcttcctggttctatagcagcttccagcctttggacttgaaagcggatacaagctctacagattttggactagccagtgtccataatcccatgataggtatctcctattagttctgtttttctgaagatcactgactaatatactgtttacccaactctgtagtaccatttcataagatttttttttttttttttgacagtgtcttgctctatcacccaggctggagtggaatggtgcaaacaaagttcactgcaccctcaacctcctgggctcaagtgatcctcctacctcagcctcctgagtagctggaaccacaagtatgcgccaccatgccttgctagttttttaaatgtttgtagagaaaaagtctaaccatgttgcccaggctcccagatcgtttattagacctcaaaatattctctactacaatgaaataaatccatttgtcaacttctacccaatttgcataattccactgaaatgcttttattaaataactgatatgcatttgtaccacctacatttgcctctcacatatatctctccagctaggatgttaactactttgacaacaggagcctctattttctttacttctttccacagtgataacagagattaacaatgtgaagtatagtttaaagactattaaatatatatatatacttaaatcataaaaagtcaggaaacaacaaatgctggagaggatgcagagaaataggaatgtttttacactgttggtggggctgtaaactagttcaaccattgtggaagacagtgtggtgattcctcaaggatctagaactagaaataccatttgacccagccatcccattactgagtatatacccaaaggattataaatcatgctgctataaagacacatgcacttgtgtgtttattgcagcactattcacaattgcaaagacttggaaccaac

SEQ ID NO: 397 - DNA, 2428 bp, Homo sapiens
aggcggctctgaccccgcccccctcgctgggctcctcctacaaagcctgggcccgtgggggacgcacatggtcctgttcgtactccaggatggcggcgtaaagggcccgctgctcccgttcctccggggtcagggcgacttggctgcaaaacctcctggggagaaaggcacgcggtgggtgccggggccaggccctccccgcagcggccccaggggcgggcaggagtcccacctgttggcggcctcctggagccgcagccggcgctcctccatctttctctggagctgggtgcagagtcaaggggccgagcgtgggatctgagcgggccctcggttcccaaccccgtcccacacccggagaggccgggacgtcccagggacctcctctcggtgaggggctgtccccagggaggcctcctccagtggcgtcagctctctggaaatgtgacaagctgctgtctagaccccaggaagcccagtggtgtctggacaccagaggagtctctctcatcctcccggattgctctgaggccaggagctttgtgactctgccccctgaagcttctggaagatctcgggtggcagaaaaggagagagctttcctccttcatcggagtatacacggcggtgtcggccggcaggctggggaatgggagcagctgcaggcatggttggcttcaggcgtgttttccctgcaagccatgggcctctgggaagtggccgttttacagagacaaggacgtgctgaggggatcgcctcacccatctcccaccggctgtgtccccaaagtcctgccttcccgtagcttggcatggagcacctctgcgcgaccatggacctgctcacacagcccttctgcgcgccgtgggagctgcctctctgtgactcgcccctggacccaccgccccagcgcctgacccacctccctgctgcccttcacagaaaacttctcatagactcccattttctcatcccgccccgatttagcccccgactccccccggaaactgcccttacccgtccccaccttgccagacacggtgggccactggagttcctctgtcttctgggactttgctctccccaggggatcctctgccactcctccacccaactcctcaatcttggagcgccagagctcagccgagctcaccggctccctagggagctggggcaactgttagctccccctgacctgtgtgatcctacgtccagtggctgccccgacctctgtgatcccacgtccaggggctcccccgacctctgtgatcccacgtccagtggctcccccgacctctgtgctcccacgtccagtggctcccccgacctctgtgctcccacgtccagtggctcccccgacctctgtgctcccacgtccagtgggtccccctgacctctgtgatcccacgtccagtggctccccctgacctctgtgctctatgtccagtggctccccctgacctctgtgatcctttgtgcagcggctgctggcctctcaaacttaatgtgttcattgcggaacttgctattcctctccttgccagtttgctcctgccccatctgcctcctgcaagtctgctctgttccaccttcaggacgcaccccgaggccgtttactgctcccatcctgggtggtctggccactgccatcctcagtcctcacctgaggctccactcccaggctgtcctctccctcaaagctcaaagtctcttcaagtttccctgcacaccagaacggccccagttccacccaaggcatgcacacagccccaccccgcccactcctatttcagggcctttgcacaccccacagctggaatgctgccccacgtctgtgccgctcactggagccagtgtcttgccacaccccagtctccatcttcttatccacaacgctggtcccttcctgccactatatcacactgagtgtgggctggtccacctactacaaatggtcaggctagaaggatacaagagacccccgccgaagcctggcacccatcaagggctaggatgcccacaatttgtccagcatggaggaagcagcagggctcagccatgcctttttctttttcttttcttttttttttttttgagacggagtttcgctcttgttccaggctggagtacaatggggtgatctcggctcactgcaacctctgctcccgggttcaagcaattctcctgcctcagcctcccgagtagctgggactacagacacccgccaccaggcccagctgattttttagatttttagtagagacggggtttcaccatgttagccaggatggtttcgatctcctgacctcaggtgatagcccgcctctgcctcccacagtgctgggattacaggcgtgagccaccgcgcccggctggctgagccgtacctttagtggtttccacttcttctagtaacacctgggagat

SEQ ID NO: 398 - DNA, 2428 bp, Homo sapiens; identical to SEQ ID NO: 397

SEQ ID NO: 399 - DNA, 3100 bp, Homo sapiens
ggcccgtgggggacgcacatggtcctgttcgtactccaggatggcggcgtaaagggcccgctgctcccgttcctccggggtcagggcgacttggctgcaaaacctcctggggagaaaggcacgcggtgggtgccggggccaggccctccccgcagcggccccaggggcgggcaggagtcccacctgttggcggcctcctggagccgcagccggcgctcctccatctttctctggagctgggtgcagagtcaaggggccgagcgtgggatctgagcgggccctcggttcccaaccccgtcccacacccggagaggccgggacgtcccagggacctcctctcggtgaggggctgtccccagcttctgattctgcagggaggcctcctccagtggcgtcagctctctggaaatgtgacaagctgctgtctagaccccaggaagcccagtggtgtctggacaccagaggagtctctctcatcctcccggattgctctgaggccaggagctttgtgactctgccccctgaagcttctggaagatctcgggtggcagaaaaggagagagctttcctccttcatcggagtatacacggcggtgtcggccggcaggctggggaatgggagcagctgcaggcatggttggcttcaggcgtgttttccctgcaagccatgggtaaccaggggtcaagcggtgggccacatcccacagaggagatgcgggcttgggggatgccccaggagagccgcctactgcaggagacccaccaagcttggcggccgtcgactgggccctctccagacactgctgtgctagcttcagcatcttggaggtgtcggggggcacagtttccccagcttctgggggagggacaagaaggctggtcacagtcggctctaccactgttacttactgctgagataaaatgaggcaacggaaaaggcaggcaagcccactgcccccctcagcacccccactgaccccgggcaagcccactgcccccccatcccctcactgaccctgggcaagcccactgcccccccatcccctcaccccgggtaagcccactgcccctcccgtcccccaactgactgaccctaggcaagcccactgcccccccatcccctcaccccgggtaagcccactgccccttccaccccccactgaccccgggcaagccgactattcctcatggaccccaggcaaggcccctgcccccaccatggaccccaggcaagtccccccacccacgcatttctaatcatctgccctggttttgcctcctgagtctgctaaggctgtgggcccctcatcgaggcccgtcacagcctcgaccctaaacaggcctttagtgctcactcagcttcacttgcaactgcaggcctctgggaagtggccgttttacagagacaaggacgtgctgaggggatcgcctcacccatctcccaccggctgtgtccccaaagtcctgccttcccgtagcttggcatggagcacctctgcgcgaccatggacctgctcacacagcccttctgcgcgccgtgggagctgcctctctgtgactcgcccctggacccaccgccccagcgcctgacccacctccctgctgcccttcacagaaaacttctcatagactcccattttctcatcccgccccgatttagcccccgactccccccggaaactgcccttacccgtccccaccttgccagacacggtgggccactggagttcctctgtcttctgggactttgctctccccaggggatcctctgccactcctccacccaactcctcaatcttggagcgccagagctcagccgagctcaccggctccctagggagctggggcaactgttagctccccctgacctgtgtgatcctacgtccagtggctgccccgacctctgtgatcccacgtccaggggctcccccgacctctgtgatcccacgtccagtggctcccccgacctctgtgctcccacgtccagtggctcccccgacctctgtgctcccacgtccagtggctcccccgacctctgtgctcccacgtccagtgggtccccctgacctctgtgatcccacgtccagtggctccccctgacctctgtgctctatgtccagtggctccccctgacctctgtgatcctttgtgcagcggctgctggcctctcaaacttaatgtgttcattgcggaacttgctattcctctccttgccagtttgctcctgccccatctgcctcctgcaagtctgctctgttccaccttcaggacgcaccccgaggccgtttactgctcccatcctgggtggtctggccactgccatcctcagtcctcacctgaggctccactcccaggctgtcctctccctcaaagctcaaagtctcttcaagtttccctgcacaccagaacggccccagttccacccaaggcatgcacacagccccaccccgcccactcctatttcagggcctttgcacaccccacagctggaatgctgccccacgtctgtgccgctcactggagccagtgtcttgccacaccccagtctccatcttcttatccacaacgctggtcccttcctgccactatatcacactgagtgtgggctggtccacctactacaaatggtcaggctagaaggatacaagagacccccgccgaagcctggcacccatcaagggctaggatgcccacaatttgtccagcatggaggaagcagcagggctcagccatgcctttttctttttcttttcttttttttttttttgagacggagtttcgctcttgttccaggctggagtacaatggggtgatctcggctcactgcaacctctgctcccgggttcaagcaattctcctgcctcagcctcccgagtagctgggactacagacacccgccaccaggcccagctgattttttagatttttagtagagacggggtttcaccatgttagccaggatggtttcgatctcctgacctcaggtgatagcccgcctctgcctcccacagtgctgggattacaggcgtgagccaccgcgcccggctggctgagccgtacctttagtggtttccacttcttctagtaacacctgggagat

SEQ ID NO: 400 - DNA, 3100 bp, Homo sapiens; identical to SEQ ID NO: 399

SEQ ID NO: 401 - DNA, 3100 bp, Homo sapiens; identical to SEQ ID NO: 399

SEQ ID NO: 402 - DNA, 2710 bp, Homo sapiens
aggcggctctgaccccgcccccctcgctgggctcctcctacaaagcctgggcccgtgggggacgcacatggtcctgttcgtactccaggatggcggcgtaaagggcccgctgctcccgttcctccggggtcagggcgacttggctgcaaaacctcctggggagaaaggcacgcggtgggtgccggggccaggccctccccgcagcggccccaggggcgggcaggagtcccacctgttggcggcctcctggagccgcagccggcgctcctccatctttctctggagctgggtgcagagtcaaggggccgagcgtgggatctgagcgggccctcggttcccaaccccgtcccacacccggagaggccgggacgtcccagggacctcctctcggtgaggggctgtccccagcttctgattctgcagggaggcctcctccagtggcgtcagctctctggaaatgtgacaagctgctgtctagaccccaggaagcccagtggtgtctggacaccagaggagtctctctcatcctcccggattgctctgaggccaggagctttgtgactctgccccctgaagcttctggaagatctcgggtggcagaaaaggagagagctttcctccttcatcggagtatacacggcggtgtcggccggcaggctggggaatgggagcagctgcaggcatggttggcttcaggcgtgttttccctgcaagccatgggtaaccaggggtcaagcggtgggccacatcccacagaggagatgcgggcttgggggatgccccaggagagccgcctactgcaggagacccaccaagcttggcggccgtcgactgggccctctccagacactgctgtgctagcttcagcatcttggaggtgtcggggggcacagtttccccagcttctgggggagggacaagaaggctggtcacagtcggctctaccactgttacttactgctgagataaaatgaggcaacggaaaaggcctctgggaagtggccgttttacagagacaaggacgtgctgaggggatcgcctcacccatctcccaccggctgtgtccccaaagtcctgccttcccgtagcttggcatggagcacctctgcgcgaccatggacctgctcacacagcccttctgcgcgccgtgggagctgcctctctgtgactcgcccctggacccaccgccccagcgcctgacccacctccctgctgcccttcacagaaaacttctcatagactcccattttctcatcccgccccgatttagcccccgactccccccggaaactgcccttacccgtccccaccttgccagacacggtgggccactggagttcctctgtcttctgggactttgctctccccaggggatcctctgccactcctccacccaactcctcaatcttggagcgccagagctcagccgagctcaccggctccctagggagctggggcaactgttagctccccctgacctgtgtgatcctacgtccagtggctgccccgacctctgtgatcccacgtccaggggctcccccgacctctgtgatcccacgtccagtggctcccccgacctctgtgctcccacgtccagtggctcccccgacctctgtgctcccacgtccagtggctcccccgacctctgtgctcccacgtccagtgggtccccctgacctctgtgatcccacgtccagtggctccccctgacctctgtgctctatgtccagtggctccccctgacctctgtgatcctttgtgcagcggctgctggcctctcaaacttaatgtgttcattgcggaacttgctattcctctccttgccagtttgctcctgccccatctgcctcctgcaagtctgctctgttccaccttcaggacgcaccccgaggccgtttactgctcccatcctgggtggtctggccactgccatcctcagtcctcacctgaggctccactcccaggctgtcctctccctcaaagctcaaagtctcttcaagtttccctgcacaccagaacggccccagttccacccaaggcatgcacacagccccaccccgcccactcctatttcagggcctttgcacaccccacagctggaatgctgccccacgtctgtgccgctcactggagccagtgtcttgccacaccccagtctccatcttcttatccacaacgctggtcccttcctgccactatatcacactgagtgtgggctggtccacctactacaaatggtcaggctagaaggatacaagagacccccgccgaagcctggcacccatcaagggctaggatgcccacaatttgtccagcatggaggaagcagcagggctcagccatgcctttttctttttcttttcttttttttttttttgagacggagtttcgctcttgttccaggctggagtacaatggggtgatctcggctcactgcaacctctgctcccgggttcaagcaattctcctgcctcagcctcccgagtagctgggactacagacacccgccaccaggcccagctgattttttagatttttagtagagacggggtttcaccatgttagccaggatggtttcgatctcctgacctcaggtgatagcccgcctctgcctcccacagtgctgggattacaggcgtgagccaccgcgcccggctggctgagccgtacctttagtggtttccacttcttctagtaacacctgggagat

SEQ ID NO: 403 - DNA, 2710 bp, Homo sapiens; identical to SEQ ID NO: 402

SEQ ID NO: 404 - DNA, 925 bp, Homo sapiens
cagctccctgtcttttggcagacaaggagccgctgcaaggctgtggatgaagctttctggtcacaaagccccttctcctggggctgctgtgggagtagctcttggcacacacttccacccagagacttcacatcccagctgacgagggcacggtcctgagagctggcagcaaagatggggtggggtggatgctgctcagtcattggagcagacggagtgtcccaggagtgggcggaaaatgtctctttaggagcctgaggttggcccctggtgcccggagcctgaggccccacaacctccccatgtcctcctccgttccccacgactgctggtgagaagtcctgcctggagttttgcagggacccctccctggacccagaagggtccgcgcttcaacactttcagagatcatttagtccatcctctttgacaaacggggaccagggaggtaaggaactgcccagggtcacacaggaaccagaccacacaatatcaccacctccctctgcccagcacacttaaagccgcgtgcaccgcgctcaccaggagcatgtcagcacctccttgagcgtcctgcggagctcctggctgtggaaggcgtagatgagggggtcgatgatggcattgcagatgatgagggcgagaaagaggttgaagttcttgaagatgcagccgcacgtggggtgctcggggcagaggacgatgagtgtgagatgcaggaagaaggggccccagcagaggaagaaaatgcccagcaggatggtgagggtgacagcgcctttaaggccaaagccctggtggaccgggcgctgcctcttgtggagccgggcgatgccctgggcgtgctggcaggcccgggccagcatgtggacgtacagcacggccatgagcaccagcatagccaggaagaagaccacgaggcaca

SEQ ID NO: 405 - DNA, 925 bp, Homo sapiens; identical to SEQ ID NO: 404

SEQ ID NO: 406 - DNA, 925 bp, Homo sapiens; identical to SEQ ID NO: 404

SEQ ID NO: 407 - DNA, 925 bp, Homo sapiens; identical to SEQ ID NO: 404

SEQ ID NO: 408 - DNA, 925 bp, Homo sapiens; identical to SEQ ID NO: 404

SEQ ID NO: 409 - DNA, 356 bp, Homo sapiens
ccggcccagcccgcgcccgccgtccgcagctcccagcgtgccccgcgccaggggccgtcttccggcggaagttgtctcttcgccgccgccgcagcctctgccccactcgtgagggatccgagggctccgtccttgtgctgtcttcgccccggctcccaggggtcaaacgagggtcgggggtggggacacgcagcctagccactgtcctgcctgggatccggtctcccccgccccccggctgcagggtggataaagaggaagatgtgaagaggaggcagacaaaagcaaaaggacatcctgtcagtaggaaacggccgaattacaattcagatgtgcaatgtttgcataagtaaact

SEQ ID NO: 410 - DNA, 2087 bp, Homo sapiens
ggggcacaaccccctaagagtctctcttgctcctggacggcatgatgggaagtgacctgttccacttgtcgagaactagtggaccccatgtttccctctagcttggacactatggttctcaggaggaatcctcacccccggccaggagcccttctcctccacctactactgctgggctctacctcccccacttttaattttaagccttggctcaaaattcactccccaatatttctccccttctctctactttcgtcctcaataatcccaagcagctggggtgtacaagtcgttttcacctcttgggaccgtgctaaagggggcagcctatgattaccatgagggtatgggagccctgaactgcaaatctatcatttccagagaagccagaaatctgaaattttctgtgcaatttctgaaactttaaatcagaattttttctaaaattcaatgggtcagataccacagtctgtgtaatcaatccattccaaagtctcctccttttgctaaaggagaagattccttaaaacaaggcagaagccaactgaagcaagggagaaccacctcccacccctccccacacacactttccacacccagtaactaggtctctgggcggataattctgttttgttttgttttttttaattttggacagctaatctctgtagtgaggaacccagaactttcggtaatgtaagggatattagtctggttgtcagaaaaatgggctggagtatttgtgctgtgtccctgaccataattcctgctcagttgcttagctccctggcaactatgtctgagggctaaacaggagttggtgtgatcttccagaaaaagaacaggcttcttgtcttgcagaggcaggaagtcagaaaacaagagtgtgtgtgtgtgtgtcagggggtggggggtgtcagtgctctccagcctgggtgacagagtgagcctgtctcaaaaaaaaaaaaaaaaagagtgagcaatcctcaaagtatccaagaacaactacacgccccaaggggaaaaccagctggattgcttaggccttggctgtagtcactaaagaatggcatcaatctcagaaaccctcaagatggggtcaatttaggaagaagctgtttattctgtactgtctttggcctccacctaaggtctggcatcgacccacccttcaggctcatagttcagcgaggttagagcacttagggagaagcaggtaacacatccagggtttgagagaagaccagcacacaactctcagtgatctggatagaggaagactaaattactgtggttcaggcagccttgccaggtgatgtcttcccaaaacttctcagatgtatattcctccctgattgtgccacctaggcctccttcccttcagtttgggacttaaaacttccaccaataacgtgagtatgtgcacccatgcagcagcctgtccgaggactcacaactggagacacctccctgcttggcgctgcccagaaaactatgtagatggccaagaaaccgacttccattataaaatgtttttctgtgtgtaccaggaaaaagatgctcaaaatccaaatcaccactttattatgtggcagtcaccatggtgccagcctctgccttccccatgtcaccctcctaatccagggctctccaaccatattcatgtttgcgttttcacaagtcaatgtccattaaggccttgtgctccccttttcttcagtacagggcagggcccttataatttgggtctcaagaattgatagttgtctcttaactggttctggtgaggcgcactcacagcagtgagtggagggtcctgggagggcatggatgacggaggctgcccctagaggagctggatgtaggagcagagacatttcttgatctttcactctgcaaactggtccaagaacttgagaggggatgactttgtcagtgtccccaaaaacatggagcgaaggcaatgacaagggcctttgcaggatggattccttgaacccaatgccccggggacagaaaccagacaccaagaggataaaccgtggcaaggggaagcggggatcgcctgcctggcccagggcacacac

SEQ ID NO: 411 - DNA, 990 bp, Homo sapiens
ccgatgctgggggacagggacggggaggggcagcgggtggatgatgaggtatctgtgcaggcccgggggccactggcctcaggatgcagggagaggtgggcaggctgaggggaggggcgagctccacgaggctgctctaactgccccgtgggtcaggcctgccatcgctgtcacaatgggaatagcaaagctggctctcccagagccacggggtctggcggaggtggctgtgctggggtgggtacagggctcagcctctgaggatggtgacctggtttgtaactgtccctttacccacaccaggagagagaaataaggaacagtcccctgggaggtgtccaggaccaggagggaacaggaagggaatttttaggcatctaaggattctttatttccagagaaaatctattcaagacctttgctgacctcctctgtgcctgcagggcactccaggaaatcctcagctctgtcccctccccccggccccctcgccggcccaggctgcaggggacggggaaggggaaggacagccaagtccctccttccccacctcagcctgccctcctgaggtccagagcccagtggcagggattggggtgagggcacaggaagcttggcagtggctgggtttggtttattgttggtagagaatcattttaagtagtatctacggtaacgaatcacagtgactgcaaccgggtcagagagccccaggctgaggccccacctgtccgggtgggactccagaccagccacttcctatgatctgtcacctgtgctcagagcaaggcctgggaagagaacatgaggctccggaggaaagccgggggcctgggccacctcaccagacagcaatagcagcagcagcacacgaaggcggggcagggcgggggagaagtcagggagcgtgacgtccacatcgcactgatttccgagggtagggaggggaagcaggagcggcactggagctggcactgggccggacaggtg

SEQ ID NO: 412 - DNA, 990 bp, Homo sapiens; identical to SEQ ID NO: 411

SEQ ID NO: 413 - DNA, 2569 bp, Homo sapiens
ccacatttgctttattataaagatattacaaaggactcagttgaagagatgcataggacaaggtatgggggaaagggtgcaaagctttaatgccttgcctgggtgtgccatcctccaggaacctccatacgttcacatatccaaactcagtcctcttggttttgtagggaggcttcaagatgacagcattcctttccgcagagtataggacagaaccctctctgaaatgggggtcttaggactcacagaaaggtaggggaagatcaagagtcccgtcttagtgaaggtaaaagggcagaagtgaagtgagtttcctgtggcctaacacacacaacatgactataacaagggctatagaagttatgaacgaggaactgtgggcaaagatccgtaaaaccagagtgactaaggcagtttacctaaaattatgcgtgaaaccattctcaggtacactatgaatatcaaaggtgtatttctagatatggtattcctgcatttgtgtaatacacccatgggtacttcttgcgtaccaaaccactaactagagattaactggcccgtgatttaaagtccttactctaagtatgcacttaccatgccagttttagtaccagaaaacattatttctctactataaacctgggaaaaacagcgctccccacaccattcccaattttgtgccaagatgagaatcacatttattgaagttacattacagaagatagtgaaggggaaagattgagaacttccttagtacacccttactccaatattttctattagcactgcacatgtattactgcctagtgtccattggcatagaagcctaagaactgcttatgttgccagtcttagacaaggataagcatttttaacaaatacaggtaaaatctcatttgttgctgcaatcttttcacaataaagttaagctgtgtcattaagaaccaacagcgtggccgggcgtgatggctcatgcctgtaatcccagcactttgagaggtcaaggtgggcggatcacttgaggccaggagtttgagaccagcttggtcaacatggtaaaaccccaactctactgaaaatacaaaaattagctggtgtgcccctgtagtcccagctatgtgggggactgaggcaggagaactgcttgaacctgggaggtggaggttgcagtgagccgagatcgcaccactgcactccagcctggggcaagagagactgtccaaaaaaaaagtgaggaaccactttaacttgccacctaacttatcaagatcaggaagattgtcttagatcagaataccgttttcaacattaagtacctgcaaaccatcttttaaaaagcctgcatatccaactttttgagatgttgtcttgctctgtcgccaggctggggtgcagtggcacgatctcggctcactgcaacctctgcctcccaggttcaagtgattctcctgcctcagcctcccgaatagctgggactacaggcaggcgacacgacgcccagctaatttttttcttttatatgctaccatgcaacgaaacctttattaacattttgaacaggttcagctattactgaaacttgtaatttctaaacttaagttggggcaaatggctatagtgcagagtaatgccatcactgggcactgcgaatgccatgactgaagaattaacagccacccctcaggcgcaggaccagctgcttgcctgcaaagatgagcctctgctggtcgggggggatgccttctttatcttggatcttggccttcacattttcgatggtgtcactgggctccacctccagagtgatggtcttgccggtcagggtcttcacgaagatctgcataccacctctcagacgcaggaccaggtgcagggtcgactccttctggatgttgtagtcagaaagagtgcggccatcttccagctgcttgcctgcaaagatgagcctctgctggtcgggagggatgccttctttatcctggatcttggccttcacattttcgatggtgtcactgggctccacttccagggtgatggtcttgccggtcagggtcttcacgaagatctgcataccacctctcagacgcaggaccaggtgcagggtcgactccttctggatgttgtagtcagaaagagtacggccatcttccagctgcttgcctgcaaagatgagcctctgctggtcggggggaatgccttccttatcctggatcttggccttcacattttcgatggtgtcactgggctccacctcaagggtgatggtcttgccggtaagggttttcacgaagatctgcattttgacctagtttaaaagtaaaacataagcgtgtcacctcaggatcattgtatttcttgcttttacacctaatattcttcaaaattagcaactattccttcaaaatgccttaaatacgttaatattccgcaagcctcccctcaattttacaaggctaagtcacttaatacgaaattcgtcattcaaggtttcaacgtcaacagcggaaaatccagagcgctctcttaccaagcgtccacagctttccccactaactgttccggatattca

SEQ ID NO: 414 - DNA, 2569 bp, Homo sapiens; identical to SEQ ID NO: 413

SEQ ID NO: 415 - DNA, 2569 bp, Homo sapiens; identical to SEQ ID NO: 413

SEQ ID NO: 416 - DNA, 2569 bp, Homo sapiens; identical to SEQ ID NO: 413

SEQ ID NO: 417 - DNA, 3180 bp, Homo sapiens
gcttcccaagtagctaggactacaggtatatgtcaccaagcccatttaaacttttttgttttgttttgtcaagagcccattgcccagtctggccccaagctctagcctcaagtgatcctcccacctccacctcccaaagtgctgggattataggtatcagccaccacgcctggccacatttgctttattataaagatattacaaaggactcagttgaagagatgcataggacaaggtatgggggaaagggtgcaaagctttaatgccttgcctgggtgtgccatcctccaggaacctccatacgttcacatatccaaactcagtcctcttggttttgtagggaggcttcaagatgacagcattcctttccgcagagtataggacagaaccctctctgaaatgggggtcttaggactcacagaaaggtaggggaagatcaagagtcccgtcttagtgaaggtaaaagggcagaagtgaagtgagtttcctgtggcctaacacacacaacatgactataacaagggctatagaagttatgaacgaggaactgtgggcaaagatccgtaaaaccagagtgactaaggcagtttacctaaaattatgcgtgaaaccattctcaggtacactatgaatatcaaaggtgtatttctagatatggtattcctgcatttgtgtaatacacccatgggtacttcttgcgtaccaaaccactaactagagattaactggcccgtgatttaaagtccttactctaagtatgcacttaccatgccagttttagtaccagaaaacattatttctctactataaacctgggaaaaacagcgctccccacaccattcccaattttgtgccaagatgagaatcacatttattgaagttacattacagaagatagtgaaggggaaagattgagaacttccttagtacacccttactccaatattttctattagcactgcacatgtattactgcctagtgtccattggcatagaagcctaagaactgcttatgttgccagtcttagacaaggataagcatttttaacaaatacaggtaaaatctcatttgttgctgcaatcttttcacaataaagttaagctgtgtcattaagaaccaacagcgtggccgggcgtgatggctcatgcctgtaatcccagcactttgagaggtcaaggtgggcggatcacttgaggccaggagtttgagaccagcttggtcaacatggtaaaaccccaactctactgaaaatacaaaaattagctggtgtgcccctgtagtcccagctatgtgggggactgaggcaggagaactgcttgaacctgggaggtggaggttgcagtgagccgagatcgcaccactgcactccagcctggggcaagagagactgtccaaaaaaaaagtgaggaaccactttaacttgccacctaacttatcaagatcaggaagattgtcttagatcagaataccgttttcaacattaagtacctgcaagccatctttctcctcagccagtcgtcttccatactcggtgattagctgctgcttggctcatcagttaaagcatatacagcaaagagacaagattatggtcccatactaccacccaggttaaacactttggtgtaatacactacagagcaataaacacacagctcatagtcacccaattaattgcagaactgaaagcagttacgttaccactattcaagcagcctcaatcaaaactttgtttctccagcaatccttgattaggtctcaacaggcacatttgctttccttcaatgtaaagaaaatgcctgcaatcacttgagcccaggaatgatagtgagctgtcatcgtgccactgtataccagtctggactacagagcaagaccatcttttaaaaagcctgcatatccaactttttgagatgttgtcttgctctgtcgccaggctggggtgcagtggcacgatctcggctcactgcaacctctgcctcccaggttcaagtgattctcctgcctcagcctcccgaatagctgggactacaggcaggcgacacgacgcccagctaatttttttcttttatatgctaccatgcaacgaaacctttattaacattttgaacaggttcagctattactgaaacttgtaatttctaaacttaagttggggcaaatggctatagtgcagagtaatgccatcactgggcactgcgaatgccatgactgaagaattaacagccacccctcaggcgcaggaccaggtgcagggtcgactctttctggatgttgtagtcagaaagagtgcggccatcttccagctgcttgcctgcaaagatgagcctctgctggtcgggggggatgccttctttatcttggatcttggccttcacattttcgatggtgtcactgggctccacctccagagtgatggtcttgccggtcagggtcttcacgaagatctgcataccacctctcagacgcaggaccaggtgcagggtcgactccttctggatgttgtagtcagaaagagtgcggccatcttccagctgcttgcctgcaaagatgagcctctgctggtcgggagggatgccttctttatcctggatcttggccttcacattttcgatggtgtcactgggctccacttccagggtgatggtcttgccggtcagggtcttcacgaagatctgcataccacctctcagacgcaggaccaggtgcagggtcgactccttctggatgttgtagtcagaaagagtacggccatcttccagctgcttgcctgcaaagatgagcctctgctggtcggggggaatgccttccttatcctggatcttggccttcacattttcgatggtgtcactgggctccacctcaagggtgatggtcttgccggtaagggttttcacgaagatctgcattttgacctagtttaaaagtaaaacataagcgtgtcacctcaggatcattgtatttcttgcttttacacctaatattcttcaaaattagcaactattccttcaaaatgccttaaatacgttaatattccgcaagcctcccctcaattttacaaggctaagtcacttaatacgaaattcgtcattcaaggtttcaacgtcaacagcggaaaatccagagcgctctcttaccaagcgtccacagctttccccactaactgttccggatattca

SEQ ID NO: 418 - DNA, 3180 bp, Homo sapiens; identical to SEQ ID NO: 417

SEQ ID NO: 419 - DNA, 3180 bp, Homo sapiens; identical to SEQ ID NO: 417

SEQ ID NO: 420 - DNA, 1314 bp, Homo sapiens
agtgcctcatgaagctttcctggagcaccatctgggagtttcaggagcgactttttcagagctgggccccggaggacaacgtggtcctcaggaaccttcaaacctccgtgaaggaactcacaaggaaacactgggacctgccacccccagggagcttgctacaaaatgcacataaccacagcccgggtcttgcaatccaagcctggcaaggattcagcatgtcaagggcttcaggtctgaaggtccatggctgtcctgaatcctggatatcaccttcttgcccaaaaaaggagggacgaggctcaaaccgcagcaggccactcacagaaagggacgaaacgttgagtgcgtggcctccctgacacccagacaagactttgggcccaaagccaggctgcagctctggccactgactcagaccagggacgcccccatgcaggccggtgtcccctggccgctcttctccctcctgccaccctctcttcggctgcttgtgtcaataaaaggaaaactggccagttctcagagaaaatgtagctttattatgacataggagagactacaaagcactgggggggaggaggagtgacacagctcctcaaaatggaaggggaaaggaagagtaaacatcttggtaaataaagtctccaaccacagcacagtcattggaatttttttcttcatttttattttcaaacttacagtaaacaaaacaatcacttaaattgtcaaaagaacagcaattttacacaatgaagagcatacacaccaagccaaaatacaatagcactcaggtctatatgttgcagtggtgctggcgctggagggaatgcccagggaggctgcagtgctcaccacgaagcccaggtccacggagggagccaaggtccacagagggccccggggccagagggaggccgcccacactcccagcacatcacctgcctcaaagcactcccttcaggcatctgaagagggaaaggccatgtgtcttcctgggaggcactgaaaggccagccagcatctccaaaatgcaggccattttaacactgctgtgaatgtgctggggtcaccaagggggccccttagtggtcagatgcactttgtcacaatgtacacctacatggggtgattactaggcaacgggaggtttcctgaatttcacagccagatggggagctaaaagaaattcctgaacccaacgcgtaaatattttgttctgacaaagtaaattcacaagaacacatcaaacacaagacctaatgcaaggggcactgcccagctcacaatcctgtgggccaacttcagtcaact

SEQ ID NO: 421 - DNA, 1314 bp, Homo sapiens; identical to SEQ ID NO: 420

SEQ ID NO: 422 - DNA, 4160 bp, Homo sapiens
gacggggtttcactgtgttagccaggatttttgtgcctttttataagcctcaattattttctattaaattaaatcattccctaggacgtctctgaggcctagtctccttggcccccaccccaaataatattttttttaaaggcctggggttaagatatattggtaaccccctcataatgcaagacctcaggaacttaggccactgccagaaggaaatccagaaactcctcccattggcccatttccaggaggcagagctttctgtgagcagggagtggagacttggcagcaatgtcccccaaagcactgttccatcaaatagatctgaaggtgaatgaagcctcccggggagtggggcaggccgacatgaggcaagctttgccaactaattcccttctattgggaaagtattgggctgcctgcacccctggaggggagcaggtgtcagtgctgtctctaattataccacccagggcagccttggatgctccccacattgccccagctcagctgactctggccatgtcattctccagattacaaatgctcagctcaggagagccctcctcctctccaccctgctgtgattctgaggctggagaattccttagttctgagccccaagagagaaatgcccctcaagcagctggacctgaggctgattggcagcactgagcagggccagattcccctctctaccactgtcctcttcccaagcccaatgagcaagaggggaggccgcctggccttctggccagtcacagaccctgggcacctggagcaaaacatggagcccaggagacacacatctaagagctgccacagacacaggcacgcggcctgccatggccgggtggcacagcaccagactgtgagcatcacatgggggtctcaggccccactctgccactagctgtgactgccaccaatctgctttgcctttctgggtttcagtgagcccctctataagtagttacttctctcacagggttgtgaggaagaaggaagaaaggggatgtgtattaaagattacattcagaaggcactgtgaatagtgctttgggttgccaggccaccttacagacagctttatccaggtcccgtcccactgtggaatgccctgtcatctcgttcctcaaatgcgtggagctcctgctctctgcctggcagcggcagagtgctagaactgctccccagccaagctcattcattaattcaacagctccgcaccgctcctgggcaggtacccgggatttagagatgaattagactcatcacctgccccaagggctctggctagtggggagacagatatgtcactgaggaagtgacacagtaatacgagacggagctcagggaagcttccgggagcatcaccaagttgggcagagaggaatgagcgggtggaaagccagaagtaggttggtggggagttctcagcaaggaggaagtaggggccaagggcctgacagacagcagcaaactcccccttggcatccagacaagtcattctctccccgaggggcagcagaggtcccaggagggccacaggccagtgcccccaagcagacaggacacacacacacacacacacacagtggcaccttacagctagacacacacacacacagcagcaccttacagctagagacacacacccacacacagacacacacaacagcagctcagagccagagaggaaaccaagtccgcaggtaaaaattatacttttatttgagtcaccaggagaaagattcacttgtggttcaagtcaaatgttcagaatcataacaggccagaaaggtttgatcccgagcacaagcccacgagggaggggaccaaaacagaccaaaatgagacaacaaccccatataaaaagatgaactggcggcttcacacactcacacacatacacatacacacggatgaaatgtttggacagaggcccatgcccgttccatccagagagaaaaccaagaagtcgatcaagggggaagcctgccagaggagggagcccgcagaagtggcagaagaaggcttcagttggcaaaagaagctggaagaggggtaggaatcacaagctgtcgcaggttttaaaaaacagagacactgaagaatggacgggtcacgcccaggacggatgcgatgccgtggaatgtgctgaagacagatgggggcgctgcgggttcagatggcctccacgtagttggccggcagcatccccgtgtcgccggtgcgctccaccgtcccgtacatccagccgtcgtcgatctgctgcacgttgacgatggtgtccccgtcctggaaggagacctcgtcctcgtcggcggcgctgtagtcatacaccgcgcggtaccgcttctgtgggggaagtgtggtcagcctagggccctgcatgccggctcacctgggtctgagcatttttttctaactctccacgaccctggagcagagcctgggggagcagtgaactcagaaatggagcaccaggctctgctgcaaagattcttaacctctgtgtcttgctttctgagagcaatcgatcttttacaacctttggcagctactaagggccagaggcagagcagggaccgggtcacatcagctctgccccacctccctgaacaggactgcagtaaggtccaccagccatgatgacagagtaatgtctaaaaatacgacatgcaggccaggtgcagtggctcacgcctgtaatcccagcactgtgggaggccaaggcaggagaactgcttgagcccagaagtttgaaatcagcctgggaaacacagtaagaccccccaactccctctttttttttttttttttgagatggagtcttgctttgtcacccaagctggagtgcaatggtgtgatcttggctcactgcaacatccgcctcccgggttcaagcgattctcctgcctcagcctcccaagtagctgggactataagcgtgtaccaccatgcccggctaatttttgtacttttttgtagagacagggtttcatcatgttggctacgatggtctcaaactcctggtctcaagtgatccgctcgcctcggcctcccaaagtactagcgtgagcccatctcaacaaaaaataaaaaattagttaggcttagtggtacatgcctgtagtctcagctactcaggaggctgaggtgggaggatggcttcaacccaggaggttaaggctgcagtgagctagctgtgattgcaccactgctgcactccagcctgggcagcagagcaagaccctgtctcaaaaaagaaaaaaaaaacagaaaaaacatgccctgtatgctattatttgtatgattataagcaccagtagtttcttttagaagccatgatgagtcctgtccaagttcaggacaaagatctttccttgggagaaaaatcttcagaggacagaagacgagtctatcaggttccaccttccaagcctcagccaaaatctgccgcttaagccctagatctaggtaatgttcagtaaggcacacaaaaacctacagcgccacctactaccaggatggagtttaaaaaaagaaagaggaaaaaaaaaagaaaaataaatcctatagctatagacaacattctacctcccctgaccttcactgcccttgactggtctctgaggctccacaggacagtttgaaaccaacaggtctatgggataagaagtcacacctcccatgaagtaacctcagtctctctcatcaccaattctgcctctatcttgggctgagccactcccatccatgcctatatcctgcaacagcctcctgacggtctccctgcttctaccctcaaaccactgcctcttctcaacacagctgccagggtggtcttccaaaaacctatgtcgctctgcacagatcacaggtcacagaggccttcctggggcccacaagtccctgcataatcggacctcccaccctctcccactctagtcaattcgggcttcctgctgctccctgaactttcctagaatattcctgcctcagagcctttgcacttcctgtcctcgttgcacggctcactccttcctttattgaggactttgctcaaatgtcacgtcttttttttctttttttttttctagctggagttttgctcttgctgcccaggctggagtgcaaatggcgtgatctcggct

SEQ ID NO: 423 - DNA, 4160 bp, Homo sapiens; identical to SEQ ID NO: 422

SEQ ID NO: 424 - DNA, 4160 bp, Homo sapiens; identical to SEQ ID NO: 422

SEQ ID NO: 425 - DNA, 4160 bp, Homo sapiens; identical to SEQ ID NO: 422

SEQ ID NO: 426 - DNA, 578 bp, Homo sapiens
gaagcggatgtggagctggttgccgtggtcaatgaacaccctcatggacctgttgacacccttcagggtactaagcagctccgaaccagcacctcaggcgtgtggtccctggccttggtccgcagcttccttggcacagcccttgagccacaagacaccacatcgggcacggccttgagaacactggcgctcacccaagaatgggtcaaaggaaaccggaatgagaagggcgggccgaggtgctcgggcagggagatctctgcctcagtgctccaggccctgccctgccagcctggtggaaaagtctttcatcaacctgggggatgaaggaaacccaccctcctgcatatctggccatccgggaggctggctggacctgagctgatggcttgggactttcccaggcccaacctgcacaagaactgagtctctaggggaaaattcaacacctcaaatgatgtagtatttgatcatttgttgattacatgtccattcattggtttggggctataaacattcttgttaagagctgtggagatcagtgtttgtttaccataaagattttgctttttcccttt

SEQ ID NO: 427 - DNA, 578 bp, Homo sapiens; identical to SEQ ID NO: 426

SEQ ID NO: 428 - DNA, 578 bp, Homo sapiens; identical to SEQ ID NO: 426

SEQ ID NO: 429 - DNA, 749 bp, Homo sapiens
tttaaataagtaactccattgtttttctcttttccaagatggccgatgttatggttttctacgaagtcagtgcttacttagctcactaacagcgctgctgttggcggctgcggctgctgctgtggcaggattttcaatgtggtgtgttttcaagcctcactcactcatcctctcattcccaaacattcagcatccgtgcacactcctcacttccaggtttttcaaaagatgggagatttccagtgggggtcctcaggttatcatcccaatggtaacagatctgaaaacagatggaaaaaaaggtcaatctttgagatcacatatacccaacagagccaataatgctgactcctacaattacatgctcctaggcctgaatggaatttgtcaacatttcaaggattgacactctttcttcttgtcctatgtgccattgacctgctcttattaacacctacatcagagggtgcgagggaaactcaaagagccaattttactgagatctgtggagtaagataactaattaagagtgaaagaaattaaaactgtatttcagtctgggtgcagtggctcaagcctttaatctcagcactttgggaggccaaggagggagaacttcttgaggtcaggagttcaaacccagcctgggcaacaggagatcttgtctctaaaaataaaaaaaaattagccagtcatggaggtgcttgcctgcagtcccaaccacctgggaggctgaggcaggagggcca

SEQ ID NO: 430 - DNA, 749 bp, Homo sapiens; identical to SEQ ID NO: 429

SEQ ID NO: 431 - DNA, 2817 bp, Homo sapiens
cgggttggggatggatctggaacacaacacaaagtgttttctgaaaacaaagcattttctgccttactggagactctgtcccagctggcaatgcaaacatgtacacacaaaaactgctagaacactctgttctgatcccacggctcccacaaacaaaaaaccaacccatggctgagccggaaggtctgggtgtcatttattgacagcagtttatacacatttgtttccttcccagtgcaggcatagagcccgtgagaagggcagtctctgaatgagggggccaggaacgtaggtcggacacgtctttggcaggcatgttcagccccagcaggatgcaatccttcaagttggaattccactgggtatctgagagggaccaaggtggggggtagagaggaagtcttcaacaggactcacatctcggtccaggcctcctctctcactatacaagtccatccaagttttaggaccctggggggcaacagtcaggcccacccacctcaacaggggcagattcttcaatctgtgcccagttcacacacacctgtttccgctggtcacacagttaaagagaatcagacttatggtaacagacagaccacttcctctctgcccctccccggcacctctcttcagcagcatctgcacaggaaccgctgggaagacggaggcctgccttctcagttcagccgcacatgccctcatccgcaaaccttccatcagtgacaggacggaggccacacgtggataaaaaagtagatggatgtgagaagaatgaaagagtttcatttgatagactaattagagatctgaagtgattttacctttatttccttcactttaagccaatcatgaaatttcacagtgatttctggggtgggagcagaaggaaggctgtgttaagaatcatcggggctgtggcccagtcagcccgcggaggtgcaggcagggtgggccctcactggggcagctggaggagcacggactgccccgctggcaggtaggtgatgttccgagagcgtgagagctggtacgcgatgtcctctgcagcttccagcttgcgcagctcgatcaggccatcccctgcagtggccagtgagttggcaatcagctcagctgccttggagtcgccctcagcagagatgatggccgcctttttctgttgctcagcctaaaagaatggaggtggagacaaagatcaaacctcagggcaccgcatgtcaggctacaaccaaaggcccttcaccagaaagccaccttcccaggctcctgaaggaactcggggagtttacttcctcctgatggctagcgggggaagcggggggaagcagagcacattgcccaccagtcctcccctatcctttcatgctcactccttgtcacgggagggatacatctctgttggctgcaggaatatttgtcttatttcaaagtcctcattaatattaattgcaatctagtttaacaaccctactctgagccaggagaagccaaggccaaggaaaacagaagcaaaagaaaggtggaatcaatcctcaaggctcatcttttcctccagccttaagtctaaaggacttcatcaaagccaggacagggccgggtgtggtggctcatgcctgtaatcctggcactttgggaggcggaggcaggaggatcacttgagcccaggaggccaaggctgcagtgagctatgatcatgccattgcactccagcctgggccacagagctgtcacaaacaaacaaacaaacaaacaaacaaacaaaaaacctcgggatggctaaggaagagcagcatgcacttttgactgttcctagagctgcctgtgagttaggctggttcctgaccagaatccaggcacccagagtgagatctcctaggcttgccctaccaatatcaataggaagacagctctctgcaacgtgtgaccttcaggagtgtgaggaagaagacagtattaagcctccctgaaattacatacaattttgaaatgactgggccctgcgtctatttgctcaacaaacatttactgtatacctactatcaccaggcactgtactagacttattataatctctgaagttatggcagatacaaagcaacacaagtctctgcccacacagtgttttcattctccaaaattaaatctatccctcttttcccattttatttcttgctgtccccatctccccaccaattagggatactggtggtgggaagaaggggacaacaataaatgaacatgtctttgcaaataccagaaagaccaggctgctacgcaaatacactgtgtcccatcacattctttgacacatctggatggatttagcactagaaaaaaatctagtgacgaaagcacatctggtgcaacgtttgatcttttttgctgtcagctttcactatgtaactatggttaaaaatgacttctcagtgaagctgaaaatactccaggagaaacatttttatttgtaagagagtgtttttgatctcagagaagtggaagaaaaattacccttcagtgatttaggaacataactccacatatccttgactagcccctgaagactctggaaccaattgcagaagtacaattccttcaagccccttctgattatcccggaagaagggatgacagatgatgaatttccaggccacccagcaaatggggaagctgagtgccggagaaaggggagagagaggctcctgccatctggtcgaaggctcaccttttccaccacaaatctggccctctctgcttcctgctgagccacctgtttggcttccaccgcttctgtgaactccttcccgaaggtcagat

SEQ ID NO: 432 - DNA, 2817 bp, Homo sapiens; identical to SEQ ID NO: 431

SEQ ID NO: 433 - DNA, 2817 bp, Homo sapiens; identical to SEQ ID NO: 431

SEQ ID NO: 434 - DNA, 2817 bp, Homo sapiens; identical to SEQ ID NO: 431

SEQ ID NO: 435 - DNA, 952 bp, Homo sapiens
ctcccctctccaaactcaggccctcccaggggaggagagatgagagggctgagtccgaaggctgcagtgttaataatgaatgggggaatgagggcccttatcaggtttccttcccaagggaggcaggaaggcccattcacccctctggccagtattgcgggagggagaatgtcagcccacctctaggctgtgctgcaggggacatgcactgaggaggctcttcccctgccacaggggagaaaatgaggcagggaaaggtgaagatgaccctcccagcagggatgggctgcggaggtgtttcttgggtatgctccaagcccctgagcttcaggaaggggcgggatgatggcaactggagattaggatggagaggaaatagtggaacttccaggcaccagcccctcctcccggtggccacccacatcctgtttctctccaccaccctttcctgggggtagtacccctcttgcaggggggcagggagtgatccctgaatgttaagccaaaggtagagtggacacagggagcttctgatccagtccccttggttacaggcctggggcggagtcttcccaggatgacatagggctggtcggggtggggggcatgaggtcccaatgaggggaccccaatatggttagcattcaccctggacgtcctggttcttcagtcagtgagtcagggacaggtagggggaaggagaagaagccctagaggacagtttggagggctggtggacagtgggccaggaaggctgagtactggtggccagctgttgccagggagctgggatgagaaggcaggtgtgaggcgagggactccaggcacagcaactcctgcagccaaggagtcagcagaacctctgtgagctgggccaccagaaccttaactggctgttaaggcaggtgaacggagtgcctggacgaggacctcctgcccgctcccacgcccc

SEQ ID NO: 436 - DNA, 1013 bp, Homo sapiens
tggctcacgcctgtaatctcagcactttgggaggctgagatgggtggatcacctgaggtgaggagttcaagaccagcctggccaacatagtgaaaccccatctttactagaaatacaaaaattagtcaggcgtggcagtgcgcacctgtaatcccagctactcaggaggctgaggcaggagaattgcttgaacctgggaggtggaggttgcagtgagccaagattgcgccactgcactccagcctgggtgacagagtgagacttcatctcaaaacaaaacaaaacaaacaaacaaacaaacaaaaatctctatatatagatgtgggtctcaaaaacaggactgcctcttaggtggtaaacactgtccccaggtctgctttctagtctgatgactttacaacaacactctatttggcatctcaatgcaatatttatctgtagaaatacagtctttctggggagttgctttttactttttagagatgagttcttgctctgttgccaatgctggagtatagtggaacaatcatagctcaccatagcttcaaactcttgggctcaagtgatcctcccacctcagcttcacaagtaacttggacacttagactacaggtgtgcgtcaccatgcctgggtaattttaaatttttgatagagacagggtctcgctatgtttcccaggctgtattactgtctttgattacataggtcagtgacaacagggaactaggtctcacagtgacctgctatggacttcagagattccttggcaaggcattgtcgaaaatataaggttcatgttgaagttgtcataaaatttttatgtagctgtataaatgtggacagcagatataaaaataaggaataccttagacttctgtaagccagatataagtacctacctaagatgctagaaatgatattctaatttaaattttttttttaatttttagagatggggtcttgctatgttgcccaggctggagtagagtggctattcacaggcataattata

SEQ ID NO: 437 - DNA, 1013 bp, Homo sapiens; identical to SEQ ID NO: 436

SEQ ID NO: 438 - DNA, 1013 bp, Homo sapiens; identical to SEQ ID NO: 436

SEQ ID NO: 439 - DNA, 1013 bp, Homo sapiens; identical to SEQ ID NO: 436

SEQ ID NO: 440 - DNA, 1013 bp, Homo sapiens; identical to SEQ ID NO: 436

SEQ ID NO: 441 - DNA, 1013 bp, Homo sapiens; identical to SEQ ID NO: 436

SEQ ID NO: 442 - DNA, 9319 bp, Homo sapiens
caggagtgagagtttattaaaaagttttagagcaggaacaaaaggaagtacactacacttgggtcaggcaggcaacttgagagatctaagtgccctgcctgacccttaacttggggttttatgtatttggcatagttctgggatttacgtctcatctcccctgattcttcccttgcagcaggctgtccgcgtatgtggtgacctgccagcacttggaaggggtcgcatgcacagtgtgattactgaagttgcgcgcatgctcacttgaggcatttttccccttaccagtcgtgcgttcccagaggaagatgccgggagcacacccacccagctgtgacaaccaaaaatgtctccagacaccattccaaaaccagcgggagacaaaatcgcccgacagtcgttgctttagtgagtgaatgttgacctaagcgtcacttcgcctgtcttgagtctaggtcggggagtgggttcagttagccaatcagagaacgctgatggggcgaccagtatatgctcatgaaatgggtggctgacctcttggggtcagaagagggaaaagttttactgtgtgttggctaaggaccattttaagtccttcagtgaccgattaccacatgagaacacaagagggcgctctaactaatgagttccgcggccgagaaaactcctggagtgggtgctcctgggatgcttcaggtttagacaccggggttacggcagctgccgaggaaggctaaagccagcgtcctggattcagacagaccttttagccattaaatccactaagaaagatccctgcgcatgaagtttcctcctcggaaatataggcagaagggaaagtaattttaaactcatgtgtgctccacaggccgggggcggtggctcatgcctgcaatcccagcactttgcgaggccaaggagggaggatcacttgagcccagaagttcgagaccagcctgggcaccatggtgaaacctcatctctgcaaaaaaaaaattaaaaattagccagctatggcggctcacgcctctggtcccagctacccaggaagctgagatgggaggatcgcttgagcccaggggttcgaggctgcggtgagccattgttgtgccactgcactccagcctgggcaacagagcaagcccctgtctcaacaaaacaaaacaaaacaaaaaattcagtcgtgctgcataagtaaggcaccaggagtaggaatagggtctttgcagctcccgtggcaattgcccttctctggtggtggcaagggactaaggaactccctggacacaggggatctggctgtccccagatcatcaacagagacatgaaggtcgttagaggtcgtctgatcctttgacctcaatctgagcccaccactcagaaaacctggaaattgtatgacattttcgtgatacaactcggtgtgtgtgtgttggggaaaggaaccaacagctttcatcatattgtcaaaagagtctaggctgggcatggtggctcacgcctgcaatcccaacccaaaggcctgtggagcacacatgaggacaaggcgggcagatcaccaaaggtcaggcattcgagatcagcctggccaacgtggtgaaaccccatctctactaaaaatacaaaaattagccaggcgtggtgacatgtgcctgtaatcccagctactcgggaggctgagacaggagaactgcttgaacccaggaggcggaggttgcagtgagcagaggttgcgccgctgcagtccagcccgggcaacaagagcgaatctccgtctcaaaacaacaaaacaaaaacatagacctgctcggttctctctgtgacttcagaggcccaaggagtcctcagcactatagatgcatgtggcccctcagaagacaacatttcacagatctgcaaagagcaaaggtcaaatttatttaatacaacatccacgagggtccctgcagctgtgtcactgaggcaaacaggaaaagtgattttggctaggcgtggttctcatctgtgaaattccacagcgcaatgacagcagcctctctcccacccactcaagacactgtcaggaatgtcttaagacctcaggagaccacttctttagcaagcaattttgttttttgttttttttgagatggattctcactctgtcactcaggctggagtgcagtggcgcgatctccgctcactacaacctccgtttcctgggttcaagcgataatctcacctcagcctcttgagtagctgatactacaggcatgcgccaccacgcccggctaattcttgtatttttagtagagacagggtttcatcaggctggtctcaaactcctgacctcaggtgatccgcccacctcagcctcctgaagtgctgggattacaggcgtgagccaccttgcctgccctggcaaggaatacatttttaaaaattagtaagaaacatacacatttcaagttttcaattaagaataatatttgctgatggcaccatcttcctgtctttcagccttcagcatggtagaggaaaagagaaagagtgtagacaaaaacagttgaagaacatctgtgcttgttccaccttcattttctgttttgtgcgttgcctgaatgaacggtgtcttcaggttggtatttcacaggcggtgctcccaagtagtctggttttcccatttgtggagggcgaggtcatagaggggacagggggaggctgtctggtcagcactgtgtatttccaaagaacaaggactagccaaaactacaagcctttgaaggaccaaaggaaaagagaaaaaaccagcctctaaccaggccatgcgctagaaatgattgagtataaaaaagaaaattggtttctgtgtatgagggtgcatggaaaaggtctttatctctgcacaaaacaaaatattcaagtttcagaatatcccaatggccttgccctggatctcctcttgtgctcttccaatttccaaggatgttccaacttggtggaaggagggtatgtgggaaattcaacagcccctctgtatctctttctacccaacattaacttagcaggatggatttaagaaccggcagcttagcctgaggaattgctgtgttctgtgggagcagggcaggttcataaataagtgcacagaggtcttgaaatacagggattatctgttcttctcggaacatggatgtccttccagggatgtgcatctggccttgctgtctaagttccatcaagggagccttccgttctctgtagcgacaagaaacaaggcaagttatgatcacacctctcaagattgaagattgccctggtggagagaaatgcaaaatgacagcacttctcaaagaaaatgcaaagcagggctgtcacacactggtcccccaccctgcagggttctctctgtgacttcagaggcccaaggagtcctcagcactacagatacacgtggcccctcagaagacaacatttcacagatctgcaaagaataaaggtcaaatttacttaatacaacacccaccagggttcctgcagctgtgtcactgaggcaaacagggaaagtaattttggttaggtgtggttctcacctctgaaattccacagcacaatgactgcagcctctctcccacccactcaagacattgtcaggaacgtcttaagacctcaggagaccacttctttagcaagcaattttttttagatggattctcactctgtcactcaggctggagtgcagtggcgcggtctctgctcactacaccctccctctcctggctcctgcccgtatgtatttctccttctctccatgcctgctctgtagggaccatagcctctgtccctgcatacatgttggacatcaatcacatcagtccaccaagtaacttcatcaagcacccatgtacgcccagcacagcgtcccaagggtgccccacttacccacagaagaagaaaggcaactttgtaagagatctgacttctagctccagttctgtctctagctaacgtgagatgtacccgtttgaggcctgttttttaattttgaaaatgaaggactgaacttagatggtccaactgaaatgttttaaaatgatatgattctaccttaaaaagagaatgaaattctgatatattttcaacacaggaaaaccttgaaaacgttatgctaaatgaaataaggcagacatgaaaggacaaatatatgattccacttatgtgatgtacctcaaatagtcaaattcatagagacagaaagtagacagtggttgctaggggttgctggaggggcaatggggagttagtgtttaatgggtacagtgtttcagtggctgctctgcctatggagtagccattcttttgtttctttacttctctaataaacttgctttcacttaaaaagaaaaagctctggagatggatagtggtggtggttgcacagcaatgtgaacggacctaatgcaactgaattatacactttaaaatggttaagtatacactggaaaatggtgaatttgccgggcgggcgcagtggctcacgcctgtaatcccaacactttgggaggccgaggcgggtggatcatgaggtcaggagttcaagaccagcctggccaacatagtgaaaccttgtctctactgaaaaatacaaaaattagccgggcgtggtggcgtgtgcctgtagtcccagccactcgggaggctgaggcaggagaatggcgtgaacccgggaggcggagcttgcagtgagccaagattgcgccactgcactccaacctgggcgacagagcaagactccgtctcaaaaaaaaagaaaatggtaaatttaatattatgtatattttatgacaattaaaaaaaaggattcctggctgggcatggtagctcatccctgtaatcccagcactttgggaggccaaggtgggtggatcccctgagtttaggagttccagaacagcctgggcaacatggcgaagccccatctctatcaaaaatgcaaagaattaggcatacatggtggtgtgcacctgtagtcccagctactcaggaggctgaggtgggaggatcacttgagtctgggagatggaggttgcagtgagctgaaatagcacccctgcactccagcctgggtgatagagtgagacttcatctcaaaaaacacacaaacaaacaaaaaaagcaaaaaaacacccacaaaaggattcctggattccttctgccatcctgtagtgctctttaacagcttcaaatggtatttgtgtcacctatccacctatcagtgcctggacccttatctgacccacactgttctctatgctggggatgcaagaagctgtccccaagaattttatattgtatcaattattgataaacaacaccactatgaagtagaaggtataagaggtctcaacaaactgcagaaggggttcagaggcactgagagggctctgggctgggcagtgggggattcacagaagcaactctggagtcagcctaaagattggattttgacaaatggaaggagcccttggagggaaaaagagcagggcctgctgggagataccagagtagaggggggccctgggcaacagtgggccctgaagagcaggcagcacctaagtccactattctggaccctccatgtgcacaggacactctgctgcaggtggaactcagcaaggcagaagctggagatggaggatgacccagggtcttgggacctccacagccagcctggctggcttcctgagggtgagctgggatagtgtctccattttgtttcagccctgctgggtccaaggacccttggggaacaggatgcagggccgaggtgccccaactagaaagccaaggctctggcccctcctctgccaggagagccccatgcaagtgggccaagcaagccgtgctggccccagaggctggaggcctgccagcgccggcagccaccctgccctatttcctctgctctgcctggatgggggagacatgactctggtgtccagcctttctgtgggccccagaccaagtccctccccagacacctccgctctctctctgtgggggcagccaatgcctggggcaccattgcagaaccaaagccacagacaggaagggctgggccacaatcaacagggccttagggattttgaagtaaaggttaacacgctcacatccaaggtctgggcttgctgtgcttaaatcagaagccagccatcagccacccaagtgcagttgtgaaatcgccctgccttgtacccggaatatggtgtggtctccctcaaaggtcattttgatttcaacacaccctgggatctctagttcctgcttctacaaagtgctcctgtgggcacttgcaatagaccaggtctatgccaggtgctcattcaacccttgcaacaaccaagtgagggagtttatgattcccagtttacagattaggaagtagaggtcttgagaggccaagaaatttgcccatggtgacatggctaagaagtgggaagtcaagtgttaatgtgggtctctgattcctaagtcaaagcctggccttggttgaatcctatgccttgggtaagcaactgctacattctccatatgtggcagggtcatttcatggccaaatcaagttaagtcccccatccacacctactattgcccaagtgatgaaaagagcttgagatcaaccagcttttatatggtggtttgcagcttgcagcttttatatggtggttgcagttgctcatttcatccttaaaatcctaataggttgctcttatcatcattgtcatcaccatctccactttatagataaggaagcttgagcttgaggaagacaggctcacccaaaagacagctggaaagctggagctcccctcccatcccctgatcctagcacctggacagtttccactgtagcccagctgcctcctggcctccaggaaggggggaggcgagctatagctgccaattgcctttctttctgtaagaaggcagggtcctttccaagatcccaagactctcacaagtccagattcacccctttcatttaagtacagggtgttctcttccatgctatctgtctgcgtcggccacacacacaatttataaacaaggtaaaaatggcagaggaaaaatgaagtcagaatgtgccattgaagcaagtcaaacaataccaaattagtctttggctacgtggctatctcattgttaagatatttcctccaatgttttcagaggcaacggccattaaacaactgggaatgatcgccaggtttgatttcaggaaggaaatctcctcccatttccccactgggcaattcaattaattttctcctgacccacaccagctgattattagggaagctatacctgcttcttttataaacaaaacccatttgcttaaaggttcaaaattcctttcccaacggctggaaaccctgtgctcccatcaaatgactctattcttttttctggggggacaggaccagtcatgggtgagctctcagaaccatcctgggagcagactttgaggcccaagggccagcttctgggtaaagttctgtctggcctggagctccaagcctttgtccagagacaccctttggatccaagacaaagtaaataagttggtcctacagggtgttttgggtggacccagccatgtttatcgcttcaggagaacacatctgtgtcccgcactgcccagggagcaaagacctcattttccactctctcaaagccattattgctgggacagcaacttcacatcttggagggagtctctgtcgtgacagaggactggccgcagagtatagaggcctgggctctgttcctcactctattagccatccaggtgaccccagacacgctattctaccagtgcaggcctcagtttcctcatctgtaaattgggctccttgtcccagtgacacgatagtctctgatttcaggagtctgagtgggttttggctaggaaaaaaaacaaccattcatttcattcctcttttccttaaattcatagctttcttccataaaaagaatgtcagtggcttcctgtctgtcaaaggcataatgagctctgttttacaagagtccagacatgggcaaaacaaaggaagccaggggcccactggaagagctaccagaaatcttgctgaaagttcttcccagacctaaaagaagtttatgcggcaaatgcctcatttcttcagatattagctgcccagttaactcctgcattgctgggtagctcacaaaaaggttgggattggaagacacgtctttgcaaaagttgaacgtgggcctctgtgtctttcataaaccctcccatctgccaaatagcagattcctaactccatttcctacagaatgaagcttcttaacaaggcatgtaaatcctttggatttaagccctgacttatctttctcccgtcacttgtcactgtcacactcttcttttcccatcccacactgcttgaaactggtcatccctcacccttgtgctcctgctgatctttctccctcaatgctgccatcactccattcattcttcatggcccattccaaatgattccttggggaagaggccactagctaggtctctgttctgtgttcccataggctctggcatagctcactttgctttatgataagtgatcacatgtctgattccctcatcagaaggtgaactgaggtcaagaagcttgggtgtctcctgcagctgatggcctggtgtgtagggggtaattagaatcggctaaattgcaatgagctgtcagctgctccactcctccaagcatacaccctagatctgcctcacttccagagcctagactttggcgttaaacgaaatgtgtgctttgcttgtttggcgctaagcaccccagagtcccaatcccttcacgtgtgggctgagatgtaatgatggaaattgcaggagagaatattcgaaatcagaactggccaaggctagtcagagaagcccagggcttctggtctgaaacagactagggagcggggaagaattcatgtgaatgcaggacgtgggtgagtctggaaatatttcactgttcagtggagtacttttaaatataatgtatatgaaatgtgtacttacagagtatctgctttccacggcatctacaaaacaaaggatgacatgcgcataaagtccctggcacttcatttaaaattttctttattttttattttttgagacagagtctcgctttgtcactcaggctggagtgtggtggcgccatcttggctcaccgtaacctctacctccagggaattctcctgcctcagctggcactatctcggctcactgcaccctccgcctccc

SEQ ID NO: 443 - DNA, 9319 bp, Homo sapiens; identical to SEQ ID NO: 442

SEQ ID NO: 444 - DNA, 9319 bp, Homo sapiens; identical to SEQ ID NO: 442

SEQ ID NO: 445 - DNA, 9319 bp, Homo sapiens; identical to SEQ ID NO: 442

SEQ ID NO: 446 - DNA, 9319 bp, Homo sapiens; identical to SEQ ID NO: 442

SEQ ID NO: 447 - DNA, 9319 bp, Homo sapiens; identical to SEQ ID NO: 442

SEQ ID NO: 448 - DNA, 3949 bp, Homo sapiens
ttagagcaggagtgagagtttattaaaaagttttagagcaggaacaaaaggaagtacactacacttgggtcaggcaggcaacttgagagatctaagtgccctgcctgacccttaacttggggttttatgtatttggcatagttctgggatttacgtctcatctcccctgattcttcccttgcagcaggctgtccgcgtatgtggtgacctgccagcacttggaaggggtcgcatgcacagtgtgattactgaagttgcgcgcatgctcacttgaggcatttttccccttaccagtcgtgcgttcccagaggaaggtaggtcatatactggttaaattccgccattttgcctcttggtgcgcatgctccaggctgcttgcccagctcctgagatcttatcgggaagcggctgatcaccagatcagggtgttttgtatctattgagagactgtccttgcttggagctggctgcaaccaattattattttacagagacagtttaacaaccacctgaccatcacctgatggtagcctgacattcctgtgggggccctcacctgtcctgctcatgtttgcctagctccctactctaacatttccactctgtggaccccaggttgagatcttctgcagggaagactgtcctcaaatagcctgctggggagacatctccttcccgtttacctttccatttgcccttgcggtgttaggcaaaggctgaagctggcctctgtggcagagggtttcttcccaacacgccaatgacgctggtggagagtcttaaaaacagctgtgctggggagagttcttggtgtgtacctttcagagacctcctccttaagactctcaaagactgagtcaggccagtgggagcctggcagcaattcttaggggacagtgacagctttttgaggaggactaattggcttctagggctggaggccacttgggtctgacagactgccctgctgccatccctccagggcaccccccactcccttgcctcagggccttcctgcacttcttccttttgtcctcaatgttcttcaccccaccttttccactggtaccctctgcctatggtcaaggctttggtgagacccactttcctcttagaccttcctggatcccccaaagtctgtgttggaagcccctcccatgtgcccttgtttgagcttttaattttccaccatgacgcttgtcacactgctttgtaattggctctctgttagtctgcatctctactgggttgtaccttccaggaggacagctgccatgtgactcttgtaatcttcccaccgccaacacccagcacagcgtcaggaacacagagcatgatgagcacaagcttgttgagcaaacaggaaaagtgattttggctaggcgtggttctcatctgtgaaattccacagcgcaatgacagcagcctctctcccacccactcaagacactgtcaggaatgtcttaagacctcaggagaccacttctttagcaagcaattttgttttttgttttttttgagatggattctcactctgtcactcaggctggagtgcagtggcgcgatctccgctcactacaacctccgtttcctgggttcaagcgataatctcacctcagcctcttgagtagctgatactacaggcatgcgccaccacgcccggctaattcttgtatttttagtagagacagggtttcatcaggctggtctcaaactcctgacctcaggtgatccgcccacctcagcctcctgaagtgctgggattacaggcgtgagccaccttgcctgccctggcaaggaatacatttttaaaaattagtaagaaacatacacatttcaagttttcaattaagaataatatttgctgatggcaccatcttcctgtctttcagccttcagcatggtagaggaaaagagaaagagtgtagacaaaaacagttgaagaacatctgtgcttgttccaccttcattttctgttttgtgcgttgcctgaatgaacggtgtcttcaggttggtatttcacaggcggtgctcccaagtagtctggttttcccatttgtggagggcgaggtcatagaggggacagggggaggctgtctggtcagcactgtgtatttccaaagaacaaggactagccaaaactacaagcctttgaaggaccaaaggaaaagagaaaaaaccagcctctaaccaggccatgcgctagaaatgattgagtataaaaaagaaaattggtttctgtgtatgagggtgcatggaaaaggtctttatctctgcacaaaacaaaatattcaagtttcagaatatcccaatggccttgccctggatctcctcttgtgctcttccaatttccaaggatgttccaacttggtggaaggagggtatgtgggaaattcaacagcccctctgtatctctttctacccaacattaacttagcaggatggatttaagaaccggcagcttagcctgaggaattgctgtgttctgtgggagcagggcaggttcataaataagtgcacagaggtcttgaaatacagggattatctgttcttctcggaacatggatgtccttccagggatgtgcatctggccttgctgtctaagttccatcaagggagccttccgttctctgtagcgacaagaaacaaggcaagttatgatcacacctctcaagattgaagattgccctggtggagagaaatgcaaaatgacagcacttctcaaagaaaatgcaaagcagggctgtcacacactggtcccccaccctgcagggttctctctgtgacttcagaggcccaaggagtcctcagcactacagatacacgtggcccctcagaagacaacatttcacagatctgcaaagaataaaggtcaaatttacttaatacaacacccaccagggttcctgcagctgtgtcactgaggcaaacagggaaagtaattttggttaggtgtggttctcacctctgaaattccacagcacaatgactgcagcctctctcccacccactcaagacattgtcaggaacgtcttaagacctcaggagaccacttctttagcaagcaattttttttagatggattctcactctgtcactcaggctggagtgcagtggcgcggtctctgctcactacaccctccctctcctggctcctgcccgtatgtatttctccttctctccatgcctgctctgtagggaccatagcctctgtccctgcatacatgttggacatcaatcacatcagtccaccaagtaacttcatcaagcacccatgtacgcccagcacagcgtcccaagggtgccccacttacccacagaagaagaaaggcaactttgtaagagatctgacttctagctccagttctgtctctagctaacgtgagatgtacccgtttgaggcctgttttttaattttgaaaatgaaggactgaacttagatggtccaactgaaatgttttaaaatgatatgattctaccttaaaaagagaatgaaattctgatatattttcaacacaggaaaaccttgaaaacgttatgctaaatgaaataaggcagacatgaaaggacaaatatatgattccacttatgtgatgtacctcaaatagtcaaattcatagagacagaaagtagacagtggttgctaggggttgctggaggggcaatggggagttagtgtttaatgggtacagtgtttcagtggctgctctgcctatggagtagccattcttttgtttctttacttctctaataaacttgctttcacttaaaaagaaaaagctctggagatggatagtggtggtggttgcacagcaatgtgaacggacctaatgcaactgaattatacactttaaaatggttaagtatacactggaaaatggtgaatttgccgggcgggcgcagtggctcacgcctgtaatcccaacactttgggaggccgaggcgggtg

SEQ ID NO: 449 - DNA, 3949 bp, Homo sapiens; identical to SEQ ID NO: 448

SEQ ID NO: 450 - DNA, 3949 bp, Homo sapiens; identical to SEQ ID NO: 448

SEQ ID NO: 451 - DNA, 3949 bp, Homo sapiens; identical to SEQ ID NO: 448

SEQ ID NO: 452 - DNA, 3949 bp, Homo sapiens; identical to SEQ ID NO: 448

SEQ ID NO: 453 - DNA, 3949 bp, Homo sapiens; identical to SEQ ID NO: 448

SEQ ID NO: 454 - DNA, 3949 bp, Homo sapiens; identical to SEQ ID NO: 448

SEQ ID NO: 455 - DNA, 2747 bp, Homo sapiens
gtggacgcccgcgcagcgcatgctaatgagcccgcgtcgtcgctcgcggattggctggcgcggattccagctgctttccaagttggaggcgcctagtgagggtcagggaggcccggcccgcgccctccccgcccagccgcctccccgtcgaccacccagggctggggcgagccaggctgcctttcgaacttgggggcttctcctcttgtctcccactggtgctctggccgtgaatccatccaggcgccaggagatgacaatccggtaccaaggccggcagtacaggctgaggatggcatttctccaaaaggtttccaagctgcgtcctgggcctggagactgagacagagatccacggactgcagtgcaggcagcccaccccagatccgagtcatataaggttgaaatatcagtaaaaaacatgcagacccaaagatggggaccaaaatccaaagccagagggtcctggaaatcagagggtcttacaacataacaggcagtacaggccatggctcaggctaggcgtggaacagactgcagttctcttctacaaatcaatctagactggacagacagaactccaagggaggaaagaaaaatgaatctgatgttacttcttgaaaccacattttctgaagtcaccatttttatgtatctatcaactcatcatttttatgtatatatcaatatgattttatgatcttattttttcctactaatgtgatgaattaccttgattgattttagaatattaaatcacttttgtattcctggaataaaccctagatggatgcttgattttttctaattccttagcaaaaatgctaatattttatttaggattttgcatctatattcacaagtgaggatttttttcctctcctgacaccaaccaattctccaacacaaactgagtgtcctacaattcaatttaattctgacactacccagagttagcattagcctccacagatttaaggcctcagccctacaagactgtcccaatcagactccagttgcaagtcctgggccacccatacttctgggcaactggttacaaattgggggttcttatgaccacctcccacaggcttgacaatttgctagaatgattagtggaaagcaagaaagtgcttaacttaatattactggtttattacaaaggatacaattcaggaaaagccaaatggaagtgatgcatggagcaaggcaagggagaatgagcacagagctttcctaccctctccaggcacaccactctcccagcaccttgatgtgttcaccaacctggaagctctctgaaccccatcatttagaggttttaatggaagtttcattacataggcatgacttttttttttttttttttttttttttttttgagacggagtctcgctctgtcgcccaggctggagtgcagtggcaccatctcggctcactgcaacctccaccccccaggttcaagcaattctcctgcctcagcctcccaagtagttgggactacaggtggacaccaccatgcccagctaatttttgtatctttagtagagacggggtttcaccatgttggccaggctggtcttgaactcctgacctcaggtgatccgcctgccttggcttcccaaagtgctgggattataggcatgagccctacatagcaatgactgattgaatctttgaacactggtgattacttcaatctccagccccttgtccctctcccctccccagaagtcagtgggtggggctaaaagttccaaccctctaatcatgcctagttctcctttttttttttttagttgtttatttttcttggcatgcagaataagagctattgtctaggtctttctggtgacctcttcatcctgaactacctagaagcctccagccactagtcatttcattagtatacaaaagacactcttgccattgtggagatttcaggagtttcgggagccatgtgccaggaaccagggacaaaacccaaatatttattttttctcataccacaatgattgacattggtctgtaattttttctgcttataatatcctagtccagtttttctattaaggttatggccacataaaaagagttgggaactatactctgttttgctattctttggtagagtttgtccaagtttatgcaagattggtattattcttttttttttagagacaggttctcactctgtcacccagactggagtagcagtgatgccatcacagctcattcactataaccttgaactcctgggctcaagcaatcctcccacctaagcctcctaagtacctgggactacaggtgcacgctgccatgccctgctaatttttaaatttttggtagaggcggtgccttactgtattgtccaggctggtcttgaactcctagactcaagtgattctcctacctcagcctcccaaagtgctgggtgtataggtgtgagccaccacacacagcccatggtattattctttaaatatttggaagaattaactgatgaagcaagccatctggggcttggaattctttgtgagaagttcttgaatagattccatttatttatgagatattggctattcagattttacttttttatgtgggctttggaaagttgtatttttcagggggtttgtctattttatccaagttgtcaatattttggtgtaaagacaataatattctcttatctttgttatatttgtgggatctgtattgatattcctttctaatattgaaaattt

SEQ ID NO: 456 - DNA, 2747 bp, Homo sapiens; identical to SEQ ID NO: 455

SEQ ID NO: 457 - DNA, 2747 bp, Homo sapiens; identical to SEQ ID NO: 455

SEQ ID NO: 458 - DNA, 2747 bp, Homo sapiens; identical to SEQ ID NO: 455

SEQ ID NO: 459 - DNA, 17122 bp, Homo sapiens
gggggggagctgagggctgaggcaggaagatcacttgacccaggaggtcaaggctgcagtgaactgtgatcccacttctgcactccaccctgggtgacagagcgagactctgcctcaaaaaagaaaaagaaacagctgggcacagtggctcacgcctgtaatcctagcactttgcggggccgaggcgggtggatcacctgaagtcaggagttcaagaccagcctggccaacatggagaaaccttgtctctactaaagaatacaaaaattagccgggcgtggaggcatgcacctgtaatcccagctaccccagaggctgaggcaggggaatcgcttgaacccaggaggcggaggttgtagtgagccgagatcgcaccactgcaccccagcctgggcgagacagattgagaccctgtctcaaaaaaaaaaaaaaaagagaaagaaaaagaaaaaaagtgtccctgattgcacgtagatggaaggaattgcctttctctgaagggttggagcattttatctagtcccctcgaatggtatcttggcttaagtacttatgcacctgtgtcttctcccctgctggactggaagcatcttaaattcaactccataagtggatcattttcttatcacccaaagtgtccagcacatgggtgacatagtagacatttaacaaattcagttaaattctacaaacattttttgagcacttatacttgatgggtatatacccatcaagctactagactgaggattcagaggcaaatgagacaaatacagtgatctctgacttccgggagcttacagtctaatctagaagtcagactggaagacaaatagttacacatgtgatgaccgagatcaatgcagtaggtgaactcttgtaaagcaaggggaggcatagtctttgcaggtcaaatgcagggctgatcttctgcctctaaatgtttattaagttttttcttcatataaaagtaaccaatgctctttgtagaaaatttagaaaacagagaagtataaagaagacaaaatattttgtgattcccatcactcagaaaagctaacattttgccatatttacttttaatctctttgctaactttgtggagtgactgaagtctcagattctttgaacagccttattgagatataattcatatgctataaaactggagagccagtctccatactggcagggtggcattctctccactcctccacagtcagattctcatcacaatttgattgagatttgaattagattgaatctgatgggcactcaaagagcttaacaggagcatctgtgtagcaatgtcgagttcacagcacagtggagtggaggagctaagaatctatgaacaataatagcttcaaaataaggtacagaggtcaggcgaggtggctcatgcctacaatcccagcacttcgggagactgaggtgggcagattgtttgagctcaggagttagagaccagcctgggcaatatagcgagacctcatctctacaaaaaaaaaaaaaaaatttgccagatgtggtggtgcgtaactgtggtcccagctacttgagaggctgaggtgggaggatcacttaaacctgggaagtcaaagcgaaagtggcctatgactgtgccactgcactccagcctgggtggcagagtgagaccctatctcaataaataatagtaataataataatagcagtaatgtggaatgatttaagttccctgaaaaagcagtaacatgggataagtactcagagaaagaactgcttctagcccaggatgcatagcaattgggatatcctcccttgaactgggtcttgaaggatgagtaggatttgccatgtggcaaacagaaccagacagaagaggtgagaggtgtggggcaaagaagccatctagtttagctagagtggaggaagctggaagggaaggccggttagaaaaaggctgatgcagctgggcacggtggctcacacctgtcatctcagcactttgggaggctgaggcgggcggattacaaggtcaggcgttcaagaccagcctggccaacatggtgaaaccctgtctctactaaaaatacaaaattagccaggtgcacctgtaatcccagctacctgggaggctaaggtaagagaattgcttgaatttttgggggttgcagtgagccgagattgggccactgcactccagcctgggtgagactccatctcaaaaaataaaaaataaatcttggagggttgaggtagggggttacatatagaccactttaggggtgaccgactagtctaatcgagatgacactggcttgtatcacggagggacagtgggaatggagagaaactgattcaatatttattttaaaggcatagcaaacaataaaggaaaaagtttattctcatatttctagcttgagcagctggtgggacagtaatcccatttactaagatgagaacactagatgaagagtaggtaatggggggaaattatgagttcagttttaaacacatttgaggtgcctgctttgcagacatgtccaggagtctgctggacatacagaactgaatgtggacagaaggaattcagacacaggtctgatggcaactaaagtcaataagctcacatgtggcttgtagctagaaaggggagtagaaagctgtatagatttaaaagtatagtttagttcatttggaaaatgaaaagaatatagattgattttaaatgctgcttaaatgcgtgtggtggttcacacctgttgtaatcctagcacttcgggaggccaaggctggaggatcgcttgagcccaggagttcgagaccagcctggcaacatagtgagactctgtctctacaaaaaaaaaataaaacataatgctgtgttcacgtagttttatttagaatggacagtgacagaaaaacatgctaatcttatctgcccatttctattttagtaggtcctaatttcagagcaaagattgacaggataaaagcaatagttaacaaagattggcccacttacataatgaatgaaaactgacctctaagttatatgctgaatatgtcttggttcctcaggtggaccataaattcatgtataagaaccttttttttggccggacacggtggctcatgcctgtaatcccagcactttgggaggcagaggcaggcagatcacgaggtcaggagatcgagaccatcctggctaacatggtgaaatcccatctctactaaaaatacacaaaattaggtgggcgtgatggcgggcgcctgtagtcccagctactcaggaggctgaggcaggagaatggcgtgaacccgggaggtggagcttgcagtgagctgagatcacgtcactgtactccagcctgggcgacagagccagcctccatctcaaaaaaaaaaaaaaaaaaaatcttttttattatatgcttcactaacctatacaaataacatatttttaagcacttattaaataaaagcaataatggaaaacttaatttctataaattgctaacattacaattaaaacctctgcatactataaactgtgtgaaaattttacatggctttaaaactatcatgaggagtccacatgtaatctaccacaaaagtacagttaaactgaaattactttaatctcattttcataaaagatgtaaaatctttcagatttgtcaaaattgttgacacagaacacttaattatcactatgtttaaagtttcctacttgactttacatagaaaaatactcaagatatcacagcatggaaaaagataatcctatttgcctgaaatcatctttaaaatctgtgcactttattatgcatcaaaaaaggcaatttgaatgacgactatagcttttaaagcaaataaacttaaatgaacagttttattgacaaatataacttgagtaaagaattttactgttccactaagaaaaacagaatatttgatttcctcgacaatgtatcaaaaattcacccacaggtatttgtcatctgagtcatgtgatttcaaaggtttgcatttatgtaactatcaaatagtatatattttgcttccctgaatgctgtttcatatattgatactgatatatcaggaaacagaacttttctgaaaggccacttagttgagattttcttaaaacgcctttatttcaaaattttaaagacttttttttttttttttttgagacggagtctcgctctgtcgcccaggctggagtgcaggggcgcaaactcggctcactgcaagctccacctcccgggttcacaccattctcctgcttcagcctcccgagtagctggaactacaggcacgtgccaccacgcctggctaatttttttgtgtgtttttagtagagatgggatttcaccatgttaggcaggatggtctcaaactcctgaccttgtgatctgcccgcctcagcctcccgaagtgctgggattacaggcgtgagccaccgtgcccggcctaaagatttcataaatactcactgcagatataacaaaaaccattacagtatctttctcctcgagttataagcattggttttaacagctaaaacaatgcaagttgcagatttctcaagaagatggtttgaaaactctatagactacagtataaaataaggtattgaaaatactctcataaaatacgttctgaaaaaaattccaggttctacctcctaagagccataggatcttgggcaaatcaagggcaaattatttaacctctttgagatttagtctcttcatctataaaatgcagacaaaaatagtgcctgcaaggcagggcatggtgacccaggcctgtaatcctatcactttgggaggctgcggtgggaggattgcttgaacccaggagttcgagaccagcctggccaacacagtgagacctctacaaaataaaaaataaaaaaatcagctgggcgtggtggcacatgcctgtagtcccagctcctaggggggctgaggtgagaggacagcctgagcctgggagattgaggctgcagtgagccatgatcatgccactgcactctagcctgggcgacagtgagaccctgtctccaaaagtgattaattaaaagtaaaataaaatttaaaaatatagtacctgcgttattgggctgttgggaggtttaattttaaaatacataaaatgcttaggacactgtgaggcatgcatgaagtgctcactaaatgttgctcttggctgttactaacttatcacaactacttctttttacaggtctctgaaactaagacctataccactgattactgtgtaatgagccttacagatgtcaaggtttttctgtatgtggacaagacacctttggtctgtatctggccaaaaagggcagcacagggaaagaaagaggcagtgagagtgaatatccaaagggtaaggacaagcagcacagaaaggaaggcacaggaatgggagaattggagcatggactaaatttcacttacttcctaatttgttcccagccatcctgatgactatgagctcctttcaagagggcacttgagattgcgtgaatgtgacctgctataactgctgaatgtctatacagagtacaagcaccgggctccctgacaggcagccatcactgaatttccacttacaatgacaacacagcagtaaacttttttttttggagacagacagagtctcactccatcacccaggctggagtacagtggctccatctcggctcattgcaacctccgcctcctaggttcaagcgattcctgtgcctcagcttcctgagagcagtaaactttaaactttaaaaatgtggttacagttatttcaccatttggaatgaccttgctgacaaaggtttccatgttaccacctcaacagtgaaatgttaaaacaaagacaaaagcaaaaaatggcacaatgaataccatgaccagatgtttgggaggtaagggagcaagaaaagaaaaaagttacacatattttacacatatttcttaaaatatctgatccaaaccaaaagacatagaatatacatttaaaaccttatgtattgtttctcttagcagtttctgggttaaggtgacagatttcattttgctccctcctgaaaccttcttaaaaccatactaaagaaatattgttagtctggacgcagtggctcacgcctataatcccagcactttgagaggccgaggagggcagatggcttgagctcacaagttcgagaccagcctgagtaacatggtgaaaccctgtctctacaaaaaatgcaaaaattagccgggcgtggtgtcacacacctgtagtcccagctatttgcgggactgaagcaggaggactgcttgagcccaggaggtcgaagctacagttagccaagatagcgccactgcagttcagagcttgggtgacaaagtgagaccctgtcaaaaaaaaaaaaattgttaaagactaactcataaggataaagtaggagacacacaattaaaaaaaaaattctgaaagtagatgaacaagtgattactgcctcagcagactcaagaaagtctgatctccaactaaaaaggaaggtgaagttgagaacacaatcctcaaaacgcaatgataacaaggaggggtgtctctagaatagggaactggctggagcagattcctaaaccatctctctccccttcaagctgccaaaggtctagtctctagaggaggtaaactgaggttccctggactgggagaaaccacgctcagttgtgaagaaaggtactgtacagaaaactgaggatttaagtgacgatatacatagtaaatgctgtgtgcacaataaatgaagctttcttccaccactcagccaccagaataccaccagcaagacctccatgcttcaagcaggacacaggaaaaggcctttccatgccatcgctcctctagagcttactctcgaggacagacctcaagatactgacaagagggatttcccccaataaaagagacaatgaaaatcatccaatggttaagtcaaaattgataaggcccacccacttgctcagagcttccaactggctacagagtaccacgatgttaatgagaagcagaaaattaagaattaataaacatctgaggaagaaataaaaaaaaaaaagaataggaagcagcaacttagaagaaacagaccatgcacagaggagaaaaaaaaaaacctgtcattaatagcctcagaaaagtaagagaaaatactatatccaggacacagaaacaggattttactaatttttttaaaggaagattctaaaaacaaaagagctcttagataataaaaatatggtagcagaaaggaaaaactggatagtagggttggacgaccaagataaggaaatcttaaaaacctgaacacatacaaataccccaaaaagaaaaagagacaaagaggaaaactggagagaaatgataagaatgtcagaagaccaaaataggaagtccaacgttcaataaaatcatagctcaagataaatacaagagggaaaagaggaagttgtcaggagaagttctcagaatcaaacacaattgccagattgaaaacgcccaccaaaaatacctcgtggatgaaagtggcccacacaagggcgtatcactgtaaaactgcagaacaccatagacagcgaagattccgtaagcttccagccacaaagaatcaagaatcagtgtggattcagacctctcgacagcacattgataaagtttctactctcctttccattccctgctctgacactcatttcatcctaccagattttttcatgtgacctaattctaagaactggaagagggctttgaagacttcagaagctgaagacgcaaagtagcccatccctctgcccagtttgttttattctccccattttggttattatgattttttaaatcctttcattcttttcactcagaaagaggcaagtaattgatttccttatgaagaggccaggcagtccatttttcatggcgttcagcgtgcacagcaaatctaaaaccattgtctggcaaatgcagcttgcagccgcaatcatttttttcaccaggtaagccggctggcgtatgtttttaaaattttattgttaagtattgtcttttactggttaaatcaatgataacattctttactttgtggttgtgttactcaaaacgaggatttttaacaatgataaaaaataaagcttgttagatcatttttaatggtaatgaattggttcctgaagatttgattaaagagaactaggccaatctaagcagagtccaaatgaggtagaaagtccatagagaacaggaaaaaaggaagttgtggaaccacagacacagtaaaaggaaaaaattggccaggtgcgatggctcactcctgtaatcccagcactttgggaggctgaggtcggtggattgcttgaacccaggagtttaggcaacatgacaaaacccccatctctacaaaaaatacacaaacaaaagacattagccaggtgtggtggtgtgcacctgtataatcctagctacttggtaggctgaggtgggagtatcgcttgaacctaggaggtggaggtggcagttagctgagattgagccgttgcaccccaacctggatgacagggtgaaagagaccctgaaaaaagaaagaaaagaaaaaaaattatttaattaaattatttatttttgtgacaaggtctctttctgtctcccaagctggagtgcaatggcataatcatagctcactgcagcctcaaactcctgggctcaaggcatcctcctgccttagcctcccaaagtgttgggatcacaggcataagccacttcaagggtagatttttttttcttctttgaaacaagatttggttctgtcacccaggctggagtgcagtggtatattcttggctcactgcaacctctgcctcctgggctcaagcaatcctcttgcctcagcttctcaagtagctggaactacaggcacgtgccaccatgcctagctaatttttgtattttttgtagaaaagggggtgtcgatatgttgcccaggctggtcttgaattactgggttaaagtgatccacccaccttggcctcccaaagtgctgggattacaggtgtgggtcaccacacctggccaaaaacatgttaagttttaaaatcaaaagaaaatcagcaagccattttgcatatttttctggagatatataaatacagatatatatagatagagataaagatatacagatagatctggactggaaaccttatgataatatagtatcagttgggtataacttaaaaggacaaagggaactgattaaaaaagactcaaggcatatatatatacatacacacacatatatacatatacatatatatacatgtacatatatacatatacatacacatacatatatacatatacacatatatacatatacatatatacatatacacatatatacatatacatatatacatatacacatatatacatatacatatatatacatatacatatatacatatatatacatatacatatgttttcccaattcttcataccactttttatttttattgagatataattaatttatacaccataaattcacccttttaaataagtgcacaatttagtgggttttagtatagtattcacaaggttgtaaaaccatcaccactatttaattccaaaacattttttcttttttttttttttaagacggaatcttgctttgttgcccaggctggagtgcagtggtgtaatcttggctcactgcaatctccacctcccaggttcacaccattctcctgcctcagcctcccgagttgctgggactacagatgcccgccaccacgcccagctaatttttttgcatttttagtagaaacggggtttcactgtgttagccaggatggtctcgatctcctgacctcatgatcctaccgcatcggcctcccaaagcgctgggattacaggcgtgagccaccgtgcccggccaattccagaacattttcatcaccccagaaagaagccccagaatcactggccctactcaaccatttcccctcccatttcctggcaagtatttacttacttcctgtgaatttgcccatttgggacattccatataaacgaaatcatacaatacgtgatttcactaaacaagatttttgtgtgtggcttctttcaaataatttttgaaaattgtggtaaagtatgcataacataaaatttacactctaaccacctccccccccccctttttttttgagacagggtctcactctgtctttcaggctggagtgcaatggtgtaaacacagctcagtgcagcctcaacctccttgggctcaggtgatcctcctacctcagtctcacaagtaactaggaccacaggcacacaccaccacacctggctaatttttgcattgtttgtagagacaggatttctctatgttgcccaggctgatcttgaactcctggactcaagtgatcctcccaccgtggccccccaaagtgctggaattacaggcatgagctaccacacctggttgtctctaaccatttttaagtgtacaattcagtagagttaagtatattcacattgttgtacaaccaatctccagaactttttcatcttcccaaatggaaactcgtacctattaagcactaactccccattctctccttctcccagcctacagtaatcacccttctactttctgtctttaccaatttgaacactctaagtacctcatgagtggaatcacacagtatttgtcctttggtgactggcttatttcgcttagcataatgccctcaagggttctccatgttgtaacatgtcggaatttccttccaaggctgaataatgtatctgttatatggatcaatcacatttgggttatccattcatcagttaatgcacatgtaggctgtttccaccttttggtcattgagaataatgctgctgtatacatatgtgtatacgtttttgcatgaccatttgtttgcaattcttttttgactatatatgtatgaatagaattaccgggtcatatagtagctctaagtttaactttttgagtaactgccaaagcattttccagtgttacatggttttacattctctctaacaatacataatggttccaatttccccaaatcctccccaacactttttatttttattttttttaaacattacagccctgctagtgaatgtgaagtggtatctcattgtggtttgggttttaattttataatattttaatttttaaaatcaaaagaatatactggggctggggtggtggctcaagcctgtaatcccagcattttggggggccaaagggggtggatcacctgagtttatgagttcaagaccagcctggccaacatggtgaaacctcatctctactaaacatacaaaacttagccgggtatggtggcaggcacctgtaatcccagcttctcaggaggctgaaacaggagaatcacttgatccgggaggtggaggttgccatgagtcagaatcacgtcactgcactccagcctgagaggagactctgtataaaaaaaaaaaaaaatatatatatatatatatatatacatatacacacacacacacacacacacacccacaattattttcttctataatattattttacaaaagaagtccatcactaacacacgcttgcatgcaaaatacaagacacatctaaaggccgggcatagtggctcacgcctgtaatcccaacactttgggaggcagaggcaggcggatcacttgaggtcagcaatttgagaccagcctggccaacatagtgaaaccccatctctactaaaaacacaaaaattagccgggcatgctgatgggcgcctgtaatcccagctgctggggaggctgaggcaggagaatcgcttaagcacaggaggtggaggttgcagtgagccaagatcgcgccattgcactccagcctaggcgacagagcaagactccatcaaaaaaaaaaaaaaaagtactaaaattaagttggcaaaaatttacatgtagtcctttctacatataagacataaatatctgacactgaattcattccttttattctccatacagcctccccggacaagtctggcaacgattctgaccatccggcaaaacaaattacctttttccagtttatgttagtgtccagcattggtgggttcctggtctcactaacttcaagaatgaagccgcagaccctcgcgctgagtgtcacagttcttaaaggcggcgtgtccggagtttgttccttctggtgctcggatgtgtttggagtttcttccttctggtgggttcgtggtctcgctggcttcaggagtgaagctgcagaccttgaccttccaggtgagtgttaccgctcttaaggcgacgtgtctggagttgtttgttcctcctggttggttcgtggtctcgctggctttaggagtgaagctgcagaccgtcgcggtgagtattacagctcgtaaaggcagtgtggacccaaagagtgagcagcagcaaaattcaccacaaagagcgaaagaacaaagcttccacaatgtggaatgggacctgaatgggttgccactgctggctggggcagcctgcttttattcttatcaggccccactcaaaatcctgctgattggtccattttacagagagccgagtggtctcttttgacagggcgctgactggtgcctttacaatccctgagctaaacacaaaggttctccacctccccactagattagctagatacagattgtcgattggtgcattcacaaaccctgagctacacacagggtgctgattggtgcatttataaaccttgagctagatacagagtgccgattggtgtatttacaatcccttagatagacataaaggttcttcaagtcccccaccagagtcaggagcccagctggcttcacccagtggatcccgcactggggccgcaggtggagctgcctgccagtcccgcgccctgtgcccgcacttctcagccctagggtggtcgatgggactgggcgccgtggggcagggggcggtgctcgtcagggaggctcaggccacacaggagcccacgggggcaggggaggctcaggcatggcgggctgcaggtcccaagtgctgccccgtgggaaggcagctaaggccctgcgagaaattgagcacagcagctgctggcccaggtgctaagcctctcactgcccatggccggcggggcctgccggctgctccaagtgcgtgcccaccgagcccacacccactgggaactcacgctggcccgcaagcaccgctcgcagccccggttcccgcctgcgcctctccctccacacctcccccgcaagctgagggagccggctccagccttggccagcccagaaaggggctcccacagtacagtggcgggctgaagggctcctcaagcgcgcccagagtgggcgccaaggccgaggaggcgccgacagccagggagggctatgagggctgccagcacggtgtcacctctcattaggacaacctacgtaggtttatatttggctcaagataatactactctacttctccagtaagtaagcatttatgaaaaatcagaaacttttcaagttaaccacttctactacagcagtctctctgagaaagacatgacacaccttacttcaaggaaaaaagggtcctttttcctcacaagtattttctcataaactttatttttttaatgcttttaaaaacagattctaatttaattaatctagatttgcaaaattataaaggaaaagtcttgccggttgttgcttcggttacgttaatttcacaatttagtaaattccaactacgtatttaatacaaagcagcctttgtggggggggggtatttaacaaaatgcatcttagcaacagtctagagaaacttttctgtgtgaaaacagaagaggggttaccatggagaaattcattacggatttcgggaaggctttttcctcagaaatagagtgaaaacaaaaaagtcgttgtgtaataaatctgataatgatgctgtgtgacttagaagttggtccaaaagtttatcttcagcaattatgtctagatgatcaactacatatcttctgcaacaggtgacacgaaactgcatttcccaagcaaggcaaagcgatcaaatgagctaagatgcgcgttcctgcggttttgtactttcatttttgatttaaccaaaaacaattttgaatcgaatgaataaccaaagttgggtgggtcttgtttggctttctgctttgctttttaatcagccatttaccagcaactgttgcacaggcccattagcactcgaagaataaaagcaaacatacaggaccagataaaattcccctactaacccaaatgatccatttccttaacacaattttaaaaccacagctagggatgtgaaaacagacatgtttttgtgtgtgtttgtgtgccacaatctgtccaaacccttaattcccttttaagtaacatatctaataaaaatctgaaagaaaccacattagaaatgcaaagaggtttgtaaaacaagaggcttctttcattccagaaaaccagaccaaaacaaggggaaagaaatgaatgcaatggatacgtgtttgccaaagtttcaatcctgcccggtggagacactgcactggcacaaattttgaagaggaaaaagaggaggttgggggggagagagagagcgagcgagtgtagcctgcaaactgcaacaatgcaatctccatttttaacaatgcgcctctttcctcttgtaaatctagttttttgccacttgatgtgccctcgcatttcccctctgtttgggggggaggcggggttggggggagatcggagcaggatgcacagcacacgagtgagcaaggggggagggcagaggaggtggggaaggagtctgcagcaactgggctgggtgggtacctggagtgctgctgtaggtactatggctcctgaagctgctttctgtgcagtaactggcgtcgtcgtcgtcttccagctcctccagataatcggaatcagcctcgtcctcctccatctcatgctcctcgttgtcctcagactcctgggtctcctcgacgtcgccgtcctcttcctcctagctcccgtggtcatcgtacaccactttgttcacggccctccgggccgcggtggtccgggccagaagggaaagcggaggaggagggacgggcgcgggtggggaggcctgcgaggccgcgcgggagggccccggtcggcagaagcgggtggagggaaaaggctcattccgaattgctggggccccactcaggatcggcttcagccgccctcttgtttcatccctctcccgcagcgcggtcacgtgagatgcgccacagaagagcctgagaccgagtgaggcggcgcggcagccgctagggggagcgcgggggcgtcgagtcgggagcgcggagcccggagcgcctgggctcggcgcagcgcggtgcgcctggactcggggcgcggatggcgcggctgagaggggcgcgtagctcgcgaaatgcccggcgtcaaaggccttcggagaccagtctccgcggacccctggctggagcccaaagccggccagacctcctccccgcgtctccccttccgcggctcggagaggaaggcaggggagcccccaaatatcattcccctcccgccccctagggaaactgatgctgaaagagccagcgagagaaagaaaaaaaaaagtcgctgaggggggcggcccgagcgaccgaaggcaccggacagcgccagcgacggagggaaacttggggcgggggggggacagggagacaagcccccagaattttggaaaccccaaagcttggagctggagtcctgaaattgactccgatgacagctgctccggatccttgccaggagccacgccccgggctgccacgcccggagggaggggcgccctaagacctgttgcgtggaatgcccacttggaaagcctcagtaaactccagaacgcaactactgcacgttccaatgtcccgccaccttcccagtgccccaggtgggactttgaccacctcagcaagaacttacctctcctttgcagtggaaaagagggaatcctgcctaaaacctacttcacggtgttaaatgtttgtattattgggaaataaccttaatttattgacctgacaagtcactaggtttcagcttagcccaaaggacgaatcatgatgacatttcaggcaccctcaaaccttatcacagcgactcaaccctgagtggttgaggtcagctcttcagataaaagaaaggtacatattaatatttattgagagaagtgacaaccgaaaagtaatttaaagaaaaatagttggctgggcgtggtagctcacacctgcaatcccagtcctttgagaggccaaggccggatgatagcttgaggtcaggagttcaagaccagcctgagcaacatagcaggacctcgtctctagaaaaattttgaaaaaattagctgggcatggtggtgtgcacctgtggtcccagctacccgagaggctgaggtgggaggactgcttgaacctgggaggtggatgttgcagtgaactgtgattgcaccactgaactccagcctgggtaacagagcaagaccctgtttcaaaattttaagaaaagaaagaaaaatgcctaacaggattctgtatatcaaatggcttatttcaatctagttaggaaaatggaacacatatgtgaaatgaaaattaaaatacaagaactaattgccaaataaatgcattcaatacaatttggttgagcactaagggtgacaaatgtgtatatgtctccaaggaccaggtaagtaatgtaagtcaataaagtaggcaagatgaagacctaggccaatggaaatgcccatattttgtttgaagaggatagccaggcacggtggctcaggcctgtaatcccagcactttaggaggccaggtgggcagatcacttgagcccaggagtttgagattagcctagacaacatggtgaaatcctgtctactaaaaatacaaaaattagctgggcatggtggcacgagcctgtagtcc

SEQ ID NO: 460 - DNA, 3663 bp, Homo sapiens
aggcgccgacagccagggagggctatgagggctgccagcacggtgtcacctctcattaggacaacctacgtaggtttatatttggctcaagataatactactctacttctccagtaagtaagcatttatgaaaaatcagaaacttttcaagttaaccacttctactacagcagtctctctgagaaagacatgacacaccttacttcaaggaaaaaagggtcctttttcctcacaagtattttctcataaactttatttttttaatgcttttaaaaacagattctaatttaattaatctagatttgcaaaattataaaggaaaagtcttgccggttgttgcttcggttacgttaatttcacaatttagtaaattccaactacgtatttaatacaaagcagcctttgtggggggggggtatttaacaaaatgcatcttagcaacagtctagagaaacttttctgtgtgaaaacagaagaggggttaccatggagaaattcattacggatttcgggaaggctttttcctcagaaatagagtgaaaacaaaaaagtcgttgtgtaataaatctgataatgatgctgtgtgacttagaagttggtccaaaagtttatcttcagcaattatgtctagatgatcaactacatatcttctgcaacaggtgacacgaaactgcatttcccaagcaaggcaaagcgatcaaatgagctaagatgcgcgttcctgcggttttgtactttcatttttgatttaaccaaaaacaattttgaatcgaatgaataaccaaagttgggtgggtcttgtttggctttctgctttgctttttaatcagccatttaccagcaactgttgcacaggcccattagcactcgaagaataaaagcaaacatacaggaccagataaaattcccctactaacccaaatgatccatttccttaacacaattttaaaaccacagctagggatgtgaaaacagacatgtttttgtgtgtgtttgtgtgccacaatctgtccaaacccttaattcccttttaagtaacatatctaataaaaatctgaaagaaaccacattagaaatgcaaagaggtttgtaaaacaagaggcttctttcattccagaaaaccagaccaaaacaaggggaaagaaatgaatgcaatggatacgtgtttgccaaagtttcaatcctgcccggtggagacactgcactggcacaaattttgaagaggaaaaagaggaggttgggggggagagagagagcgagcgagtgtagcctgcaaactgcaacaatgcaatctccatttttaacaatgcgcctctttcctcttgtaaatctagttttttgccacttgatgtgccctcgcatttcccctctgtttgggggggaggcggggttggggggagatcggagcaggatgcacagcacacgagtgagcaaggggggagggcagaggaggtggggaaggagtctgcagcaactgggctgggtgggtacctggagtgctgctgtaggtactatggctcctgaagctgctttctgtgcagtaactggcgtcgtcgtcgtcttccagctcctccagataatcggaatcagcctcgtcctcctccatctcatgctcctcgttgtcctcagactcctgggtctcctcgacgtcgccgtcctcttcctcctagctcccgtggtcatcgtacaccactttgttcacggccctccgggccgcggtggtccgggccaggtggccgccgccgccgccgacgggggagaagggaaagcggaggaggagggacgggcgcgggtggggaggcctgcgaggccgcgcgggagggccccggtcggcagaagcgggtggagggaaaaggctcattccgaattgctggggccccactcaggatcggcttcagccgccctcttgtttcatccctctcccgcagcgcggtcacgtgagatgcgccacagaagagcctgagaccgagtgaggcggcgcggcagccgctagggggagcgcgggggcgtcgagtcgggagcgcggagcccggagcgcctgggctcggcgcagcgcggtgcgcctggactcggggcgcggatggcgcggctgagaggggcgcgtagctcgcgaaatgcccggcgtcaaaggccttcggagaccagtctccgcggacccctggctggagcccaaagccggccagacctcctccccgcgtctccccttccgcggctcggagaggaaggcaggggagcccccaaatatcattcccctcccgccccctagggaaactgatgctgaaagagccagcgagagaaagaaaaaaaaaagtcgctgaggggggcggcccgagcgaccgaaggcaccggacagcgccagcgacggagggaaacttggggcgggggggggacagggagacaagcccccagaattttggaaaccccaaagcttggagctggagtcctgaaattgactccgatgacagctgctccggatccttgccaggagccacgccccgggctgccacgcccggagggaggggcgccctaagacctgttgcgtggaatgcccacttggaaagcctcagtaaactccagaacgcaactactgcacgttccaatgtcccgccaccttcccagtgccccaggtgggactttgaccacctcagcaagaacttacctctcctttgcagtggaaaagagggaatcctgcctaaaacctacttcacggtgttaaatgtttgtattattgggaaataaccttaatttattgacctgacaagtcactaggtttcagcttagcccaaaggacgaatcatgatgacatttcaggcaccctcaaaccttatcacagcgactcaaccctgagtggttgaggtcagctcttcagataaaagaaaggtacatattaatatttattgagagaagtgacaaccgaaaagtaatttaaagaaaaatagttggctgggcgtggtagctcacacctgcaatcccagtcctttgagaggccaaggccggatgatagcttgaggtcaggagttcaagaccagcctgagcaacatagcaggacctcgtctctagaaaaattttgaaaaaattagctgggcatggtggtgtgcacctgtggtcccagctacccgagaggctgaggtgggaggactgcttgaacctgggaggtggatgttgcagtgaactgtgattgcaccactgaactccagcctgggtaacagagcaagaccctgtttcaaaattttaagaaaagaaagaaaaatgcctaacaggattctgtatatcaaatggcttatttcaatctagttaggaaaatggaacacatatgtgaaatgaaaattaaaatacaagaactaattgccaaataaatgcattcaatacaatttggttgagcactaagggtgacaaatgtgtatatgtctccaaggaccaggtaagtaatgtaagtcaataaagtaggcaagatgaagacctaggccaatggaaatgcccatattttgtttgaagaggatagccaggcacggtggctcaggcctgtaatcccagcactttaggaggccaggtgggcagatcacttgagcccaggagtttgagattagcctagacaacatggtgaaatcctgtctactaaaaatacaaaaattagctgggcatggtggcacgagcctgtagtcc

SEQ ID NO: 461 - DNA, 3663 bp, Homo sapiens; identical to SEQ ID NO: 460

SEQ ID NO: 462 - DNA, 3663 bp, Homo sapiens; identical to SEQ ID NO: 460

SEQ ID NO: 463 - DNA, 3663 bp, Homo sapiens; identical to SEQ ID NO: 460

SEQ ID NO: 464 - DNA, 13352 bp, Homo sapiens
tcctctcttagtcactagctcttgggaaacccctttgaggccggtgttagattgatgaaagggtcaggggtaggcacacagggaatgatctacctatgcatataatgcacttgtgccttcagtacctggttaggagctagtcccacataaaccatttccagttggtaatgggattttatgagtgtgtcagatggcccagtacatgacggacagcttgggttgcaaatgacatgtaatacattagggataatcacttggcgtccagtggtcagtccagctcagaagtcactcccagcttctcctgctagcacagtcaatccagaatctctgcaatgtatatcaacaacatcagaccagtgtaaaatgatacctttccacccatttattaagcacccttagttaggaaaatcccaaaatcatgttggtttctaatcttgatcctcgctggtttgagcttgccattgtccttctttctgaagtgctgggatctaactgtccattctggagacagtcgagggtaatgcatgagaactggcttgctcttgcagtgagactgcaaaggatgcaaagaaatggcagtgtcgttacgaagtgtgtcagaagactggagaagagggtttccgctgacgaaggaggctctttgaggactgggtgattcagagaacttcaggttttccaaatcctctcatttgtctccatttggattctctgggtcttatcccttcctgatcaatgcttcagcaaggccatgattttaccagtgtagaaatgtggccagtcctgtggatcaaattttacctttggttttccctttttgttgttgttttttctttttgagacagaggctcgctctgtcacccaggctggagtgcagtggcacgatctcagctcactgcaacctccgcctcccgggtcaagcaattctcatgcctcagcctcccgagtagctgggactacaggcatgcgccaccatgcccggctaatttttgtatttttgtagagacgggctttcaccatgttggccaggctggtctcaaactcctgacctcaggtgatctgcctgcctctgcctaccaaagtgccagaattacaggcacgagccacggtgactggccgttctattttctcagttgtatggactcaagagggaagagggtatttcagaactgtcataggaagcccttggtttggtttaagtctcttccttcagctggtaacttcgggacttgagcttgccagtgtctttttttaagctgtgtggcatggcttaacaggactgcctggccggcgcatctgtaatcccagcacgttgggaggccgaggcgggcggatcacgatgtcagtggatcgagaccatcctggccaacatggtgaaaccccgtctctactaaaaatacaaaaattagccggcgtggtggcgtgcatctgtaatcccagctactcgggaggctgaggcaggagaatcactttaacccgggaggtggaggttgcagtgagccgagatcacgccactgtactccagcctggcgacagagtgagactctgtcacaaaaaaaacaggactgcctattgggcctcatatgcttgactgtttgatggcagaaacaactcattggctacaggctttgctttgaatggacccttcttccaggtgaccggtatgatgagaagtagagaggtaggggcaggtgtcagcgtctggatcttctctgggatcccaacagaagacattttcgtcctgctgtgctgaagacgggaccggaaggccattgctcaggtattcactctaccagacggggctttacgctcccaccacttcctcgaatcccccgtgaggtagatattattatcctgactttacctgtgaggacaggaacgcagtggcggggtgggttctcactgtgcgtggaggcagcaggacgcagaaatcgacctcccccacgcgcctcgccagcagctttcagtttcgtggcccaacgccctgcactgcacgcctctcctctgggataattgatagttgaatctgtgtaagctggaagcaaatgagagcccagcggctgttctttcccattccttttagattgaggcaaagggacaaatctgcgatgtgaataatacagctccaggaatttttatcagcgcgccccacgcccggccctgcctgagggtctttctaagccacaggcgtcccttcccaggtcttgtctcttcccttccgcgaatgccctcggctcacccagcaggcaggtgtgatccggctccgcgctggggccaggtgaggccgggctgcctgccccggtgcacgttcccagggcgcggcgcccagtcggcggggcctgcgggctgggcctccccggggcgccgggcgtggcgccgggggcaggtccccgggctgccctgcagggcggccggccggcggccagcggctgtttacctgtgcagggcgaggcgagactcgtggcggtgccggggctttgcacgcaaggggcgatgcgccccggagggggagggacgcaaggggcgactactgttacctcgcttggagataccaaggccggtcggaccccccgctggccgaatgtggggagcgagcagatccagcctgtttggacgtggtgaggacccagccgtggggtttaaggccaagttagcctctcccttcactgattacaagagccattgttacaggtgctcacatgccaggagaaataagctggtgatttatgtggcacagcaccatcgatcgacctacaaaggaagcttcagtgcagccgtgttgctatacagacctctctcaccaaggcgtcatgaactgaagggctgggagaggcctcgtggaggaggaagagtttcgctcagctgcttgggtgtgggactgaatgtggttccagaactggtcgctgccttcacccgctgactctggtctcggcgatgacaagcccatggaacagacttacggcgtatgacctcatcggagacttgtacatggggccaacccccattttcccacaggaaacccacactctaattaagggctgaccctgaacttgaatctgagtcttctctttcttcaacagagagccatctctccagcccagctggcaaggagacaggtgatgttacaggaaaaaatacacagcttgtgcccttggaattaccagagttcaaagcctgttcagcatctacccaccatgtgacccgggtcgaattcttcagtttctctaagcccattttctcatctgtaagatggggaagtgtaatcagttctgaacccacatatacctcactgggcttgaacaggcctgagcaggcatgtggggctttactagctagccatcctttctgccgctctccctcattctccttcaagccccccaaagtccttggtggaggaggaagtggagacagaacgtttggtgttgggtgaggtacgtgaggaggctgatttcagaacctccaggaaacaaagctttagtgttccgagggcagtgcccgcctgtgcctcctcctcacagggggtagtaggagtggggtggggccgaggcatttcccagcacagctcaatcacatctcctgcgcctgcccttgtgacctgctcactggaaaggaagaaatgaccgagggagaagggagggcatttgaggggagaagaagaggatggagaaaaaaactggatcatctcgtgacatggaaagaaaggtctgagctctgacgatcccctcacgtgattataggcatgaggactcactcttcgaattgtttgaaaattgaatggactggctcacaccttctgaaatttcttggaagctctggagtaactattccactaaagaacagcgtgtttttggctgaaatctgtgactgtttgtttttgagttattttaatctctgtgtcaagcatgaaaacctcagcagcctgggatttataattagatcccactggcatgccctctcacctctcaaacatgccacagtgctttggctctctccttgtgcaaacctccctttgatatttttggatatcgataccaagtgtatctgcatattttaaccaactgatatgcatatcctgtgatctgaggcattcgctcaatgtggggcatcaggccagctgtgaacttcctttaaaatttattttgtgtcaaatgattccctaatgctatagctcccttgaactgctagatttatgaaaattctgcacaacacatagctcagagaaaaaaaaaaaagagtgttgcaagaccagatataggatatcatttgatttgtttaaaacactctgtccagggggttttgacttgctaatttaaaaataattctaaaattaggtacagttgacccttagtatccatgggggattggttccaggatgccctgtggataccagaatccaaggatgctcaagttcctgacataaatggcttagtgtttgcatataacctactcccctcttcctatatactttaaataatctctagattacttataatgcctaacacaacgcctgtgcatcacttcattcatgtggattcaatgtagtacttggtgtgaagaaaatttaagtcttgctttttggaactttgtggatttttttttctggaatgtttttgatctgcagttggttgaatccacaggtgcagaactatggacacagggggctgactatgtatatttatatccacttgcaaaattaagaataaaaataatgtgcatcagcaggtgcagattctgatgctcggtggacagtatgaagtcttccatttttaatgaagtctcaggcgatgctgctgttgcagtcctgtccaatagaatgttctgtgatggtggaaagattctctatcggctctatccaatacctaagccacacctttcacacatgggggagtgggatgggcaatggaagagcccaggcagggtagggagggggcagaaggaaggacagcagcacaggtaggcttactaagatccctaacatttatttagtgcctgtaatgggcaaggcagtgtgctgggtgctttacacctgttcagccacattcttacatcagcttgtgcagagcatttactcttcctggaacaatcctcggtgcagcgggtacaacaatgtaaaaagatccagtccttgctgctgggaaatttatagacacgttaactgaaactgtggagtaggatgaagtttctgagagaggagtctgcatttttaccctggcctttctatttcgtctgcaacattaagcaaggagcaaggaagagacatgattccagctttacctggggaaaatcaatctcacagcaatgagaagaaataaatgatgagttaaaattaatttctatatttttctaattattcaagtgactaatgtttggtgtgcagaaatttaagaagactgaggactagaatgaattataacgcaggagaaaacaataaccatgcatagtcagcaagaggcactgataccattttgagacgactggatgccctttcgtatgctaggaatatgcagcccgtgttctggaaagtggggagaaggtcaggcggctcctagcagcaaagctgcgttatcctcaatatcctgtaggggagggtttagggagttcggatatccctgcctttgacattcatcttggcctcagtttttctcttacctggaagcaagagaggagttgattgtgagttcagagtggaaatggtggccaatccagaccctgcactgccactgactctccgggaatgtcagcgccaggtgagagccaggattccagggccagacctgagcttgtccatagcctgggacttgaatggggggaaacttgggcacagtggcaggtggaaaatcaagtctgtgcttcaggggcatctaggaatgccctgtctatcttctcccctccccaaccccatttacccaggtgcctcctgttactttcaatactaatgccttctttttttttttttgagacagagtctcactctgttgctcaggctggagtgcagtgacgcaatctcggctcactgcaacctccgcctcccgggtccaagcgattctcatgcctcagcctcctgagtagttgggactacaggcatgcaccaccacgcccacctaattttttttgtattttcagtagagatggggttttgccatgttggccaggctggtctcgaactcctgacctcagtggtgggattacaggcatgagccaccacgcccaacctgatgccttctttttctgaccatttcctctccagcaatcccaccgtggccacaggaaaacctggcccaggagattccaatgttcttggcttcccctcctgtcacagcctcagtgattttgtgatttcatcttgcttctcagggcttgcttttatcaaaagggttggttagtcacaatggctgttaataggtgcaacaaggcatagaagacctgttaggggttgaacttttccccctacaactccaaaatattaatatattgcagtcctaatcttcaggacctccaagaatgtaaccttatttggaaatagggtcgttgcagatgtcattggttaatgatgaggtcgtactggatcagggtgggccccttatccaatatgactggcatccttgtagaaacaccacagtgtgaagagacagagattcacgcagagggaaaactatgtgaaaagatacacggagaagaccgtgtaaaaggtggaggatgaaggtaaggcagttgcaagccaaggaacgcctaagataaggaacgcctaagatagccaatgaccaccaggtctcagagaggcccgggacagattctccctcactgcccctagaagcaagcaaccccgctaaccccttgatttcggacctctggtctccagaagtggggcccagctgggataacctgactctagggccaccaaggtttgtcatcctgggcggcattcggggctggtgtgacccaccttatgcacaaaggccagaatagacctagcggcattgacaataggactggaatgccagctttgtctgtgaaggaagggcgcaagggaggacagctgtggtgggcaaaccctaaccatttccatccttgtttagcttttgttctgactacgacaggactacgtagtcgaactacgactcccaggaagccgttcggccttccccaccccctccccgcccaccccgctccgccccgtcccggcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtggaatcagaggtttctggctgactcggtgggtgctttgaaccaggaaaggacaagaaagaggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgctgtgcttgtatgaccatttagtgaatttggtgtcttctaaatagaacagtggagtccttgtggacatctcagattcatcacaaaatgattgaggagaacctcttgaagatgtttagagctattgaaatttacagattgttgatgggttttcaccttttccttcctttcttgacacacagttacaggcattgtattccttggattcctacaggtgtcaaggaacagagatccacttacgttaccttcataaatcctggtttattcaaaagtcacagtaaggtagacaggaaatagtcccagccactgcctagctaagccttttcaaaaagcccaaggtcattcagcagatgcagaagcactagttggttttcaaagataacaagagcaataccatcatggtcgttttgatcctctgttcagcagcagggttcgctgcccctgactttagaattctgccatcgtgatgagctgaaggtcaccaacggtcccagtttgcccaggactaaagggtttcttgggatgaaggacattcagtgctaaacctgggacagtcctgggcaaactgggaaaactggtcaccctcctgggtgactcaacgaccatgcctctactttgttacttactattaactgactgatgctgttgactggtttagccaatctgcattcagagcttttgcgtctggttacttcgttggccttcaggcagccacagatggatgctattggatcaggcaccaatgctgaccaaatcaattgtttccaggatggtagggttgtatgaagaaccaactgagaccatgtccttctgagtgttgtggatggtgggcatggcaggccttcaaggtatcagggattcctctccaatacagccttacttacaaaggagaaactaactttctcatgaaaaacaaaacagttcattaagaaacaaaactaacacagccactgggaactgaggaagagagactgtaacatgtgtgcaagcacacacacacacacacacatgcatacacatgctgtctgtagaatcatgagccaggattccaaatctgcatctttgctagacagagatcaagaactaaaacctttgggatggtgttgtctgggaagcaaaggagttggctagaggacttcctgaaattcctttaaactctagaatcctttaaaatatcaagggtgtgtaaactggggctaagtatgtacattctctctaaaggctcctagataacctttgagttcaattcagtgtggagtggggcctcccagcttatacttacctttctagacactgacttttatctgggatgagggagcagaatttggaggtggtagtcagggcgggggtagggaggggagtgggtaagggatagttgcaccagcccaacttttttggtcttaagaacaacctgaacgcaaattacagggtcttttgtggactagaaaaagccaggttttcaggatcacgtggcgtcctgaagttgttgctgcttgtcagggcatctgacctccatcttctctgctgaaagacaggcatgagtgtttgcagtgccggaacaggggccttcagataatttcattcatctggcatggcaagaccacagggagggaattacatgctagggtagagatgaacttatggacgtatcatgcaccttggtgtttgcccctgtagtgattctcactaccttcgctaccattggagggatgctcacccacctccttgggtgccatttttcttttttaaaagatgaaggcatttcagatgatcccttcatttatgttctactttcattctttggtttcaaaagaagtcctgatcttatgtcaaaggcaacaatctcttctctcaatctctctctctctctcactctctctctctggctcactctgtcacccaggttggagtacagtggcatgatctcagctcactgcagcctcgacttcctgggctcaagaaatcctcctgtctctgccttccgagtagctgtgatcacagttgtatgccatcatgcccagaccagatttcgccatattgctcaggatggtcttgaactcctgggctcaagtgatccgcctgccttggcctcccagaatgccaggattacagatgtgagccactgtgcctggcctgaagtctagtaatttttaaaactttgcatgttattctgctcatgagccaagttcgggtgcctgtggaacagctatattcctcaaactagatatgcaccccagtccctggggattctgtcaaaaggcagattcacattcagcaggtctagggtggggggcctgacattcggcacgtctcacaagctcccaggcgatgctgatggtgctggtccctggacgccctcttgagtagtaaggaacaaaaggactctcccctgttcttttcagctacgtagcccagtggttctccacttaggcttcacactggaatcatccagggagttttaaactatagtgatgcctggcggtgtcttactcgcagagcttctggtttgattggtctaggttgcagcctgggcaaggagatttaaaaacttctcagatgggccaggcatggtggctcaagcctgtaatcccagcactttgggaggcagaggtgggcggatcacgaggtcaggagatcgagaccatcctggctagcacggcgaaaccctgtctctactaaaaatacaaaaaattagctgggtgtggtggcgtgtgcctgtggtcccagctgctcgggaggctgaggcagaagaatggcctgaacccgggaggcggagcttgcagacagccgatcgtgccactgcactccagcctgggcgacagagcgagactccgtctcaaaaaaaaaaaaaaaaaaaggttctcagatgattctaatatgcaaccactgacttaatagcatgcagtgaatctgtggaatattaaattgtaggaaataaatttttgcacagaaagacactgccagccctcattactcaggtgtgcaggagctttccagtaacaatagcagtaactaacagtgaaaggctcaaaattacctcccctcaattctacttaattctcctcataatgagaatgattaacagccagcatttattgagtgtcaagcactttacattcattagatcatttaatcatcacagtaacctggtgaggcaggcattattatcctattttacagatgaggaaattgagcttgattgagttaagtgacttgcccaagatgacagcagtaataagtcttggacagagattggaactgggtttgcctgacttcaaagcccatatccttgaaccattatatcattctgttgtcttcatgatctacgccaggggttggtaaaatatagcccataagccaaatctgaacagctgtctgtttttataaataaagtttcgtgggaacacagctataaccattgatttatgtatggtctgtggctccgttcatgcaacgggcagagctgcatagtggcaacagagatggtccacagcgcctgaaatatttactctctggtcctttacagaaacagcttgatggattgctgaggcagagtgcaccgagcaagggttcagtcctccatagagctcagagcaaaaggaatgacccagccgggatgaacttgaacctatggccacctagctctggtttctgcttggacattttatttcaatcttatggcctgccttgcgctccaagggttacttatttcctctgcacatattttattttgatgccaaaatttcagatctgttttcttaagagcagaaggtcttgacctcaaagcccgggccatcacacagctctctgtggagtggggtgagggaggccagctgccggtcaccttctgctccagcaccgtgggaggcctgagtggcaaagctccagccccgctgctcccgggcggtgtccgcaacaagaggcttccgccccatcccaccagccatccacggagacgccctccccagag

SEQ ID NO: 465 - DNA, 7531 bp, Homo sapiens
gagcaaggaagagacatgattccagctttacctggggaaaatcaatctcacagcaatgagaagaaataaatgatgagttaaaattaatttctatatttttctaattattcaagtgactaatgtttggtgtgcagaaatttaagaagactgaggactagaatgaattataacgcaggagaaaacaataaccatgcatagtcagcaagaggcactgataccattttgagacgactggatgccctttcgtatgctaggaatatgcagcccgtgttctggaaagtggggagaaggtcaggcggctcctagcagcaaagctgcgttatcctcaatatcctgtaggggagggtttagggagttcggatatccctgcctttgacattcatcttggcctcagtttttctcttacctggaagcaagagaggagttgattgtgagttcagagtggaaatggtggccaatccagaccctgcactgccactgactctccgggaatgtcagcgccaggtgagagccaggattccagggccagacctgagcttgtccatagcctgggacttgaatggggggaaacttgggcacagtggcaggtggaaaatcaagtctgtgcttcaggggcatctaggaatgccctgtctatcttctcccctccccaaccccatttacccaggtgcctcctgttactttcaatactaatgccttctttttttttttttgagacagagtctcactctgttgctcaggctggagtgcagtgacgcaatctcggctcactgcaacctccgcctcccgggtccaagcgattctcatgcctcagcctcctgagtagttgggactacaggcatgcaccaccacgcccacctaattttttttgtattttcagtagagatggggttttgccatgttggccaggctggtctcgaactcctgacctcagtggtgggattacaggcatgagccaccacgcccaacctgatgccttctttttctgaccatttcctctccagcaatcccaccgtggccacaggaaaacctggcccaggagattccaatgttcttggcttcccctcctgtcacagcctcagtgattttgtgatttcatcttgcttctcagggcttgcttttatcaaaagggttggttagtcacaatggctgttaataggtgcaacaaggcatagaagacctgttaggggttgaacttttccccctacaactccaaaatattaatatattgcagtcctaatcttcaggacctccaagaatgtaaccttatttggaaatagggtcgttgcagatgtcattggttaatgatgaggtcgtactggatcagggtgggccccttatccaatatgactggcatccttgtagaaacaccacagtgtgaagagacagagattcacgcagagggaaaactatgtgaaaagatacacggagaagaccgtgtaaaaggtggaggatgaagcttttgttctgactacgacaggactacgtagtcgaactacgactcccaggaagccgttcggccttccccaccccctccccgcccaccccgctccgccccgtcccggcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtggaatcagaggtttctggctgactcggtgggtgctttgaaccaggaaaggacaagaaagaggtgccacctcctgagtcctggttcctgcggctccgtcgaatctgcagtgaaggcctttgggaagcgtgggttatgtgggtccaggggtcccatcctcccgtggaggcccttgacctgaggatcactaactcacaccccaccgacttccggcccccaacaagggcagtgttcctcttgctccattctgctctgaagtcccccaaaccgcttcctggggctgcttagtgaaatacaaggctcatctctgaggacctctacagggctggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgctgtgcttgtatgaccatttagtgaatttggtgtcttctaaatagaacagtggagtccttgtggacatctcagattcatcacaaaatgattgaggagaacctcttgaagatgtttagagctattgaaatttacagattgttgatgggttttcaccttttccttcctttcttgacacacagttacaggcattgtattccttggattcctacaggtgtcaaggaacagagatccacttacgttaccttcataaatcctggtttattcaaaagtcacagtaaggtagacaggaaatagtcccagccactgcctagctaagccttttcaaaaagcccaaggtcattcagcagatgcagaagcactagttggttttcaaagataacaagagcaataccatcatggtcgttttgatcctctgttcagcagcagggttcgctgcccctgactttagaattctgccatcgtgatgagctgaaggtcaccaacggtcccagtttgcccaggactaaagggtttcttgggatgaaggacattcagtgctaaacctgggacagtcctgggcaaactgggaaaactggtcaccctcctgggtgactcaacgaccatgcctctactttgttacttactattaactgactgatgctgttgactggtttagccaatctgcattcagagcttttgcgtctggttacttcgttggccttcaggcagccacagatggatgctattggatcaggcaccaatgctgaccaaatcaattgtttccaggatggtagggttgtatgaagaaccaactgagaccatgtccttctgagtgttgtggatggtgggcatggcaggccttcaaggtatcagggattcctctccaatacagccttacttacaaaggagaaactaactttctcatgaaaaacaaaacagttcattaagaaacaaaactaacacagccactgggaactgaggaagagagactgtaacatgtgtgcaagcacacacacacacacacacatgcatacacatgctgtctgtagaatcatgagccaggattccaaatctgcatctttgctagacagagatcaagaactaaaacctttgggatggtgttgtctgggaagcaaaggagttggctagaggacttcctgaaattcctttaaactctagaatcctttaaaatatcaagggtgtgtaaactggggctaagtatgtacattctctctaaaggctcctagataacctttgagttcaattcagtgtggagtggggcctcccagcttatacttacctttctagacactgacttttatctgggatgagggagcagaatttggaggtggtagtcagggcgggggtagggaggggagtgggtaagggatagttgcaccagcccaacttttttggtcttaagaacaacctgaacgcaaattacagggtcttttgtggactagaaaaagccaggttttcaggatcacgtggcgtcctgaagttgttgctgcttgtcagggcatctgacctccatcttctctgctgaaagacaggcatgagtgtttgcagtgccggaacaggggccttcagataatttcattcatctggcatggcaagaccacagggagggaattacatgctagggtagagatgaacttatggacgtatcatgcaccttggtgtttgcccctgtagtgattctcactaccttcgctaccattggagggatgctcacccacctccttgggtgccatttttcttttttaaaagatgaaggcatttcagatgatcccttcatttatgttctactttcattctttggtttcaaaagaagtcctgatcttatgtcaaaggcaacaatctcttctctcaatctctctctctctctcactctctctctctggctcactctgtcacccaggttggagtacagtggcatgatctcagctcactgcagcctcgacttcctgggctcaagaaatcctcctgtctctgccttccgagtagctgtgatcacagttgtatgccatcatgcccaggtaattttttttatttttatttttttgtagagacagggtctcaccatcttgcccaggctcgtcttgaactcctgggctcaagcaatcctcctgccttggcctcctgaagtatgtgagccaatgcgcctggccctctcttttcttatctccttatccatatgcaatcacagaacctgagaggctgaagtggtctaaagcatcactcttctctagatttatctctgactaatgcaggaatcccctttcaaatcaggcaagggatcgttcagcccaggggagagaggactatgagagaggctgagtgatacccagcctgatggggaagcagttgaattttaaagagtgtttcatacactatcaggtggccatgaatgtcaatttcttaatgagattttgtgctaaatgctttttgccctcttccccatgtttgttctggtttaaaaaaaaaaaaaaaagcacagtgcagggaggcagagagacctaagtttttgtctcagaaagctcctcatcatcttaattccttccgtataaaatgaggggtttgggccacacgatccctggagcctcttctattaatagttctgacatccacgatgctggcatatttgatggataagctatcagccttctaggagtccatgtcttaaagttttgctggggttttaggtctcatgttagaatagtacgttagacattgtccaaggtgcaatgtaaagtgatttcatcttgccttaatttcattatgaacataactatttcaaattagctccccgacaccgcccccaccccccaattttgttcagcctcgcctgtgagattttccatggcattggaacttgatccacaggagaactttgatcctcttcaagcggccctggaaacccatgtgggaaaatattagtcatgttgacaggagagataggaggttctcgtggtgaaacaagtccctctgctcaggaggctgcagtttaaaggatttcaaggtgaccttggaagtggtcactgaccttggataagacccttatatgccaggctggtggagaacaggtggagggaggcctgaagacagccctaaactgaggggtctggaaacctgatcaccggccctgcccttggcttcaactaagtccgggtcacatacccatgcaggagacctctccaggtacacatatttcctgctactgaatggcttagactgggatttgcaaggaactacgaagtccaagacctttgcctttcttttagaagaaggcaccagctggttctccaatgttgaaggtcttctccagagatgaactctgaaagccacatgttgagatggccccattacaggatggagagcacctgaacccccaagttatggactagaagaagacagttgccctggaaaatcatctgacccacattggactttatgtgagggggaaataaacctttattatgttaagctacacaataataaataacaacaataatt

SEQ ID NO: 466 - DNA, 5973 bp, Homo sapiens
gagcaaggaagagacatgattccagctttacctggggaaaatcaatctcacagcaatgagaagaaataaatgatgagttaaaattaatttctatatttttctaattattcaagtgactaatgtttggtgtgcagaaatttaagaagactgaggactagaatgaattataacgcaggagaaaacaataaccatgcatagtcagcaagaggcactgataccattttgagacgactggatgccctttcgtatgctaggaatatgcagcccgtgttctggaaagtggggagaaggtcaggcggctcctagcagcaaagctgcgttatcctcaatatcctgtaggggagggtttagggagttcggatatccctgcctttgacattcatcttggcctcagtttttctcttacctggaagcaagagaggagttgattgtgagttcagagtggaaatggtggccaatccagaccctgcactgccactgactctccgggaatgtcagcgccaggtgagagccaggattccagggccagacctgagcttgtccatagcctgggacttgaatggggggaaacttgggcacagtggcaggtggaaaatcaagtctgtgcttcaggggcatctaggaatgccctgtctatcttctcccctccccaaccccatttacccaggtgcctcctgttactttcaatactaatgccttctttttttttttttgagacagagtctcactctgttgctcaggctggagtgcagtgacgcaatctcggctcactgcaacctccgcctcccgggtccaagcgattctcatgcctcagcctcctgagtagttgggactacaggcatgcaccaccacgcccacctaattttttttgtattttcagtagagatggggttttgccatgttggccaggctggtctcgaactcctgacctcagtggtgggattacaggcatgagccaccacgcccaacctgatgccttctttttctgaccatttcctctccagcaatcccaccgtggccacaggaaaacctggcccaggagattccaatgttcttggcttcccctcctgtcacagcctcagtgattttgtgatttcatcttgcttctcagggcttgcttttatcaaaagggttggttagtcacaatggctgttaataggtgcaacaaggcatagaagacctgttaggggttgaacttttccccctacaactccaaaatattaatatattgcagtcctaatcttcaggacctccaagaatgtaaccttatttggaaatagggtcgttgcagatgtcattggttaatgatgaggtcgtactggatcagggtgggccccttatccaatatgactggcatccttgtagaaacaccacagtgtgaagagacagagattcacgcagagggaaaactatgtgaaaagatacacggagaagaccgtgtaaaaggtggaggatgaagcttttgttctgactacgacaggactacgtagtcgaactacgactcccaggaagccgttcggccttccccaccccctccccgcccaccccgctccgccccgtcccggcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtggaatcagaggtttctggctgactcggtgggtgctttgaaccaggaaaggacaagaaagaggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgctgtgcttgtatgaccatttagtgaatttggtgtcttctaaatagaacagtggagtccttgtggacatctcagattcatcacaaaatgattgaggagaacctcttgaagatgtttagagctattgaaatttacagattgttgatgggttttcaccttttccttcctttcttgacacacagttacaggcattgtattccttggattcctacaggtgtcaaggaacagagatccacttacgttaccttcataaatcctggtttattcaaaagtcacagtaaggtagacaggaaatagtcccagccactgcctagctaagccttttcaaaaagcccaaggtcattcagcagatgcagaagcactagttggttttcaaagataacaagagcaataccatcatggtcgttttgatcctctgttcagcagcagggttcgctgcccctgactttagaattctgccatcgtgatgagctgaaggtcaccaacggtcccagtttgcccaggactaaagggtttcttgggatgaaggacattcagtgctaaacctgggacagtcctgggcaaactgggaaaactggtcaccctcctgggtgactcaacgaccatgcctctactttgttacttactattaactgactgatgctgttgactggtttagccaatctgcattcagagcttttgcgtctggttacttcgttggccttcaggcagccacagatggatgctattggatcaggcaccaatgctgaccaaatcaattgtttccaggatggtagggttgtatgaagaaccaactgagaccatgtccttctgagtgttgtggatggtgggcatggcaggccttcaaggtatcagggattcctctccaatacagccttacttacaaaggagaaactaactttctcatgaaaaacaaaacagttcattaagaaacaaaactaacacagccactgggaactgaggaagagagactgtaacatgtgtgcaagcacacacacacacacacacatgcatacacatgctgtctgtagaatcatgagccaggattccaaatctgcatctttgctagacagagatcaagaactaaaacctttgggatggtgttgtctgggaagcaaaggagttggctagaggacttcctgaaattcctttaaactctagaatcctttaaaatatcaagggtgtgtaaactggggctaagtatgtacattctctctaaaggctcctagataacctttgagttcaattcagtgtggagtggggcctcccagcttatacttacctttctagacactgacttttatctgggatgagggagcagaatttggaggtggtagtcagggcgggggtagggaggggagtgggtaagggatagttgcaccagcccaacttttttggtcttaagaacaacctgaacgcaaattacagggtcttttgtggactagaaaaagccaggttttcaggatcacgtggcgtcctgaagttgttgctgcttgtcagggcatctgacctccatcttctctgctgaaagacaggcatgagtgtttgcagtgccggaacaggggccttcagataatttcattcatctggcatggcaagaccacagggagggaattacatgctagggtagagatgaacttatggacgtatcatgcaccttggtgtttgcccctgtagtgattctcactaccttcgctaccattggagggatgctcacccacctccttgggtgccatttttcttttttaaaagatgaaggcatttcagatgatcccttcatttatgttctactttcattctttggtttcaaaagaagtcctgatcttatgtcaaaggcaacaatctcttctctcaatctctctctctctctcactctctctctctggctcactctgtcacccaggttggagtacagtggcatgatctcagctcactgcagcctcgacttcctgggctcaagaaatcctcctgtctctgccttccgagtagctgtgatcacagttgtatgccatcatgcccaggaactctgaaagccacatgttgagatggccccattacaggatggagagcacctgaacccccaagttatggactagaagaagacagttgccctggaaaatcatctgacccacattggactttatgtgagggggaaataaacctttattatgttaagctacacaataataaataacaacaataatt

SEQ ID NO: 467 - DNA, 5973 bp, Homo sapiens; identical to SEQ ID NO: 466

SEQ ID NO: 468 - DNA, 5973 bp, Homo sapiens; identical to SEQ ID NO: 466

SEQ ID NO: 469 - DNA, 1001 bp, Homo sapiens
aaagatcagggcagaaataagtcctgtccctggtcctgtaagagcagctggaagccacgcaagagcaccatgacattcgttcaagcccctctttcagtcctggcacggaaatcgcgactggaatctgcttctaagcctcccaccacatgaccctgccggaggggagcgctccatctttcaataccctcgttatttcctgcagctgtggaagtcagaaacggaacgcacattttagtacaagtggtttatttctcttccaggtgaggccgcatgtatataagcaaaggtttgcccacctggttccttcaggaactccccgaggaatctgtttagtttccatgcattaaaaacaaccctctagttgccaataatgaaactttaagaagcaacactttgacgtcgcagagttcctctctgcatgtgacgcggatataccaaagtgagtttatggcatacagtatgcatgggttaatgtaggtgagacagggagtcccggctgccctgtggccccattctgttgtggaggcttcgctgggagctgagaacaccctgctgtccatgttttgatgacaggtggttcttccaaaacagaagcaccgagtcaccgcacgcccctgcttcagtgtgcgaggccgtggggctctggtgttgtgaactccaggctggcatttaaaaggtgctgacttttaggctgggcgtggtggctcatgcctgtaaccccagcactttgggaggccaaggcaggtgcatcacttgaggccaggagttagagactagcctggcctgcatggcgaaaccccgtctctactgaaaatgcaaagattagctgggtgtgatggcacgtgcctatagtcccaagtacttgggaggctgaggcatgagaattgcttgaactcaggaggtggaggatgcagtgagctgagattgcaccacgtactccagcctaggtcacagagtgatactctgtctcaaaaaaataaacataaataataaatggtgct

SEQ ID NO: 470 - DNA, 1001 bp, Homo sapiens; identical to SEQ ID NO: 469

SEQ ID NO: 471 - DNA, 1001 bp, Homo sapiens; identical to SEQ ID NO: 469

SEQ ID NO: 472 - DNA, 1001 bp, Homo sapiens; identical to SEQ ID NO: 469

SEQ ID NO: 473 - DNA, 1767 bp, Homo sapiens
atcttggagttgggtgggtcctaaatccaacgacaggtgtccttagaagagcgaggtggagggagactagacacagatacccggggggcattgctgctgtccccagaagctggggagaggtgccggaaggattttccctcagagccttcagaaggagccaatcctgcccacgccttgattccaggccttggctttacagactgtgagagaatgcaatggtgttgctttaggccacctgactggggaactttgttacggcatccctaaagaaacacacaagggctgtgatgaggaactctgctcggcaggttcctgtttgtgtcccttggtcacagaagcccttctccgtctcaggtgtgtgttagccggggtctccaaagaaccagagccagcaggggacacacccatctctgtatctggagaaaaagatcgatgagaaggaatctgctcctgtgatgatggaggctgacaagtcccgagagccacggttggcaccctggagacccctgagggtgataccaccactccaggctgaaagctggcaggcttgagaccctgggagagctggccctctgactcctgggacttcttattctatcctagtatttcctcagctgagtgcatggggccagaccacactggggagggcagtcagcgtcactcagagcaccgggtcatctcatgcagaaacaccctcaaagaaatagcccaaattatgctgaccaaatatctgggcaccccgtgccccagacaagttgacacagaaaattaaccatcacaggttaactccatccaggagtggaattgctgggtcatagagaaggcataggaattcacagaaatcaccaaacggttttcaggcggttgtgccatgttaaactcccactggaaagagaggagagctgtgattgttccacgtcctcagcaacgtttagaataggcagtctttggccgggccgggcacagaggctcaaacctgtaaccccagcactttgggaggccatagtgggtggattacctgagatcaagagttcaagaccagcctggccaacatggttaaaccccgtctctattaaaaatgcaaaaattagccaggcgtggtggtgcgtgcctgtaattccagctacttgggggctgaggcaggagaatcgtttgaacccaggaggcagagtttgcagcgagccgagatcgcgccactgcactccagcctgggcaacagaatgagactctgtctccaaaaaaagaaaaaataaataaagaaaagtcattctgtagttttagcctttgtgaaggcatgaagtggcatctcattatggtttaaatgcttatttcgctggtgactaatgaggctgaccagtttttcactgcatttagccctttcaatgcacttcaggtctgtgaagtacttgttcaagtgtattgcccattttaaaaattggtttgtttatctttttcttatcaatttgtaggagttcttgatatattctgggcagaaggccttggtgtagaatctattaagacacaccgaggcgaacggtacatttgtctgcaacttaccttttgactctcttgatggtgtctcaaagttgttgattttaaggaagcccagtcttttatgtcgagtccctttgtgttctatgttagaaatctttgctgaccacagtgtcttcttctttttcttttgagacggagtctcgctttgtcgcccaggctggagtgcagtggcgccatttcagctcactgcaacctccgcctcccaggttcagg

SEQ ID NO: 474 - DNA, 4785 bp, Homo sapiens
cgccctgccccaggcaagcctcaggggtggtggctgttgactgcaggagcagagccagaacagctggcggagaccaaacctggtcatccttcacaggctgtgtggccatgggcaagtcactctacctctctgggtcccggtctccacattttcagagtgagggcagtttctctgtgccctgaaagtggctgggagtctaggccaggtgacagctcagggcaagttctcaagggccccagaagcatctggggtgcaggggaggttccaggatccccagttcccacctttaaatgaggtgactcgagaccctctgagatgaagggaccctgaacgttgatcattttgacctcccatctctaggagcatgtccagagtctgccattccttccagaaaggaaaaaggagaactcacatcaagatctcccttgtttagccagggaggtgggagtggggccggggggcagccaggaaacatgagcacgttcgtcatggagggcaggggctgcacgggcggccagtcaaggcggcaagaacccctcggtgagtggacgtggccccacagggatgtagaggatgaggcagaacccagggctccccgagttccaagtccacgctcccctgcacacgggcccaccgccgccctttccagagagaaaaagaaatttctgtctaaagtcagtcagaacacccccagactccacactggtgacgtccgaatccccccggacaccggtgtggcctcagtccttcctcccagctggttcgctcagctcttgctccctgccagcccccaggtcctggtccttctgccacaggctagcaggcaccccacagcccgatggcggctcagatggagactgcggtactggatatcctgggggtaacatcacagccacaccctccgccaggctggggacagctgcccatgggccgggccaggccagtgctgggattatgtctggggccacccaacaaaagaccacaaatggggcagctgcaaacaacagaagtctattttctccgagtcctggtggccggaaccaaaatcaagctatcggcaggactgtcctctctctgcaggctgcaggggaggttcttcccgcctcttctggcatttggtggccccaggtgtcccgtggacgtggccgtgtcattcccatctctgcctcatcttcacgtggcctctgtcgcctccctctcaaatctcccccgacctctgtcttctaagggcctttgtctctggacaaagacccttttcccaaataagcctgtcgtgttcacaggctccaggtggaccgatcatttgggggccaccactgtgcccactgcagtggagtcggggacggggccactcatggccatgaggccacaaacgggtgtggggtctgagagcagcaggcaggtcacccaacaccagacaggagcaagcccaagcaggggtggccgagagagccgggagggtgatcgggtgaaacgcctgccctcagaggaagagacgggacatggcccacggcggggtctcacctgcggcctctggttctccccgtgctttggcgccgctcccgctccatcctgtcccttcactcccctgttggagagggttttcccacaatggcctggacatggagggctcgggaggtgggtgaccttcccagtgtgcccagctggaactggtcgacttgggcccaggtccatgtgagtcccgggccccgctgcctcctgagaccaaggagcatttccctctctggcgatgggcacgggagctcctggcaggacggcgaccgtccggtgggcccggagaggaggcagctgctgcaccctcggcgctggctctcagggatggctgggctgttaggcccgaactagacctgctgccgccgtgtggagaagaggtggccccaggagcccactgtctcgggtgtgggccatctccatgcctgttcctgtccccatcacacaccaggcagtccccaccagcgcccacatcctcaccagggctctccacgtcccctcctctggtccccacccatgtgtcagctcctcacagttccaaggggccacccagcatccccggggcccaagcccttagaggatgtggtctgggagggtgggacagacacttcttccccaagtctgcctctgatgtgtcacccaaacctttaaactttgcacctcagttttatttatttatttatttttattttttttgagacagactcgctctgtcgcccaggctgcaggctgtggggtgtggcgtgatctcagctcactgcaacctccgcctcccaggttcaagcgattctcctgcctcagcctcctgagtagctgggattacaggtgtgcggcaccacatccagctaatttttgtatttttagtagagatggggtttcaccacgttggccaggctggcctcgaactcctgacctcaggtcatacacccgccttagcctcccaaagtgctgggattacaggcatgagccaatgcacctggtgggacctcaggtctataatgatctaaatcacccaacaggaggaggcagcaagacctggcagcgagggccaagcaggaaggccatctgcctgccccctgcctgtcccctccccacccccagctctcccaggcactacagcctggggcagcccctcccccagggccccaccctcagcctcctgtgcaggtgagcaggagcgggcagcctcactggagcccagatgacggagccggagcccctgccccaccccacctgcatttgaggggtgggatctgcttctggccatgagggaggacagacccccacactctacaaagcctgccccttggctgcttggctgtctgggccaattctggttgtcctgaaccagaggttcttggggtcctcagggttgggtagtgcagcagcgtgcaggctgggagggaagcctgggatcaaatcctggctccccttcttcccgtttggtggccttgacggagagtgagggcttcctggtgactgagcctcgctttcctcgtgtgtcctgggctcggagaagtcctttctggaggaaggagggtcccttcctcttggtcagggcgggaagaaatgtgccccaaggagggatggcagcgcccactgcgcccctttcctcctccccccaccccgggctcctcctctgattccgttttggggactctttcctgcccctcagagtctgaggcttctaggcctgcgctgttcataccttgaccccaccccagcccccatgttcgcaagcctgtgtcccctggagcctcttgtcacagaggaccctctcctgtggagtcccagggctccactcgcccccatggggtttccagcttgcagcctggggtcctgggacgggtgcagggaggcaagtggcccccagcccacggagccccatcatgcagaaaattcggcaaaacccagcttcctccgagtgaggcggctgtcccagggcaagctcggggagggcactgttgccccgctgtcccttggccacggcagggttaggctgtagcatgggcaagactcagggacacagaaatcggaaggggagtctaaaagggggtccagccctgcccagcagcctcaccacctggtggcatcacccccacgctgggcgagctgccccctctccagggcagggctccaaaccgctctgggggaagctggcctcagctgggtgtcggggggcctgggcccatttgcctggacgctgcgggcaccctgcccctctggctccccggggtcctgggcctctcgcgggcaggaatgccatctgtgccatctgaccagggctcccctcactgtgcaccctggcgttttggggcgtgggaaggcgttcaaggctggtttctgtttccccgtcaagccctgagtggagtgcgaccggaggctggccagtggctccccgggcacctaggggaggctgggggcaaactgaggcagtctagagcctacaatcactccaggggcctgtggggcagggacagggctgaggggacctggcaccctgtgggttccccagcagtgtggctggggacatggggacagagcccaccttgcagcctctgatctctgggcctggacatttgtttggagtagtgttcactggtttgttttgttttcttttttttgagacagagtctctctctgttgcccaggctggagtgcagtggcgcgatctcagctcactgcaagctccgcctcctgggttcgagcgattctcgtgcctcagcctcccaagtagctggggctacaggtgcccaccaccacgcctggctaatttttgtattcttagtagagacggggtttcaccaagttggccaggctggtcttggactcctggcctcaggtgatccacccgcctcagcctcccaaagtgctgggattacaggtgtgaaccaccacgcctggcctgttttgttttctgattgcaaaatgaatacatttcaaaagggaaatttgaaaaatataaaaaatccttaaaaagagaataaaacccacccatcaacccatcatgctatacccaggaacactacctccagcttccaggacccccaacctcagccaagggtctccacatacttctctcttctgtaattgggtcttcccgcggaggctggggcctgggcggatggatgcccagggtgggggctacctcctctggactgccgagacctccccagcaatgaggtgccagaccaggaccggggtgaactcaccatgagcttctgttgccgtctgggcctgggctgggagcaggaatctctggggaaggccaag

SEQ ID NO: 475 - DNA, 3024 bp, Homo sapiens
ctagccgccacggctgccgggcattcgagccggaaatgacgctctagccgtacctcgcgctagcctcgtctcaccctgagattacccacaaggcggcgcgctgcgcagacgcaaaagcgtcgtctgtggcggcagctagacatcgggcgaccctcgtcccgccaggttttggggtcgcgcaaacgagcgacgggggctggggctccggattcaggtgttctttcttcagcgctcacgggtttctgtccgtacgcgatgcgagcgaacgtcgcggtcgaggctagggccccgaagcccgcagtaatccacgtctcccgcccgctccgggcccccagtgccgccgtcgcgggcggaggcgcgaggtctgggctttggcgccttcgcagccgcaggcgacatcctctttcctagctaaagccccaaacgcccaggtggcttcctgggagagcacggctgagcctccgccttcagatcagaacaggcagagcctccaagggcggcttgggcccagtgcctgcttatcctgcccgtctctccacacttcttctttccctgtccgttggagtccattccttcctggaaaagccaaagccgcgctcccctaagaggcctggatgtgaaggaatgaggagcacccgggaagcttcagccactacacgaaggaggcgccaagcccaaactcctccccagctaccggcggggtcagtgcagagccgcggagggcacacatgaaccctggcacgcagcctcagggaggggcaggctggaaatgaccctgcctgcagctgggccatcagcctgaccacctgccccctgagcaaacgttgatgcaggtcgggcgcggtggctcatgcctgtaatcccagcactttaggagcccgaggcaggtggatcacctgaggttaggcgttcacgaccagcctggccaacatggtgaaacaccgtcgctactaaaaatacaaaaactagccaggcatggtaatggggtgcacctgtagtccagctactcgggaggctgaggcccgagaatcgcttgaacccaggaggcggagcttgcagtgagcggagatcaccactccagcctgggtgacagagtgagactccatctcaaaaaaattaattaaagaaaaaacgctgatgctttctgaaatacattttattatcgctgtaccattctggggcactggagatggcagctgagaagcagagaagctggagacctgaagcctccacccttggctgtggctgccgagagaggcccctgcagagggagccccaggccacacccagacaccacagccagctcacagtgcggccagagggcacaggctgcttggggggtgagggtccccattcctgccacctctcacagaccatgacccacagggctgggggcttcccctgggagaaagtccttccctccccatggcccagccctggggaaagaaagcagagactaactcagggactgcagtaggctgaggacaagggaggtgggcttggggtgaaggccccccctcactcgcagagaagggacactaccggcagtagaggacagggaggcaggacgacggcagttagagacgaggcgtttcaggtgaactgtatgtagtgttactccggacgtgagcatggcctgggtcagtcgaatgaaatgagctgggcctcgctgccctgtgccggcggcccctgtgcctgcggttgctgggccacggggggctgctgctgggggggaccgccagagggtgccatctgtgcaggaggaaagcaggcatggccctggtcctcccttccccagcccagggaggaaggcttttgtcccagcagagccacagacccacaagtgcttgtaatccatgtccacggactgcagctcatgcagccagctcatgcggcctttgcctttcaagtaaattcacggtttttcctgtctacacttgcggatgcgcgtatctgccctgagacttgtgtcctcgttctgtctgctgagaaggggcctcgggtatgcgtctccccctgtgagcagacgtacgggacaatccccactggggccaggggtcccattgctaaaccgtgaagcctgagggtgccctgcgggtgccgctgtgaggccccgggaatggctcacctgctggtacatgggctgctgccccgcgatgtagggctgctggggtggcagagacgcatcctggcttgggagggtggtcatgagattctgttgtgagaagacgtcagatgtgagagagtagccctgtgaccaggcaggcggggatgtttctggcttgcaacaatccaaaggtgaccacagggagcacccagagagtggagggggaggagcagaaggggtggagcccacccagtgcctgccagcctcaccaaaggaccctcagcatcatcaactgctcccccaccctggcccccagcagggcctggaggtcactgtacctgcatgttgtaaggctggtagcccatggagactgactggctccccatgtagcccatggtgctggactgcggaggctgagagatggccgggaggctctgtggggcctgggaggccacgttctgcggagggaatgagtgccatgggagaaggggctggggctggggctggggctggggctggccctggaaggagaggagcggccttcctgtgtacctggtagcccgctgtgggagtaggctggtaggatgagtaagcggggctggcggtgggtccggcctgggcctggggggccgcctgcgccccagtggcccctgctgggtacatgtaggcactcaccatgctgggatctgtgacaaacaagacaggggagatggttcagccagggcaacagggaggagaggaagggacaccctactcttgagttttacttttttttttttttttttgagatggagtcctgctctgtcaccaggctggagtgcagtggcacaatcctggctcactgcaacctctgcctcccgggttcaagcgattctcctgcctcagcctcccgagtagctgggattacgggcgtacgc

SEQ ID NO: 476 - DNA, 3024 bp, Homo sapiens; identical to SEQ ID NO: 475

SEQ ID NO: 477 - DNA, 3024 bp, Homo sapiens; identical to SEQ ID NO: 475

SEQ ID NO: 478 - DNA, 3024 bp, Homo sapiens; identical to SEQ ID NO: 475

SEQ ID NO: 479 - DNA, 2710 bp, Homo sapiens
actctgcgcgttccttcgtcgaacgtggcagtggggaggagttcccagtttaggggcggagctgcggctgcgcttccgaaacccctcgtgttgcattctgactggaccgcgtacccaactggcacgccccccggcccccggaccggaagttggggtgacgcaatttccggcgcgcgtgtcaagcgtgcggcggcggccgtggaaggtggggttggccgcctagggtcggcggtgggctcggtgtgggatagccggcccggtccgacgcgctccgcgaggtcacgcgagacactcaccgaggcatggcggcagggcctgggcatgggaatcgtgcgcacagtgcgaggaagcctcggaggggatacgagcacagggcgggtggttaggagaatggggctggagagacgggcgggaggggcgggacctgggccccggggacctgccggctcccaggccccaggaagacgctgctcatgcgtggagcggccgcaggaaaggtactccccgctaaggccttcagggagcggccctttgccctgtgcgatctcttccttcctttcccacgggttgccaaatcctgtgacgctgccccttctctggtgcttctcagatgctctggtcggctcaggagacctcgcagctgttacacagctgtggaaataccctgggcgctgcttcactccgaaggcagcagctgggtttgcctcccgactcgacccgccaccgaggctcctgagcacttgaaatatggccagtccacctgagacgggctgtgagtgcgcaatgcacatcaaacttctaagactgagtgtgcgtgagccaccgcaccaggcctcctcttctatcttttaacgtggcttttagaaacttttaaaattacatagatggtctgcattttgttagtgttggacactggcagccctccgtctccctcactgcctggaatctgctgctctccttttccccaggtgcctgccctctccattcctcctcactttcctccgctgggaatcggcaccgccactgattttaaagttgaaacttggcaggcaaaagggaggtactcccatgttaaatgtatacacattgactgcaataaaggcagattttgaaactcgcatcaggccagaaaaagaatttctgaatggacacttctaaggggtgcctggttactcatctgcctcttccccctgcagggtagaggggcatgggtttgaagttcccgggggctcttggagactgcagacacggacgagctggggttcctggatgctgcagcagttggggcccctggctgagcgcacctgccccaggaggccctgcgtggttcccccagtagccccttcacaccacaccgcagtgaggatgccctgtctcctgccgatcccatcacaccaagccttttcgctgttgggctcctggcactgcccgatcctggagggcacttggctgcggctgtggctgtgaagggctggtgctctaggcgcctccgtggcccccgttgcctgggcacctacttcctgcctcagccacagctgcatccacgtgcgccaggggccacaaggccgaccctggcttgggcctgttcctccctgggtttccttgggatccagtcattggagggcccgcgcacagctgggccaactcgacacctccaagcccggccagggaatcaagcagctctccctctggcagcatgagctacacaagccaggcccgtcttcccattcccttagcaaggaggggcaaccccagccaaggccttctgcactgttctagactgttgctgcctagggctactgtagctgggagtcacattcctttctccccagatagttgcaaggggcccagcagccacagcacttcaagggggccctgcccttcccctcccaccaccccaccagggtccccatcttcccctttgtctcctaaagcccgtgaggcagtagaggagccaggccctcccctgccacaccctggagaagccaagcagcagacacccccagctccttcaggggcatttatttcccggtcagaaaagaagcagggacaggcgcctctgcctgagcctggcagacacaacacgaagaccggggatggggcgggggaggcacaggagacggctctcagcaatgtgtgcacttggtcccttgtttgttcctggctgggtcagggaaggcctgccgggggtggtggcactgagagcctgggggaacaggcgccaggccagtggcccagggacggcacggacggaggcaataaatactgatggccaggcggggctcctggctgggcccaggtggggtgagtgaggctgtccatcgagggctcttgggggggtgtgggctctgggcactgcccgctgagacagaaaaggcagaggcaggacaatacccagcctcctggatggtactgaggtgacttgagttttggcaatttggctttccccaagccgccggagccatctccacagccctgtccagggaagggggcaggctggccaggcactggtgggctggggagcagcagcagcacaccccacgtgtccctgggtcactgggttcgccaccggggaagggacggggaggccacatgctcatgcagacacagggagttagaggctagtgaggccccacggtacactccacatgttaaggcatcatggttagacgggaccgacagcgacaagggggctggccagggagcagcg

SEQ ID NO: 480 - DNA, 4227 bp, Homo sapiens
cgccgctccacagacgtcacatgatgtttggtcacgtgggctccattcatgaagcggcgacgcggccggccggcgcttaaaggggaaggcgcggcggcgggagggcaaactgcgcatgcgcaacccgcgcgccgtcgtccctggcaacactggctgctctagcgcctggcggggtctcacgggcgggcctgggcgcacggccaaagcgccaggtctccacccccagcccccggcgtcctgcagccggagcctgcctcgcctggctcctgcgcccgccgtccagggcccctgtccaagctcgcggacgccggcggcgttttccagctcgagtgctcagcctagggcaggctctgcgtgcgccccctcgagtgccggcctgggccctgccaggcagaggcgctcttgcgtcaggacggcgccgccggggccccgcgattccaactcgggggtcccggagcggcgcggggcggggacggcctggcagctcccagcagcgaggggcgatccccgcccgcgcagcagaccccgagctgcccaggcccttcctgcgccacgtgtacccagagctccgcccgggggagacttcgctgcttgttggagatgcccagcggtagggggcgaggactcgggaggaagataaacgggggatcccgtgtctggactttctcctccaccctcttcccttcgcagctgtgaatcctgggaggggaagggtggccgccccgccagcagagagctgaaggtgttccgtggtcagtgagggctggcactggctctgcacgaagatctcctcacctccccagcggctcctggccagctccccacggagagcccaggacacttgtccctggacacagtggtgcagccatgcttgggccaaaccatgaggccaccagaaccgcgaaaggctactgtactgagagggatactgcgagagaggcccacaggtttccaagcatccctctcactccgcacactcatctccacgaccggctttaagtgcggccttgaggcctggctccctgtttggacttctctgcacctccaggagctcacttcccgtcacagctggatgcctcctcccgcaggcacctcccgggcatcctcccgccccaggctgcaccttctgtgggactgagccccgcaggcacttccccggcatcctcccgccccaggctgcagcttctgtgggactgaccttaagaccccatcggttcctcctgagagcagcagatctcagccagatgctgccgggagggaggtgctagcgtccacacccagacgggtccagtccagccctgctctccctggtctccaggcagggccctcccagggtggacattgcccatctctgcctggccaggggctgctgacccactggttccagagtctgagcctgtcctgcacaagtaccatggacaggggtcagccgggcactgaagaggcgtggcagaattgggcagggcaagggccccagctggcaagctggagtcagggcaattccaaccaagaaactgcggcaggccgggtgcagtgtctcaagcctataatcccagcactttgggaggcagtgggagaatcgcttgagcccgggagtttgagaccagcattggtaacatagagaccctatcgctacaagaaaaaaaaaaaaaaaaagctgggcatggtggtgcacacctgttgtcccagctattcaggaggctgacgtgggaggattgcttgtgcccaggggttgcaggctgcagtgagctgtgatcataccactgcactccagcctgggcgacagagaacctctctaaaaaaaaaggaaaatgaaaaataaatgggggcagaagctgagccaagcagaggcgggcagctcctcctccagggcccacctggcctgctggggactcactccaaaccgcttcatttttggagggggctttccaggactgagaggtgtcagagctgctggtgacaggagcagggaaagcaccatctggccagcccccaggggccccctgtagggttcctctgcctggcagcgtttcgacgcttcttggcaggatccttgggtccttggcccccggcaccatctccctccttgacctgctgaggcccacataaaacatgttgctacttggggtgggcccgtcctcacgctctgtggcttcctgggtgtccacctccccacagcctgcctcacctacctccccagacttctcacgcacgtcaggagcctcctgtggactctggctctacctgcctctggcctctgcttaatcaggaacccacagtgggaaagctcctagggcccgcctgctgaagcaaacgcctccttgcaaagcccgtctgcagccccccacacacctcctcacctccctgtgcttcctctggagcccaagaccagtctgcctcacttgaaacccgcgtcgcctgctggcttcccttgtgtccccggaccagaagcacctttggcagccccgcgcccctcgtcttgctctgcgtcagcacctgagaatgggcgctagcagggaaactggctttgaggggaatggtcggggcagctttggtcctgggacaggcgtgtggcctgtgggacaatctcttctgggggcacctctgcccaggtgggaggagttgccagggtctcccagcactgccaggcgctttgctggggcagggggttattctattgctcacagccctgacacaagggcattccccacccgccctgatgcccacatccacccatacaggagggggccttcaggggagcctgcagggactcccggcccagcaccgtccatctgtgtcccccgcttagctcctgcactgccagatctcagccagacagcagggactcaccccacctaccgtcccctttgtgcctgggtgtggtgggtactcgttttatggggagtggccaggactcttgccagggggagagtggcggtggaggatgtacccatgccatctgccctgccgcagcgtttcctccctgttcccctgcatgtcttccctccctcgggggaaacgcaggattctgttccccaagcgccctctacacgccccatatataccaagcatggttctgcagtgagcctatggggtctctggaaatgagttcccgggataagttccagaaagttgctcagctctcctaacccctgcacaccctggagccccctgcataccctgactcctggcgcacctgggacccccctgcacaccctgacaccctgctgctacccagcccagctcccctcacacagtgtgcactgcctctggagggaagggggcctcatcttgctgtctccatactcagtaactatgtgttggttgaaggaaccagagcacccctggcccttgtaacccaaccctcagcagctcctccaatcctgtgggcctcctggaatgggtgattgtatgtgtccacttgactgggctacagggtgcctgagtgtttggtcaaacattattctgtttctggcaggggtggggaggggttgcatgagactaacatttgaatctgtagacttttgcattagattacattgacattttaatcagtaaggcagatgccctccaagatgtgggcgggccttgtctaatcagttgaaggcctccactattccacccacagtaaccaccctcccacacaggcagggcctccctcctcatgtggcagacagaagtcaggacactgggggctggaaaccaacttataaaactgaaagggccaggacagaactgatagcaccctcccagggaggtcaggagcaggaggtggtggccacagaagttcaccagcagcccaaggagccctttccccaaatgtccatgggatctgcgtgcttggcagccaagaggggctgtggcccttcacgctggacttgggatgcctggaccctctggcccttctcacacgggaaggagaggttgaggttggggaatccacccctgttctgggctgggaagcacttgcagaccacagagatttccagtgggaagtgatgtggcccctccctggctatgtccctggctggcccctgcgctgatcagagccacagaaagtgggccactttggggaccccctagtccccctagtgacaagagaagagaaggtggtggcaggatggtggtcaggcaggacgtgtcaatccttgcccgctggggccaggctgcgggggagcagcttggtgtggccagaaggtgacagagcggtccctgcaggggagtcca

SEQ ID NO: 481 - DNA, 4227 bp, Homo sapiens; identical to SEQ ID NO: 480

SEQ ID NO: 482 - DNA, 4227 bp, Homo sapiens; identical to SEQ ID NO: 480

SEQ ID NO: 483 - DNA, 4227 bp, Homo sapiens; identical to SEQ ID NO: 480

SEQ ID NO: 484 - DNA, 4227 bp, Homo sapiens; identical to SEQ ID NO: 480

SEQ ID NO: 485 - DNA, 4227 bp, Homo sapiens; identical to SEQ ID NO: 480

SEQ ID NO: 486 - DNA, 4227 bp, Homo sapiens; identical to SEQ ID NO: 480

SEQ ID NO: 487 - DNA, 4434 bp, Homo sapiens
cgccgctccacagacgtcacatgatgtttggtcacgtgggctccattcatgaagcggcgacgcggccggccggcgcttaaaggggaaggcgcggcggcgggagggcaaactgcgcatgcgcaacccgcgcgccgtcgtccctggcaacactggctgctctagcgcctggcggggtctcacgggcgggcctgggcgcacggccaaagcgccaggtctccacccccagcccccggcgtcctgcagccggagcctgcctcgcctggctcctgcgcccgccgtccagggcccctgtccaagctcgcggacgccggcggcgttttccagctcgagtgctcagcctagggcaggctctgcgtgcgccccctcgagtgccggcctgggccctgccaggcagaggcgctcttgcgtcaggacggcgccgccggggccccgcgattccaactcgggggtcccggagcggcgcggggcggggacggcctggcagctcccagcagcgaggggcgatccccgcccgcgcagcagaccccgagctgcccaggcccttcctgcgccacgtgtacccagagctccgcccgggggagacttcgctgcttgttggagatgcccagcggtagggggcgaggactcgggaggaagataaacgggggatcccgtgtctggactttctcctccaccctcttcccttcgcagctgtgaatcctgggaggggaagggtggccgccccgccagcagggtcgagcccgctctcatttgcacctccgcgcgaatttggaacggatttatgaatcgtcctcactgcggtgctgtcttctcctgggaaggagcctcagtcctcccctccctgggcactgtcatagagatgggcaggacgggctggggaggacactcagggagctgcccaggctcctttgctgcccctcaccccagaatcttcttgggagagctgaaggtgttccgtggtcagtgagggctggcactggctctgcacgaagatctcctcacctccccagcggctcctggccagctccccacggagagcccaggacacttgtccctggacacagtggtgcagccatgcttgggccaaaccatgaggccaccagaaccgcgaaaggctactgtactgagagggatactgcgagagaggcccacaggtttccaagcatccctctcactccgcacactcatctccacgaccggctttaagtgcggccttgaggcctggctccctgtttggacttctctgcacctccaggagctcacttcccgtcacagctggatgcctcctcccgcaggcacctcccgggcatcctcccgccccaggctgcaccttctgtgggactgagccccgcaggcacttccccggcatcctcccgccccaggctgcagcttctgtgggactgaccttaagaccccatcggttcctcctgagagcagcagatctcagccagatgctgccgggagggaggtgctagcgtccacacccagacgggtccagtccagccctgctctccctggtctccaggcagggccctcccagggtggacattgcccatctctgcctggccaggggctgctgacccactggttccagagtctgagcctgtcctgcacaagtaccatggacaggggtcagccgggcactgaagaggcgtggcagaattgggcagggcaagggccccagctggcaagctggagtcagggcaattccaaccaagaaactgcggcaggccgggtgcagtgtctcaagcctataatcccagcactttgggaggcagtgggagaatcgcttgagcccgggagtttgagaccagcattggtaacatagagaccctatcgctacaagaaaaaaaaaaaaaaaaagctgggcatggtggtgcacacctgttgtcccagctattcaggaggctgacgtgggaggattgcttgtgcccaggggttgcaggctgcagtgagctgtgatcataccactgcactccagcctgggcgacagagaacctctctaaaaaaaaaggaaaatgaaaaataaatgggggcagaagctgagccaagcagaggcgggcagctcctcctccagggcccacctggcctgctggggactcactccaaaccgcttcatttttggagggggctttccaggactgagaggtgtcagagctgctggtgacaggagcagggaaagcaccatctggccagcccccaggggccccctgtagggttcctctgcctggcagcgtttcgacgcttcttggcaggatccttgggtccttggcccccggcaccatctccctccttgacctgctgaggcccacataaaacatgttgctacttggggtgggcccgtcctcacgctctgtggcttcctgggtgtccacctccccacagcctgcctcacctacctccccagacttctcacgcacgtcaggagcctcctgtggactctggctctacctgcctctggcctctgcttaatcaggaacccacagtgggaaagctcctagggcccgcctgctgaagcaaacgcctccttgcaaagcccgtctgcagccccccacacacctcctcacctccctgtgcttcctctggagcccaagaccagtctgcctcacttgaaacccgcgtcgcctgctggcttcccttgtgtccccggaccagaagcacctttggcagccccgcgcccctcgtcttgctctgcgtcagcacctgagaatgggcgctagcagggaaactggctttgaggggaatggtcggggcagctttggtcctgggacaggcgtgtggcctgtgggacaatctcttctgggggcacctctgcccaggtgggaggagttgccagggtctcccagcactgccaggcgctttgctggggcagggggttattctattgctcacagccctgacacaagggcattccccacccgccctgatgcccacatccacccatacaggagggggccttcaggggagcctgcagggactcccggcccagcaccgtccatctgtgtcccccgcttagctcctgcactgccagatctcagccagacagcagggactcaccccacctaccgtcccctttgtgcctgggtgtggtgggtactcgttttatggggagtggccaggactcttgccagggggagagtggcggtggaggatgtacccatgccatctgccctgccgcagcgtttcctccctgttcccctgcatgtcttccctccctcgggggaaacgcaggattctgttccccaagcgccctctacacgccccatatataccaagcatggttctgcagtgagcctatggggtctctggaaatgagttcccgggataagttccagaaagttgctcagctctcctaacccctgcacaccctggagccccctgcataccctgactcctggcgcacctgggacccccctgcacaccctgacaccctgctgctacccagcccagctcccctcacacagtgtgcactgcctctggagggaagggggcctcatcttgctgtctccatactcagtaactatgtgttggttgaaggaaccagagcacccctggcccttgtaacccaaccctcagcagctcctccaatcctgtgggcctcctggaatgggtgattgtatgtgtccacttgactgggctacagggtgcctgagtgtttggtcaaacattattctgtttctggcaggggtggggaggggttgcatgagactaacatttgaatctgtagacttttgcattagattacattgacattttaatcagtaaggcagatgccctccaagatgtgggcgggccttgtctaatcagttgaaggcctccactattccacccacagtaaccaccctcccacacaggcagggcctccctcctcatgtggcagacagaagtcaggacactgggggctggaaaccaacttataaaactgaaagggccaggacagaactgatagcaccctcccagggaggtcaggagcaggaggtggtggccacagaagttcaccagcagcccaaggagccctttccccaaatgtccatgggatctgcgtgcttggcagccaagaggggctgtggcccttcacgctggacttgggatgcctggaccctctggcccttctcacacgggaaggagaggttgaggttggggaatccacccctgttctgggctgggaagcacttgcagaccacagagatttccagtgggaagtgatgtggcccctccctggctatgtccctggctggcccctgcgctgatcagagccacagaaagtgggccactttggggaccccctagtccccctagtgacaagagaagagaaggtggtggcaggatggtggtcaggcaggacgtgtcaatccttgcccgctggggccaggctgcgggggagcagcttggtgtggccagaaggtgacagagcggtccctgcaggggagtcca

SEQ ID NO: 488 - DNA, 4434 bp, Homo sapiens; identical to SEQ ID NO: 487

SEQ ID NO: 489 - DNA, 4434 bp, Homo sapiens; identical to SEQ ID NO: 487

SEQ ID NO: 490 - DNA, 3547 bp, Homo sapiens
ggtggatcgggcggaggccgtcaagctagccggaaggggctgtgctgtcaaccagcgagcgcaggaggtgttaaccaccgaagggaggtagaatgtttttccccaccagaggaggcagcgaccacgtctcctctatggaggcattcaagagccgtccagctgaagcagcatcactgtctgaggtaaatacctggggttcaccatcttgcaccaagaagattaaagacatggacacatgtgagtgggttgaggagcggaaattttaataggctgaagaaaggagagaggagagcagctttctctctctttctagagagaggcatccaaaagggaaaaagccggcctgaggtggaccacagcagacttgataggcaggcttgaggaggcggcgtctgatttacacagggcccacagattggtctgatcaggtgtgacgtttacatagcgctcggggaaggctggtcgtcccaccctaatcttattaaacaaatgggctttctacttggccagtaccatcttgtctgctccttactatacacgcgggtggcaaagacaggagaagatggagccaccgttttgaacgtgtctattcccagctcggaaggcacaatccacataggtctgcatggtccaccgagctgcatacccacggggccagcgggaggtgggcagctgctgggctctcttctgaagcagacaggatctcactctgttgctgaggctggatcacagctccctgcaaccttgaactctccctcaagcaattctccccactctgccttccaaagcactagcattataggcctaagccaccactcccatccactgtagtgtaaactgtctccttcaatgtttccaatagttgcggagcagatcagataagggttcttcctgtctgttgcttcaagtttcattctctctttaaacaatacaaggttggcttccatggttccttcttaaagaatgttgaaggtgtgtcttcagattcatttagtgttcgtggaaccccagggaaagctgatgtaaaaacctcttttttctcccatatgtctcaaaaagttgtattttctgggtccaagggatctgcaagcctcctaaaggcatttccattgtcactaccaccaggtgtgaactgtaatctggcacgtatagttccaagaactgtcataatagatgctgaagaaacattgtgaagttaactcgctgttaccaactgtgaagtcattagctagaggaatcttgggcggtctgaaatctgagatactgtggaaagaacagaaagatcctgtatctttcctataattgttctactggaagttgtcattttacacaggagacattctgttttatttattttcttttgagacagggtctcactctgtcgcccaggctggagtgcagtgttgttaccacaggtcactggtgcctccactgcctgaggactgctcaagcaatcctcctgcctcagtcccctgaggagctggggccacaggcctgcaccaccatgcctggctaattatttttatttgtagagacaaagtctatcttgcctaggctgatctcgaactcctgggctcaagtaatcctcccgcggtggcttctcaaagtgcttgggattacagatgtaagctaccatgcccggcctcacaggagacatttttgatgtccctcttgacagtctacaaaagtctacaaatctttttttttttttttttgagacagggtcttgctctgtcacccagtctggaatgcagtggtgccatcatagctcactacagcctgagctgtactgagctcgagggatcttcccgtctccgcctcctaagcagctgggactacaggtaatggaagtgggcagagaatgatcctttccctaggctccagtgtgtaagaattaaagaaagaggaaagaaacacaatggcttgatggtcgaggacaggtttattttaaagaaaacaaacccaagagtggcttctggctgagttagatcagaggcatgctctcttacagactaagagtttttaaggattcagggtgggagagtttatcagaggcttggactgcttctgtgtctctttaggtgtgcttatctgggagggagttgtgtgtctgtttccatacatcttcctgcagctgcaggcatacccccaggtctgcttttagcttccctatcttagtgcacctgaagggaaagaatgtgcttattaaggcccactgttatactggggcccaatgtatgagggtgaagtttggcaattacccaagagactttccccccacctccctctgtgcctgagctgtctcatctatgttttactgtctgctctttctgtctgcttgttgttagaagagaagtgattttcttgaaatgcatgaggctggaaagggagctggcacttaaagtggcggtgtttgtccgagaggatggtgctcctgctctgtcacagtgggcatggggattcaggccactgccaccgaatttcaagagcccaagcacagagcccagaactaaattgtgagggtttaaaaaaaaaaaaagctttattgaagtataattgacatacaataaacttgaatatttaaagtgtacaatttatgcgtttgggcatttgtatatacccctgcaaccatcagcacactgaagataaggaatatacccattacccctgaaaatttccccatgccctttggagcccctcccttcaacccctcaaatacttaatgcgctttttcccgaaaggcaagaagaaagcttccctacacatttatcaaggctgttataatcctgactcccaaacaaggtaaggaaattgttagacacttagagaacactttcaactattgtattcagatgttaaaatcctcagtaaaattcccataacagttaattgaacaaaccaattatgcaaaaacatacaatcaactataattgcaccctatagactcccctttttattctctaatgtgttatattccactaaatctttcttcatcttgccagtttttcttctaatttccctgcagctataattttggctgatgctatagtttgaatatttgaccctccaaacctcatgttgaaatttagtccccagtgttggaggtggggcctggtggaaggtgtttgggtcatgggggtggatcactcatgaacggcttggtgctgttctcatggcaatgagtgagttctcacataatcagttccctccagagctggttattaaagagagcctggcatctcccctctgtctctcttgcttcctgtctcatcatgtaatgtctgcacacactggctccccttctgccatgagtggaaactcctggaagccctcaccagaagtagatgctgttgccagcagaaccacgagtcaaataaacctatttttataaattacccagcctcaggtattcctttagagcaacacatatggactaagacagtgatgttctcaatttaccctgacattgcatgcaggccggctgtttcctcttaagttcccggagtgggaatgtgttccggacaaaggatgctagtgagtggcagtc

SEQ ID NO: 491 - DNA, 3547 bp, Homo sapiens; identical to SEQ ID NO: 490

SEQ ID NO: 492 - DNA, 3153 bp, Homo sapiens
ggtggatcgggcggaggccgtcaagctagccggaaggggctgtgctgtcaaccagcgagcgcaggaggtgttaaccaccgaagggaggtagaatgtttttccccaccagaggaggcagcgaccacgtctcctctatggaggcattcaagagccgtccagctgaagcagcatcactgtctgaggtaaatacctggggttcaccatcttgcaccaagaagattaaagacatggacacatgtgagtgggttgaggagcggaaattttaataggctgaagaaaggagagaggagagcagctttctctctctttctagagagaggcatccaaaagggaaaaagccggcctgaggtggaccacagcagacttgataggcaggcttgaggaggcggcgtctgatttacacagggcccacagattggtctgatcaggtgtgacgtttacatagcgctcggggaaggctggtcgtcccaccctaatcttattaaacaaatgggctttctacttggccagtaccatcttgtctgctccttactatacacgcgggtggcaaagacaggagaagatggagccaccgttttgaacgtgtctattcccagctcggaaggcacaatccacataggtctgcatggtccaccgagctgcatacccacggggccagcgggaggtgggcagctgctgggctctcttctgaagcagacaggatctcactctgttgctgaggctggatcacagctccctgcaaccttgaactctccctcaagcaattctccccactctgccttccaaagcactagcattataggcctaagccaccactcccatccactgtagtgtaaactgtctccttcaatgtttccaatagttgcggagcagatcagataagggttcttcctgtctgttgcttcaagtttcattctctctttaaacaatacaaggttggcttccatggttccttcttaaagaatgttgaaggtgtgtcttcagattcatttagtgttcgtggaaccccagggaaagctgatgtaaaaacctcttttttctcccatatgtctcaaaaagttgtattttctgggtccaagggatctgcaagcctcctaaaggcatttccattgtcactaccaccaggtgtgaactgtaatctggcacgtatagttccaagaactgtcataatagatgctgaagaaacattgtgaagttaactcgctgttaccaactgtgaagtcattagctagaggaatcttgggcggtctgaaatctgagatactgtggaaagaacagaaagatcctgtatctttcctataattgttctactggaagttgtcattttacacaggagacattctgttttatttattttcttttgagacagggtctcactctgtcgcccaggctggagtgcagtgttgttaccacaggtcactggtgcctccactgcctgaggactgctcaagcaatcctcctgcctcagtcccctgaggagctggggccacaggcctgcaccaccatgcctggctaattatttttatttgtagagacaaagtctatcttgcctaggctgatctcgaactcctgggctcaagtaatcctcccgcggtggcttctcaaagtgcttgggattacagatggtcttgctctgtcacccagtctggaatgcagtggtgccatcatagctcactacagcctgagctgtactgagctcgagggatcttcccgtctccgcctcctaagcagctgggactacaggtacttgcccccaggcccagataatttatttaaaaactttttttgtagagacagggtctcactatgttgcccaggctggtctcaaactcctggcctcaaacaatcctctacctcaacccccctaagtgctggcattacaggcatcagctgccatgcctggctacaaatcttaatgttttccccatggcttctttttctggcgttcttttctcaggtaatggaagtgggcagagaatgatcctttccctaggctccagtgtgtaagaattaaagaaagaggaaagaaacacaatggcttgatggtcgaggacaggtttattttaaagaaaacaaacccaagagtggcttctggctgagttagatcagaggcatgctctcttacagactaagagtttttaaggattcagggtgggagagtttatcagaggcttggactgcttctgtgtctctttaggtgtgcttatctgggagggagttgtgtgtctgtttccatacatcttcctgcagctgcaggcatacccccaggtctgcttttagcttccctatcttagtgcacctgaagggaaagaatgtgcttattaaggcccactgttatactggggcccaatgtatgagggtgaagtttggcaattacccaagagactttccccccacctccctctgtgcctgagctgtctcatctatgttttactgtctgctctttctgtctgcttgttgttagaagagaagtgattttcttgaaatgcatgaggctggaaagggagctggcacttaaagtggcggtgtttgtccgagaggatggtgctcctgctctgtcacagtgggcatggggattcaggccactgccaccgaatttcaagagcccaagcacagagcccagaactaaattgtgagggtttaaaaaaaaaaaaagctttattgaagtataattgacatacaataaacttgaatatttaaagtgtacaatttatgcgtttgggcatttgtatatacccctgcaaccatcagcacactgaagataaggaatatacccattacccctgaaaatttccccatgccctttggagcccctcccttcaacccctcaaatacttaatgcgctttttcccgaaaggcaagaagaaagcttccctacacatttatcaaggctgttataatcctgactcccaaacaagtggaaactcctggaagccctcaccagaagtagatgctgttgccagcagaaccacgagtcaaataaacctatttttataaattacccagcctcaggtattcctttagagcaacacatatggactaagacagtgatgttctcaatttaccctgacattgcatgcaggccggctgtttcctcttaagttcccggagtgggaatgtgttccggacaaaggatgctagtgagtggcagtc

SEQ ID NO: 493 - DNA, 532 bp, Homo sapiens
gtttacgtctgttcgcggcaccaggcaaggggaggagactgagctggcttttgattggacagcgggaagacatggggcgggaagaagcccggtgattggtggggacagcgcgttcctggatttgaagcgaggaagccgcgcgccctgcgagtccggaggaggaaatggagctctgcgctgcgtgggacccgggggacggctcccgttggcgccgccttcaaggtaagggattaagaggccgagagagatatcgtctgcgagggtgaggatactggaggttggcagtgtcagcatcgcaagagtgctctaccagaggaggaggaggaggaggaaggagctgggcataactggaccatctcgatccagcccgtggggaatccagaggggtaaagaaatacctgaaacaatgaagacaggaacaaaacaccaaacaaaacaaaaacaggaaaaaaaaaacacaagaaaaagagaaaagtagtaaatacaaagagaaccaaagaggagaaaacacatgctagaaaaaaaaaaaaaa

SEQ ID NO: 494 - DNA, 439 bp, Homo sapiens
gtggaacttgggattcgaacggcaggcgggaagtgctctagcaggggagtctgaccttgtgagggaatacctgtgtccccccttttttcccctttttacccaataaaaccctgccttactcaccctttaaatcatctgcgagcctgaattttcatggccgtgggacggacaagaactttatcttcagctgaactaagaaaaagtcctgcaacatttttggcgcgcaatgtgggggcaccagaagcgggcaccgttgagctgttgcaactgttctgctggagccttatgtatgtggttgaaaccacctgtactactggaatgaaagcacctttacagaagaggcaatgcaagttgtattcatcacatgtgtagaatgaattaagatttatgccagttgcaaagaagaatattggctcactatttttcctctgggcatcag

SEQ ID NO: 495 - DNA, 439 bp, Homo sapiens; identical to SEQ ID NO: 494

SEQ ID NO: 496 - DNA, 954 bp, Homo sapiens
cacttggtgactgccggccaggccagggagagaagccaggagtctaggagcctgtagccccgcccccgtctccgccacacccgggccacgccctcgtcctggccctgcccacgccctggccctgccccctcacccgaccccatccgggtccccacctccgccccaggcagcaccaacctggggtgcgagaccagcctgcggtgctgggcttccaggagctgctgctgcaggaggtattgctggtgcagggcctgaggaaagaaatgcctgaagaagagttaaaagcgcactgcggttgagggattttgcctctggtgtggagggcaaagggcagaccgaagctgcttggctcaatgtgtcttatgctagtctattcagccttgtatattacgtgcatgtcactgatcaatttttaaaaataaatctttgcaaaaagaaatgaaaatccaaagaatttctgcctgactgcaagtgagccagaaaagaattatctagaactttaattcccacaaggatttccataagtcaggcctctctgccttatagattctggctttggtgagtccgggggctgcagcatgagcaagcggcaccggacccccttcccttcactccatggtctaccatcacacaggacaaagggaaggagactgccagtgtgacagagggaaggagggcaagaaaagggaagcacagtagagggataaagaagagaagtagaagataagcatgtctataaaggaaaagaatggggtgaaaacgggtattgtcaagactctcacccagcactgtccaacagaattataatgtgggccacacagggaattttacatttcctagtagtcaccttttaaaagtaaaaagaaacagttgaaattaattttaataatatatgtttctgtaattcatcatatccaaaatgttatttcaatatgtattctatgtaaaaaatta

SEQ ID NO: 497 - DNA, 4504 bp, Homo sapiens
tagtttgctcttctctttctaatttcttgggagtagaagcttaaaatattagacctttcaggccaggcgcagtggctcacagctgtaatcccaaaaatttgggaagctgaggcaggtggatcacctgaggtcaggagttcaagaccagcctggacaacatggagaaaccctgtcactactaaaatacaaaaattagccagatgtggtggcaggtgcctgtaattccagctactcaggaggctgagacaggagaatcacttgaacctgggaggcagaggttgcagtaagccgagattgcaccattgcactccagcctgagcaacagagcaagactccatctcaaaaaaaaaaaaaaaaaaaaaatcctcaaaatcatggtgaatttttgccagttttgaactttatgcacacagaattacataaaatgagttcaggtacatctggcttctatcattccacgtgatgtttgtgtgattaactcatattgtgtacatggttgtggttcattaatcctgattgtcatagactattcctctggataaataaactacaatctattcatccattctactgttgatgggcatttggttaaattttagtttggggctgtaatgaatagggcagctatgggcatttggtacatgtcttttgtgattatatgtgtggctttctgtaggtaaatacccaatggtagaattgctgggttataaagtatttcctagatattaactatcttttgccaaagtgcatgcaccaatttacacttccaataactctaagattttgctttttttttttttttttgacacagagtctcaccctgttgcccaggctggagtgcagtggtgcgatcttggctcactgcaagctctgcctccccggtccatgccattctcctgcctcagcctcccaagtagctgggactacaggcacccgccaccacacccggctaattttttgtatttttagcagagaccgggtttcatagtgttagtcaggatggtctcaatctcctgacctcgtgatccgcccgcctcggcttcccaaagtgctgggattacaggcgtgagccaccactcccagccacctttttttttagagaaagtttcactctgtcacccaggctggagtgcaatgacacgatcttggctcactgaaacctctgcctcccgggttcaagcgattctcctgcctcaacctcctgagtagctgggactacaggcgcccgccaccacacccagctaatttttgtatttttggtagagacggagtttcaccttgttgaccaggctggtctcgaactcctgacctcaagtgatccacccacctcagcctcccaaaatgctgggattagaggcgtgagccaccacgcccgactaatttttgtatttttagtagagatgggtatgagccactgcacctggcctatttgtttatttatttatcttgaggagtctcacttcttcgcccaggctagagtgcagtggcatcatctcggctcactgctacctttgcctcccaggttcaaacgatcattgtgcctcagcctcccaagtagctgggactacaggcatgcgccaccacacccggctaattttttgaattttaagtagagacgaggtttcgctatgtaggccaggctggtcttgaactccagacctcaaacgatccgcccgcctcggcctcccaaagtgctggaataacaggcatgagccactgcacccggcctcctcggaatttttaaacagggaccctgtgttttcattttgctccgggtcctatggattctgcggggggtgctggagctgcctgcccagctgaacaggctagggctgttgtcaggacctaggaaggactggccagccgtcagggcaagctgcctcaggcaagacgctcaccctctgtgcctcggttttccttttaggatgggcagggggctaggggcaggcaaggagctgtctggggcgactcctgctggccactgggggcactatatgcacctgcgatatccatgccgggcccagctccccccagcactcaacgccccttagctgactcacccacctctgcttctgccatctgatccacacctatcattgccacctgcaccagccttgtcccctggctcccgccctcacccgtctgtcctcccagcagcagccaccagaggccgcctgtgagcacctgtcaggtcctgtctctgctctgcctgcgtccctccagggctcccacctccctctgagggtaaaagaccaaccctccctgccctccccccctccctccgctccaaccacacgggcctcctcgctgctcctccaacacatcaggcatggtcctgccccaggacctttgcacaagctgtgcctctgcctggctcaccctcaggccacagcatggctccttcccttcctgtctcccaggatgctactcacgcaccactttatcaggcttttcctgtacagcccaccaggaacagcccaccagaatcagccaccattggctgggcgctgtggctcacgcctataatcccagcactttgggaggccaaggcgggcggatcaccagaggtcaggagtttgagacaagcctggccaacatggtgaaaccccgtctctactaaaagtacaaaaattagccgggtgtggtggtgggcgcctgtagtcccagctactcgggaggctgagggaggagaatcgcttgaacccaggaggcagaggttgaggtgagctgagaccgcaccactgcactccagcctgggtgacagagctagaccccaactcaaaaaaaaaaaaaaagaaaagaaaagcaacagccaccatctccccatcctgtcccacttccctgctccatttctcttcctaggtgaagtcgtgctggtaagtgccaccttctctgctgcactgtagtatctggggcagcatcgggcacagcaaggggccttaagcctgacggacaggcctatcggactcaatgaaactgaaagaggatgtggggaaatcgcacccttgtgcacagctggcgggatgtgacatggcacagctgctgtggaaaagtcgggcagctccccaaaaaattaaaatagaggccgggcgcggtggtccacgcctgtaatcccagcactttgagaggccgaggtgggaggatcatgaggtcaagatggagaccatcctggccaacatggtgaaaccccatctctactaaaaatacaaaaattagccgggcgtgatggcaggcacctgtagtcccagctactcaggaggctgaggcaggagaattggttgaacccgggaggtggaggctgcagtgagccgagatcgcgccactgcattccagcctggcgacagagcgagactcctcaaggtgcatccaaaaaaagaaagaccagaggacccagcaatgctacctctggatgcacacacacgaggacagacaggagggactcaaacagaagcttgcacacgcaggtgcacagcggcacgactgccaacagccacaaggtggaaaccacccagacgtccatcgatgatagatggatcaacacagcgtggcccatccacacagtggaatattactgaaccacgaaaaggaagggaatccggacatgggcttcagcgtggatgcaccttgaggacatcatgctcagtgagagatgccagagacacagaaggacacaccccgcatggttccactcctaggaggtccatagagctgtcagattcagggagacaaaaggaaaaaataactgaaggaaggctgcagaggtcccacatccgcagcttacagaaacggaggcccggagggcatgatgtccccacaggtgccctggaagaaaaaagcgagccataagtcaaggccagaaaaaggctgcctttgccgttgacaaaagaggccccggcccggactcggcagcgccacccgcccggcagccgcaggctccgtggaaggaaggtcctgccccgtgtctccatcccgtctccctgggcctgggcgctcagaccaggttgtactccttgaggttgagctgcaggatggtgtccttcacggccgcgaacacgaagcggatgttctccgtgtcggtggcacacgtgaagtgtccttcttgttgaggaagaggatgacggaggagttctggaaccaggggacttggtcgtattcgctgagggcgacgagaaacatgatggatgtcacgttctcaaagcagtggatccacttcctccgctccgaccgctggccccccacatccaccatcctgaaaggacacagcgccaggactcagccacctggcgccccaaggcccaatctgcaatcccaggacggctcccacccaagcccctcctgccacaccagactgacatcggctggagcaggaagagcccccactcttagaacgggcaaggacgctctcagagagcggccgcaccgcctccaggggtgaccaccgcagacccttccctcactggcaaaggggcctgagaccactgggcccagggaagcgggcgctagt

SEQ ID NO: 498 - DNA, 825 bp, Homo sapiens
cacgcacagagctgccggccacgtccctctctctgcctctcgggtacacacctgagaatattctgtaaaagtccccacccaccctcgctgtttccaaattggtgacatcacaaagcggaacaaaacagaaacgcccccatccaagtggcctttctcccagtgtcaccgggggaccatccctccagccgcccagcccacgtgggctccggtggggtgcgctctagccagggcagggtggccgtgcagccctctggagtccccgggcagccccaagcagccagtgttggccccggaggcacagcccagagaagcccccgtggctccagcccggggacccttcccagcctctgcagagggacggggaacccggccatgagagagggcccagggtgtttcttcaacctaaaaaagcgagccataagtcaaggccagaaaaaggctgcctttgccgttgacaaaaggtgagaaggtgcgcgaagtgtacggagggagagatgtacatcccctgataactgtgaaataaaaaccatttgttaaaaatatgaaaaaaaaaaatctcctcccgcgggcagaggccccggcccggactcggcagcgccacccgcccggcagccgcaggctccgtggaaggaaggtcctgccccgtgtctccatcccgtctccctgggcctgggcgctcagaccaggttgtactccttgaggttgagctgcaggatggtgtccttcacggccgcgaacacgaagcggatgttctccgtgtcggtggcacacgtgaagtgtccttcttgttgaggaagaggatgacggaggagttctggaaccagg

SEQ ID NO: 499 - DNA, 825 bp, Homo sapiens; identical to SEQ ID NO: 498

SEQ ID NO: 500 - DNA, 825 bp, Homo sapiens; identical to SEQ ID NO: 498

SEQ ID NO: 501 - DNA, 825 bp, Homo sapiens; identical to SEQ ID NO: 498

SEQ ID NO: 502 - DNA, 825 bp, Homo sapiens; identical to SEQ ID NO: 498

SEQ ID NO: 503 - DNA, 825 bp, Homo sapiens; identical to SEQ ID NO: 498

SEQ ID NO: 504 - DNA, 3602 bp, Homo sapiens
taggatcttgctatgttgccctggctgggatgcagcggctattcacaggtgcaatcatagtgcactacagcctcaaactcctagcctcaagcaatcctcatgcctcagcctccagagtagctgggcctacaggtacttaacacctcatctggcatcccccagtcagatatttggatgagacccctgccttggctaacaccttgatgaaaacctgtggaaggttctaaggcaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 505 - DNA, 3029 bp, Homo sapiens
cacgggacacctgcatctgccaacaagactggaagcagaaagggacagagacggcgaagtttgacggtctggaaagcagagaccagcagggctgactgcttgggagctctccaccgaccgaaggaggagaatgctatttatttcagcaccaaatatccggacagcgcctctcgggaggtccgagaagagaaccgcgatctgtttcagcaccggggctcaggacagttcccagcgggctccgtttcgtctccagaaccctggacagctcctccagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctgagaaccgggaatggaaaacagggaggcagcacagaggcaggaaactcaggtgtcatagcttggctcagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 506 - DNA, 3219 bp, Homo sapiens
aaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagtagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctgagaaccgggaatggaaaacagggaggcagcacagaggcaggaaactcaggtgtcatagcttggctcagcctcagggcttttgcctctgctgttcctgcagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 507 - DNA, 2963 bp, Homo sapiens
aaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcacgagggacagctctccaccgaccgaaggaggagaatgctatttatttcagcaccaaatatccggacagcgcctctcgggaggtccgagaagagaaccgcgatctgtttcagcaccggggctcaggacagttcccagcgggctccgtttcgtctccagaaccctggacagctcctccagcctcagggcttttgcctctgctgttcctgcagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 508 - DNA, 2698 bp, Homo sapiens
cctgcatctgccaacaagactggaagcagaaagggacagagacggcgaagtttgacggtctggaaagcagagaccagcagggctgactgcttgggaggaggagaatgctatttatttcagcaccaaatatccggacagcgcctctcgggaggtccgagaagagaaccgcgatctgtttcagcaccggggctcaggacagttcccagcgggctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 509 - DNA, 3067 bp, Homo sapiens
cctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggaggtaagttctggggacatggtacagggtgaggagcaggtatcagtgctagttgcgacccctctgtgtctcccccccgccaccccattgccattctgaagctccccaggaagaagctaggaggggaaataaattgagtgggggtggggtttcccaagaatcggaggaaccgagaacgaagaggggtgggggaacggggaaagagagaggaaaatcaagttttcttcagcacgagggacagctctccaccgaccgaaggaggagaatgctatttatttcagcaccaaatatccggacagcgcctctcgggaggtccgagaagagaaccgcgatctgtttcagcaccggggctcaggacagttcccagcgggctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 510 - DNA, 2737 bp, Homo sapiens
cgggacacctgcatctgccaacaagactggaagcaggtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 511 - DNA, 3021 bp, Homo sapiens
cacgggacacctgcatctgccaacaagactggaagcagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctgagaaccgggaatggaaaacagggaggcagcacagaggcaggaaactcaggtgtcatagcttggctcagcctcagggcttttgcctctgctgttcctgcagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 512 - DNA, 2895 bp, Homo sapiens
cgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagacttcggtgagaaaccttgtgccaagcattttacatacatcatatcatgccatcttcaaccctaggacatgggtgttactgtgcccatgtgacatttggggaacccaaggccctgagaaaggcagaaaaataacccacgcagggactctcagcccacaagtgaagctcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 513 - DNA, 3596 bp, Homo sapiens
tattcacaggtgcaatcatagtgcactacagcctcaaactcctagcctcaagcaatcctcatgcctcagcctccagagtagctgggcctacaggtacttaacacctcatctggcatcccccagtcagatatttggatgagacccctgccttggctaacaccttgatgaaaacctgtggaaggttctaaggcaggaccctcagcgcagccacttctccaggcactcggcagagagaacgcgcgtaggcgttgccctggcaacgccgggatgcccagcaacaagtccgcggcgtgtatcacgtgctcggcgcggaccaatccgagggcccgccgggaagcaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagacttcggtgagaaaccttgtgccaagcattttacatacatcatatcatgccatcttcaaccctaggacatgggtgttactgtgcccatgtgacatttggggaacccaaggccctgagaaaggcagaaaaataacccacgcagggactctcagcccacaagtgaagctgagaaccgggaatggaaaacagggaggcagcacagaggcaggaaactcaggtgtcatagcttggctcagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 514 - DNA, 3598 bp, Homo sapiens
tattcacaggtgcaatcatagtgcactacagcctcaaactcctagcctcaagcaatcctcatgcctcagcctccagagtagctgggcctacaggtacttaacacctcatctggcatcccccagtcagatatttggatgagacccctgccttggctaacaccttgatgaaaacctgtggaaggttctaaggcaggaccctcagcgcagccacttctccaggcactcggcagagagaacgcgcgtaggcgttgccctggcaacgccgggatgcccagcaacaagtccgcggcgtgtatcacgtgctcggcgcggaccaatccgagggcccgccgggaagcaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctgagaaccgggaatggaaaacagggaggcagcacagaggcaggaaactcaggtgtcatagcttggctcagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 515 - DNA, 3581 bp, Homo sapiens
tattcacaggtgcaatcatagtgcactacagcctcaaactcctagcctcaagcaatcctcatgcctcagcctccagagtagctgggcctacaggtacttaacacctcatctggcatcccccagtcagatatttggatgagacccctgccttggctaacaccttgatgaaaacctgtggaaggttctaaggcaggaccctcagcgcagccacttctccaggcactcggcagagagaacgcgcgtaggcgttgccctggcaacgccgggatgcccagcaacaagtccgcggcgtgtatcacgtgctcggcgcggaccaatccgagggcccgccgggaagcaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcacgagggacagctctccaccgaccgaaggaggagaatgctatttatttcagcaccaaatatccggacagcgcctctcgggaggtccgagaagagaaccgcgatctgtttcagcaccggggctcaggacagttcccagcgggctccgtttcgtctccagaaccctggacagctcctccagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 516 - DNA, 8226 bp, Homo sapiens
gctccattgcccaggctggagtgcagtggtgtggtgatggctcaatgcagcgtcaaccttacgggctcaagtgattcttgtacctgggcctcccaagtagctgggaccacaggtgtgagccaccatgcctgcattttttctttttcttttgaggcaggggtctcactctgtcacccaggcttgagtgcagtggcgcagtctcagctcactgcagccttatctcctaggctcaagagatcctcccaactcagcctcccaagtagatgggaacacaggcaggcaccaccatgcccagctagttttttgtatttttaattgagacaggatttcgccctgttgctcagattggtctcctgggctcaagtgatccactcgcttcagcctcccaaagtgctgggattgcaagtgtgagccaccgtgcctaatttttttttttttttgagaattgcttgaacccgggaggtggaggttgcagtgagccgagatcgcaccactgcactccagcttaggcaacagagtgagaccctgtttcaaaaaaaaaaaaaaaaaaagaatcctgtggagcaccattataaagatgtttgtggccgggtattgtggctcacgcctgtaatcccaacactttgggaggccgaggtgggcagatcacttgaggtcaggagttcaagaccaccctggccaacatggtgaaaccccgtctctactaaaaatacaaaacaattatctgtgcatggtggcgggaacctgtaatcccagctactcaggaggctgaggcaggagaatcacttgaacccaggaggcggaggctgcagtgagccaagatcacgtcacttgcactccagcctgggagacacagcgggactctgtctcaaaaaataaataagtaggccgggcgcggtggctcacgcctgtaatcccagcactttgggaggctgaggcaggcagatcacgaggtcaggagatcgagaccatcctggctaacacggtgaaaccccatctctactaaaaatacaaaaaaattagccaggcgtggtggtgggcacctatagtcccagctactcgggaggctgaggcaggagaatggtgtgaactcaggaggtggagcttgcagtgagccaagatcgtgccacaaagcactccagcctgggtgacaaagtgagactccgtctcaaaaaataaatacataaataaataaataaacaaacacataagtaaataaaagtaaagacggtcaagacccttttcaggatgggaaaactgaggccagataggctaagttagtggcccaatcacacacacggcatgtaaggaagaggtgggggcaggaaacagatgcaatgtggggttgaaggcaggacagagcagcagaaagataaggagggaagctgctggctgggtgtggcatggcagggcctgctcaccagagaggctcttggcgcagttcttgtccctgcggaggtcgtgatcctggtcccaatcccgcagctgcacggccaggcggctgttgcggtcccccgtgatgctatgcaccttctccagacccagccagaactcgcctggagtgggagaggccactccatgaggcagggccacttctgagggtccctcttcctcccctgcctctgtccccactagaaacacctaccgtggggatccccaaaccccgccttgtaggcttcccagggccggttgaagtccactgagccatcgtggcgcctctgaattactgtccagcctccatctgcccagaaaggtacaaggtcaccaggaagtccctcttcacagacgaccccactccctcatctggctgccaagcaccaaaccccctccaaacccaggaagacagcagctccctcactcatccctggaggactcgaggagggtgggtcagagggaggaatattatgggctggccttgggaagatctttgtcccaagaacccagcagggactgagtgtgggagggagtaggcagtggaaatctgcaaagcctctctgggccagctgaactgggtaaaaccccgtgttgtaacctcttgtaatggaaaggacttctcagtggaaaaaaaagctttctttttttttttttttttttttagagatggagtctcactctgttgcccaggctggatcgcagtgccgcaatctcagctcactgcaacctctgccttcggggctcaagcgattcttgtgcttcagccccacaagcagctggaatcacaggcacgcccggctaatgtttatgttggtagagatagggtttcaccatgttggccaggctggtcttgaacttctgacctcaagtgatttgcccgcctcagcctcccaaagtgctggcatttcaggtgtaagccaccgtgctcagcctttgtttttttttagaaacgaggttttgttgtgttgcccaggttggagtgcggtggctattcacaggtgtgatcacggctcacggcagcctttaactcctgggctgaagtgaccctcctgccttggcctcccgagtagctgggactacaggcatgtgccaccatgcccagcaagggctgaattttattttattttattttattttctcttttttatttttttgatggggggacggagtctcgctctgtcgcccaggctggagtgcggtggcgtcatctcagctcactgcaacctctgcctcccaggttcaagagattctcctgcctcagccacctgagtagctgggattacaggtgcacaccaccatgcccggctaatttttgtatttttagtagagacggggtttcaccatgttggtcaggctggtctcgaactcctgacctcgtgatctgtctgcctcaacctcccaaagtgctgggattacaggtgtgagccactgcacttggcctttttttttacttttacaaaattttttgtaaagatgagctctcactatgttgtccaggctggtctcgaacttctgggctcaagtgatcctcatgataggcctcccaaagtgtcgggattacagatatgagccactacacccagacaagggctgcattttaaagaaaagaggccaggagcagtggctaatgcctataatcccagcattttgggaggccaaagtcggcaaatcatttgaggtcaggagtttgagaccagccagaccaacatggtgaaacccagtctctactaaaaatacaaaaattagctgggtgtggttgctcgcacctgtagtctcagctactggggaggctgacgctggagaattgcttgaacccgggaggcggaggtttcagtgagctgagatcgtggcattgcactccagctccaagagcaaaactccatctcaaaaaaaaaaaaaaaaaaaaagaccagcttgggcaacatagcaagaccctgcctttaatttttttgttttgttttgttttcaatttaaagaaagacaacagggcctatggggagaggggcccctggtggactaacacaccctacctgaggtcatcttgcagttcaccaaaaatggcggagacccctgaggctggatttcaaatagtccactctgcctctccccaacctggaacagctcctggcaatccctgggcagccctgaagggagataaagtggagacttgaaacaggagggcagcccctggggggggtctcaggagccaggcatatctgggggcttaacagtggatgaccagggaagtaaaaggcaaatcttatctcatgaccacctctctgccatctgcctaacctcttccatggctccctatgtccttcctcagcatggtccacaaggcacctggaggaccagcccccgtgcccatcctcctcctgccatgctgtacccacaccctctctggcacacaggctttcttcccacccttgtaccacacaccgtcctgccacagggactttgcacatgctgttccccctgcctgggactctctttttttgttttgttttttgatacggagtctcgctctgtcgccaggctggagtgcagtggcgcaatcttggctcactgcaacctccgcctcccaggttcaagcaattctgccgcagcctccggagcagctgggactacaggcatgtgccaccacgcccgactagtttttgcattatttgtagagacgggggtttcaccatgttggccagactggtctcgatctcctgacctcgtgatccgccagccttggcctcccaaagtgctgggattacaggtgtgaaccactgcgcccggcgggactctctttcctcacttctctctctgggtcccagcttctggaaggacaccctgccttgcctcacccccagaccaggccagaacaccccaaatgggaattgagcaaggacttcccactcctggacactgaggtcatctaatggtctctcctctgactcaatggaggctccatgaggctggggacaaggagcagctctgcccacagcctggcaccagcatccacgcaggccccagcgcatagcagctgctcaataaagacttgaggaatgggccgggcgcagtggttcatgcctgtaatccagcactttgggaggcgggcggatcggtcaggagtttgagaccagcctggtcaacatggccaaaccccatctctagtaaaacatacaaagattagctgggtgtgatggtggacgccagtaatcccagctccttaggaggcagaggcaggagaatcacttgaacccgggaggcagaggttgcagtcagctgaggttgaaccattgcactccaacctgggtgacagagtgagactctgtctcaaaaaaaaaaaagacttgataaatgaataaaaattagctgggcgtggtggcggtaggcgcctataatcccatctacttgagaggctgaggcaggagaatcacttgaacccagtgggaggcagaggttgcagtgagctgagattgcgccactgcactccagcctggacaacagagcgagactccgtctcaaaaagcaaacaaaacagtcttgacaaatgaatgaatgaatgaatgaatgaggcagcaggtccagaacgggaagaactgtgctgagcaggagcatctcagaggctctgcctggggtcccagctcctagagggagaggaggcagggttgaggaaagaaagagggagggaggaggggaggatggcgttgagcacgtctggaggctcagacgctccagactgggaggaaccgcccccagcccagccggaaaagtaggggaaaggtcgaaatgagtctgcacggtgggggtgggggcgggcccagagtgaccaggaagacgctttccggcccctcaggcatctcccctttcccctactttcctcccatccagtaaggatgggcacgcggccaaaccaccagtgtggcttccatgaatgccagctgttcgccttcccagctctgaactttctcctacttggcgggcctgagccaagagtctgggagtcccgaacccacagaacccctgcccccttccaccgcatttcccagccaggacttgtgccttcccccgtcaccctccagaagcccctcatcctgggatggtggctttgggagggtggacaggaccctgaccacgctgagatgctagcctggcggggttgggggcgggcagcacggaggtgggaaggagcgggagcttggggaggagagaaccctcaggtctacagtgctggaagcctgccactgaccctagggtgtgagagggggatccaaactttcacccagttggctgtggacagccacagatgcagggaaggatgaggaccacagagaaaccgtgtggggccgtgaacttagagaaccgcgagtctgcatcggacacacgtggacatgctgtggttcgagatgaacggagatttgggaataaagcacctacaacttgtggtggcagcaaaagcccactttctgcggtggggagggggccggcgggggcggggagggaggaggagaacaagagaggaaggaggaagaggggtcagggacctggagcattggatttgtaagatacaagagtgtttctggtctgggagctgggggttcccagccctaattcccacataccccaagacattgtggagggcccaaatctacaaacactactacctggcaccccctcctccatgacaccctcccctagaaggttctaaccttcaggatggcaccccgaaccccatttctaccttctccagcacccctgcagctcaagtccctcaagacctctttctccacctctgttccaatcagtgatcagcagggcttcagggacagcccactggcttgcagaggagaagggttgggtggcctggctgggccaggtcagggctgaggaaggaggtgctcccatcagctttgacccagagactggtgagccctcagggactccaggccaggacatcttctccttaaggtggacctgacaaggagaggaccagcaatggcaagtggcggggtaggggtggccaccggagagcatcgaggggcagacactcacggtgcaggcggctgacattgtgagccgggtcaactggctgggccatctcgggcagcctctttcttcgggcaggcttggccacctcatggtctaggtgcttgtggtccaggaggccaaactaggatgggacgggaggagggtgtcaggtcctgcctggccccacgtccccagccacacgtccagttctcaccacctccctctcaacctggggtccagctatcagagggaccttttctcccttgatcctagggttacctggctttgcagatgctgaattcgcaggtgctgcttctccaggtgccgctgctgctgggccaccttgtggaagagttgctggatcctgctgttctgagccttgagttgtgtctggggaggggtgaaaaccttggtgaggacccagcttgcctaccccaacctcttaattcatccactcatccatccttccaaatctccatccgctgaggccaggcaagggagtctttcttttttcttttttttcccaatgacggggtctcgttctctcgcccaggctggagtgcagtggtgctgtcacagctcactgcagcctccaactcctggggtcaggcgatcctcctgttttcagcctcctgtgtagctgggactacagtcatgcagctctatgcctggcttattttttattttttcagacagagtctcgctctgtcacccaggttggagtgcagtggcgcaatcttggctcactgcaacctctgcctcccagactcaagtgattcttgtgtctcagcctcccaagtagctgccaccacacctggctaatttttgtatttgtattttattttatttattattattattattttgagatggagtcgagctctgtcgcccaggctggagtgcaatggcatgatcccggctcactgcaacctccgcctcccgggttcaagaggttctcctgcctcagcctccccagtagctgggattacaggcgcccaccaccacacccagctaatttttgtatttttagtagagacggggtttcactgtgttggtcaggctggtcttgaactcctgacctcaggtgatccactggcctcgccctcccaaagtgctgggactacaagcgtgagtcaccgcacctggctttatttttattttatcgctattatttttttgaggagtctcactctgttgcccaggctggagtgcagtgctgcgatctcggctcactgcaacctctgcctcccgggttcaagagattctcctgcctcagcctcccaagtagctgggattacaggcatgcacaccatgccaggctaattttttgtatttttagtagagacgaggtttctccatgttggccaggctagtctcgacagcaggtggaggctccgtgagccactgcgcccggtcgttttttaattttatatttattttattttattttatttattttgtgtgtgtgtgtgtgtgtgtgtagaagagacgggggtctcgctattttgctttaggtggtcttgaattcctggccttgagcgaacctccctcctcggcttcctaaggggggagcccatcccttgacgcagggaagcccagggagccacagttgcgcaccccgcccccacgccccactcctgtccatacccttccaagccaggagagccactaggggcgcggagaaccagccctggggacacgtacctgcaggctgtgaaggacctcagggtccacccggctctcaggggctaacgggaggtcggtggacccctc

SEQ ID NO: 517 - DNA, 8226 bp, Homo sapiens; identical to SEQ ID NO: 516

SEQ ID NO: 518 - DNA, 8226 bp, Homo sapiens; identical to SEQ ID NO: 516

SEQ ID NO: 519 - DNA, 786 bp, Homo sapiens
cacaacacccaagcctcccttctcccagtccagaaggagagcgaaaggttcacgtcccagtccactaagacagcacctgtgggcgcaggtctctgcggaaggcgcccgcgcccccggctcagactcctcggtgccgtccctgcacactgaaggcgatggctccccggggacagagtccctctccgggcctctcagcagcccgggcggcggcttctctccacggttttcgcgggcgcttcccccaggatggaggggggtggcctcgcctcaggtctgcgccctcgggccgacggttcgacgcgcgctctgggctccggcagcgccgctcggggtcctcagaaggccaccacggcccgcacgagcacgttgagcatgctgtccgccgggcggcaagcgggctttgcctcgcacgcgggcggcgccgtcggaggggccgcggggctgcagttcaggaggccggagaagcgcctctgcaggacgcgggccaggttgggaaaggcgccctccgcttgcgccggagggggctgcaggcgatcggcgacttcggatgacgctccctcctcttcttccttttcttccagacgggctttcttgctcgggaccagtccagcgtccccgccgtcgctcagggtcatgatgcgctgtgcctctttctgcacttccatggcgactcgacggcgacagcggcgggggctcccgggagggacagaacaggcagcaggtgcactccggacaacgggctcgctcacgcctctctacacaaaccaacccacgcagtgacactgc

SEQ ID NO: 520 - DNA, 1498 bp, Homo sapiens
aaacttacaacgttttatgatctttacacataaaaactcagactaggttagggtgtggcactcacctctggtacagaatttaagaaggttcaaaaactttggtaatagtaaacaatattttcaagacttaaaaaatattttaatatccaaaataatcaaattgttaaactacatcctgcagaccggcagcataattttgtaaataaagttttagtggaaccagggtgttgaggtcagtaagctcaaggcacaagtgcggggttctagcctcttcaaaattttatttaggccgggcacggtggctcacgcttgtaatcccagcactttcggaggccgcggggcgcggatcacccgaggtcaggagttggagaccagccacgactaacatggtgtctccaataaaaatacaaaaattagccaggatggtctcaatctcctgatcttgtgatccacctgcctcggcctcccaaagtgctgggattacaggtgtgagccactgcgcccggcctgttatccacattttataaatgaggaaaccaaggcacagagaggtgaagtgacttgcccaagatcatacagtgggaaaagtggcggagtcaggatttgaatctgggcagcctggctctaggtgctgggctctagatggaaggccctgtctgagctccctgcactaggaacaagtgtggtcaggggctggacggtcagcttttgggtagccattcaagaaatgtattgaaaaacctagagaggcaggctagggagagctgagttggttacatctggggtccatctagggttccatccctggaagagatggtggtggttagggctgtccggagctcctcaggggcaaagacccccagttctgtgatgatgccaccagtgatgaggtcgtggggggtgacatcgaaggcaggattccaaactccaatccctgcaggggagagaggggaggcaaggaggcaagaatttgcttctgtgaaagttctcaggttgtagtcatctgtttctaccacagtggttcttggagttggggagtccttgagaacctgaggattctcaccccaaaagtacatgcaggcatggacattgtactcaatagtaagtttagactcgccactgcccctagaatgtcagtccccaagaaaaattcaaagtcctatacacatctatgccacttatttttttattttttgtgagatgtagttttgctcttgttgcccaggctggagtgcaatggcacgatcttggttcactgcaacctccacctcccaggtttcaagcaattctcctgcctcagcctcccgagtagctgggattacaggcatgcaccaccatgcccagccagtatttttagtagagacgaggtttttccatgttggtcaggctggtctcaaactcccgacctcaggtgatctgcccgcctcggcctcccaaagtgctgggattacaggcgtgagccaccgcacctggcccatcccacttatttttttagttt

SEQ ID NO: 521 - DNA, 8633 bp, Homo sapiens
tctgtcactcagggcctgaggggcgggacctaaagcattatccaatcagagacgctgggctggaaaccgtccaatcaggcacgcagctggagcgacgaggacggctttccgcttttggcgcggcctttgtctctagctgcagccggcgtttcaggtctcgtcttcactggtctgtgtcctattctcctggaggcccagcctctgtggccctgtgacctgcaggtattgggagatccacagctaaaaccccaggacaccctggaagcatagaaatgttcttcagacaatcagtaaaaacaaacttctccaagctaaaggaggatgttcgaatccatcataaagaagctggaaaccttgaaaaaagattagatgaatggctaactataatagacagtgtagagaagaccttaaatgacctgatagagctgaaaaccatggcccaaaaactacgtgatgaatgcagaagcttgagtatccaatgtgatcaacaggaagaaaaagtatcagtgattgttaaaatgaatgaaatgaagcaagaagagaagtttagagataaaataataaaaagaaatgaacaaagcctccaagaaatatgggactatgtgaaaagaccaaatctacgtctgattggtgtacctgaaagtgatggggagaatagaaccaagttggaaaacactctgcaggatattatccaggagaacttccccaacctagcaaggcaggccgacattcaaattcaggaaatacagagaacgccacaaagatactcttcgagaagagcaactccaagacacataattgtcagattcaccaaagttgaaatgaaggaaaaaatgttaagggcagccagagagaaaggtcgggttacccacaaagggaagcccatcagactaacagtggatctctcggcagaaactctacaagctagaagagagtgggggccaatattcaacattcttaaagaaaagaattttcaacccagaatttcatatccagccaacctaagcttcatcagtgaaggagaaataaaatcctttacggacaaacaaatcctgagagattttgtcaccaccaggcctgccttacaagagctcctgaaggaagcactaaacatggagaggaacaactggtaccagtcactgcaaaaacatgccaaatcgtaaacaccatcaatgttaggaagaaactgcatcaactaacaagtaaaataactagctaacataatgacaggaccaaattcacacataacaatattaaccttaaatgtaaatgggctaaatgctccaattaaaagacacagactggcaaattggataaagggcccagaccctggcaggtgcagtggctcacacctgtaatcccaccactttgtgaggctgaagtgggcagatcacgaggtcaggagatcgagactatcctggctaacacagtgaaaccccatctctagtaaaaatacaaaaaattagccaggcatggtggcaggcacctgtagtcccaggcacttgggaggctgaggcaggagaatggcatgaacctgggaggcagagcttgcagtgagccaagatcatgcctctgtactccagcctgggcaacagagacccatctcaaaaaaaaaaaaagagtcaagacccaccagtgtgctgtattcaggagatccatctcatgtgcagagacacacataggctgaaaataaagggacggaggaaggtctctgaagcaaatggaaaacaaaaaaaaaaagcaggggttgcaatcctagtctctgagaaaaacaagactttaaaccaacaaagatcataaaagacaaagaaggccatgacataatggtaaaggcatcaattcaacaagaagagctaactatactaaatatatatgcacccaatacaggagcacccagattaataaagaaagcccttagagacctacaaagagactaagactcgcacacaatgataatgggagactttaacaccccactgtcaacattagacagatcaatgagacagaaagttaacaaggatatccaggaattgaactcagctctgcaccagccagacctaatagacatctacagaactctccacccaaaatcaacagaatatacattctcagcaccacattgcacttactccaaaattgaccacataattggaagtaaagcactcctcagcaagtgtaaaagaacagaaagtataacaaactatctctcagaccacagtgcaatcaaactagaactcaggattaagaaactcactcaaaactgctcaactacatggaaactgaacaacctgctcctgaatgactactgggtacataatgaaatgaaggcagaaataaagatgttctttgaaaccaatgagaacaaagacagaacataaccagaatctctgggacacatttaaagcagtatgtagagggaaatatatagcactaaatgtccacaagagaaagcaggaaagatctaaaattgacaccctaacatcacaattaaaagaactagagacgcaagagcaaacacattcaaaagctagcagaaggcaagaaaaaactaagatcagagctgattttttttaatgggtttcattgatgttattgcagaggacatgattttttttaatggccatggagtattccatgattatgtgccatattttgttttttactacatcttttattttattttatctttggatgcagggtctcacttattgcccaggctagattaccatggtgtgattttggcttactttagtctcagcctcccaggctcaagcaattctcccttacctcatcttctcaagtagctgggactacacgtgtgcgttactatggctggccactttttctttttgtattttccatgtagacaagattttgctatttttttcaggctggtttcaaacttctaagctcaggcagtccacctgccttggccttccaaagctctaggattgaaggcatgagccaccgcttctgaccataccatattttctttattgatgggcatttaggtcctgtccatgtctttgctactgtgaatagtgctgcaatgaacatgcatagcatgcatatggatgcgtctttataataatttatatttcttttggtatatacccaattatcaggttcctgagtcaaatgataattctgttttcagttctgtgaggaattgccacactgctttttacagttaaactaatttacactcccaccagcagagtataagcattctcttttctctgcaaccttggtagcatctgttattttttgacttttttaaaatagccattctgactgatgtgaagtggtatctcattgtggtttttcttttaatttatttgtttatttttttgagatggagcctggctctgtcacccaggctggagagcagtggcacgatctcagctcattgcaacctccacctcccaggtttaagtgattctcctctatcagcctcctgactagctgggactacaggtgcccaccaccatgccaggctaatttttgtttttttattagagacaaggtttcaccatattggacaggctggtcttgaactcctcaccttgtgatctgcctgcttaagcctcccaatgtgctgggattacaggtgtgagacaccgtgcctggcttctttttaatttctttaatgattaccattgagctttgtttttcatatgcttgttagccacatgtatgtcttcctttgaaaagcatctgttcatgttttttgcccactttttaatgaggtttggttttttcttgtaaacttgtttaagttctcattaattctggatattagacctttgtcagaggcaaagtttgcaaatattttcttttattctgtaggttgtctgcttactctgttgatagtttcctttgctgtgaagaatctctttagtttaaataggtcccatttgtcagcttttgcttttgttgcaattgcttttggtagcttcatcatgaagtgtttgcaggtttctatgtctagaatggtagcttttatgttatcttgcagggtttcttataattttatgttttacatttaagtctttaatttttcttgagttgatttttgtatgtggtgtaattaaggggttcagtttaagtgttctacatattactagttagttattccggcaccatttattaaatagagaattttccccacatttcttttgtcagctttgtcaaaaatctgatggttgcaagagggtggcattatttctgggctctctgttctgttgcattggtcttgtgcacatgaattttttataacatctttctctcttctgcttttccccccataaacattttttttttttttttttggagagggagtttcgctattgccaggctgaagtgcaatggcatgatcttggctcaccacaacctccacctcctgagttgaagcaattctcctgcctcagcctcccatgtagttgagattacaggcatatgctatcatgcccagccaattttgtatttttagtagagacagggtttctccttgctggtcaggctggtctccaactcccaacctcaggtgatctgcttgcctcaacctcccaaagtgctgggattacaggtgttagccaccacacctaggctaacattctttcaagtgcatcctgtttgcaaaacttagattaccaagagttcaaagactttttaaaaagttccaaaaaaatttttcttattctctttttccttaagggatttagattatgtgtagatatttttctctgctttcttgaaatatctgtaaaccatattaacagttaaataaactttgtctttttttttttttttttttttactttagattatcttttctagtacatctgatttattggtttatttctaattttaaaaagtttgtttctctcctttttaggactttttttttttttggatggagtttcagttttgttgcccaggctggagtgcaatggcatgatcttgactcaccaaaacctccacctcccaggttcaagggattctctggcctcagcctcccgagtagttgggattacagtcacgtgccaccatacccaactaattttgtttttttagtagaaacggggtttctccatattcctcaggctggtctcaaattcccaaactcaagtgatctgcccgcctcagcctcccaaagtgctgggattacaggcatgaaccaccatgcctggcccatttttagtcctttaaagtaaacacaaatgtgtttagataaaagctcattttaagagcacacagaagcttagcagaaacataggattaaatttagcaatatggaatgagaaacgctaaaagatactaagtttctttgaaagtaactttattatccaaggtaattatccaacatttgcaggctgaagtacttacacagcaaaaacaaaaagagttcagtgcataaactgaacagtagagtctgtagttgtacttggctttctattgatgacttcagaacaattagcatagttatgtgtagtgtttgcagacactacacataacaatacattcatatacattaaacagttttctttttctttttttttaatttttctttgagacagagtctcactcttgcccaggctggagtgtaggggcgtgttctgctcactgcaaccactgggacccaggctcaagtgatttctcctgcctcagcctcctgagtagctgggattacaggcacaccccaccatgcctggctaagtttttgtatttttagtagagatggggtatcaccgtgttggccagcttgattgtgaactcttgacctcaggtgatccacacacctcagtctcccaaagtgctgggattataggcatgagccataaacagtattttttacaatagtatgaatataaagccacaatacttactttgaatgaatcacttaaatggttattttaatattgttatttacacttttgaaatataaactattttaactgaagtatagttaaactttttaactgccatatacattactactagtttattaaaattatttatacttagatatttaatctaataccccaaaaaatttactaccaaattgttacagtcaatactagtctgacatgtttattactttattcaatagggataattataagtaaacacaattttagtatcttttatttcactcaattggaatgctgctattacaaatgaaataaagacagttgatgtggccacccaaaaaccatgatagctcttcagttaactatgttggaagttctaatatactccacaatgtgaacacagtcagattctatttctgcatcaaaaagtgttgttggaagttgtcagatatatttcaatatagaacccccattcaatgactaggagatgagagagcagcagagatgggaaaaaaagctttataaaattcttctgaaattctgccccctttcttcataatgctcatgtttctcatgctgagagtaattgtgcactttgggtggttagagagaaattgcttttaggggactattttctggctgacttgatcaatcttatatctaaactgagctttttctcaagatcttttttctcaagatctttttaacttttttctctcaaaattatcttgctcagatggagatctgtttttctctccaatactttgggtgtctgtttcagaagccctattagtatcccatggtgtctgaatgaggtaggctgtcacagtgagaacttttgtagatatctctatctggactcatgctggaaattcatccgattttttttccatgtcaccatgataattaaaaacgggctgaaacactggtcacattcccattattgtgaaagtgcaattctactcacaaggcctgcaggctctcctgcagctcaggctttcctctctgatgtgacactagagtgctgctgtgggaaatgtggttcacataaactgagctgtgctcaaggctgtccctcagtggcagatgagagaggtcaagaggacactagcaaccaggaaaaagcaagaaagtgctgtagcccaatgccatggaacacagagccactgctgtaaaatgtaaatagccaaaaggatagaatgcttttcaaccatttttgtagcagagtgaaaacctaccttcagcaagtacctggcttcaagctgctaaactacctcctgttatgaaggtgtgaaaagtttttttgttattgaatataaacaattagcatatacagatggcctcttcaatctccatgtgaatttaggatgaactatgtatgacatggttctggaaattctacttgtggactaattttggtgaccatctttctgtctctgcagtctcttaagcagattgactatgatgcatgtcacataaaacagttttctttctgttctattgtggagtttttctggggctggagaacattcttttgttatttccaaacactgtctataattaccagacatgatataaacacataaggtgccaactggaatttactctagaggggactttccctctcagacttccagtcaactcacacttgtgcaacaaagtgcatgctgtcccctaaatatgcaagcagaactgtgtttctgcctatttggtatctatagtcctctacagtcacttctagagagactaaaccaaatttctaccaacttcacagggcaacaatcaatagttttatctcaatgactcttgtatcttcagaccttaaactgattcagagaccatggggcccacaaacctaatcagagtaacgttttcattgagtacacattcagacatgagaatcttcactttccccttttttctcttggtaaaatgttcacaaatgtgcaggtaacacctgctgctactccagccattcgggccctaaatctgcagctctacattttgtatctaggtcttgagatttgggaaatagaaaatttttatctaaaaatgcaagtccttttggttatcaaactcagacattgaaatgaaagtgcagttacgcctttctcctcctttgaaatatgtattcatctcttgaaactgttcactattgccacaagtagatgtatattaaactgataataccacattggacactgtatctcataccctaaaccataatgatatatgtccaatcaataaccaatgttacttctttaaataaaaatttctgacaactctatcagcccactctctgtccctttgtttttgtcttcacaactcctcttgcaactgctgttaatgaaagtgtagattctaggcaacttcagtctttgctcccaggttataatccttaaacttcacccaaataaactgtctacttacattcatgttgtgtcagcttttttttttttttcatgtaggcttaatacttagaaagtgctagagcagcctctattaggggatctcttctctgattgtactccacttgctgtaacaccaaaggatgcagaaccaggttctgtagcagaaattgctggtgtctgtggcaggggagggcacctgaggacagggaagaagaaacatatttttatctttatggagcagcacattgttcccaaataccttctgctttaagggacagaaatggatggactttttctgtcttttctgccagttgatgtcatgcttgcaggtcttctcccagggtgacag

SEQ ID NO: 522 - DNA, 8633 bp, Homo sapiens; identical to SEQ ID NO: 521

SEQ ID NO: 523 - DNA, 8633 bp, Homo sapiens; identical to SEQ ID NO: 521

SEQ ID NO: 524 - DNA, 27059 bp, Homo sapiens
cggccctccctccctctcttttggggacctcgagggtccaggggcgaggggagccgtgccagcagcctgcctcagtgtgtgttctctgagcacctcgtgaccttgctgggagtgtgtctgatcagccgcttcccttgtgaccaaatatttggtcatggcagcaggagagaattccatcagtggacagctctatttttaaggctctggctttgttttctctttcctgagaggcagtccctgcagcaggcttgagcctctctcactgacagcctgcctcgcataatgttaagcaggcatcggacacttgctggaaggcagggaattgcaatgaaagagcacggaggtgagaagctgtgctccttggggtgaaggcagcttctgtgctcctgggatctactgttaagccagggtgacgccagcttgcatgctaccggagggttctttttctaggaaatccatcctaagatgagaatctcatcagaaacttcccttccaggcctgaagccttccagtagcctctttgtggacatgtcagagctttggtagagtctgaggctcaagttcaaatcctgagcaaggtcttaaatattcctgctcagccggattcaccctttgggatgtgagtactagtggaagagaaaatttggacacacagggagaaaaccacagggaggagatggccatctacaattccagaaaagcagcctcagaagaaaccaatctgcaaacatctttatctgcaactccctgcctcccaaatggagtaaagagacagaaagggaatgaatttccaagaagaccagcgtagaacggaaaaatatcagaggagggagaattgttaaggatttccagtatctcaagtgtggatgctgtcctgagctgacccaaggctctggaaaggacacagaacacatttatgagtcttttcaccctcatttcgttgaagattttattggccgaagaaccctcagtaggcacgaaattcattctcacaagcagagagatgcattatgctccatttattgctcatcctaaattataaacatttccagtgaatgtaaaggaagatatgattgaaaaggactctgtgaagacaggatgtttctgtacagtccttgtatctgctcacctattccaaactttccagagattttaccagaggtttaagatattctcctgagggtttgctgtagagagatttttcttaactaaggagtgcaagtagcaagcaatagcccacccagttggagacaaaaaagaagggtgtcagtgttcccactgttaaaaaacaaaaaaaaatcaccctggacacctctgagaattatacaaggggatgtacacagccctgctttatttgagttcaaaaggaaggtgggttttgaaagaagaacaaggagagtagatctctctggatcttctgatgctcacagcaaagagctcaaggtatctgagtcaactcttgaggcttcttcgaacagagggatgaagagagaatatggcaagcttgccaacagatcccagaagttttaagagaaaagaacagattgctctttgcaaaacaaaccgagctgggtgcatggagccccagtagacagaaagtgaagaaaacatcaacgttctgaagttttagataggtgcaccatcccttatggataccaatctgtgctccccataaacttctgtgcccagggtcaactggccagggacaactggctcaccaggaggcctacatagcctcttcttcaggccctaattacagctctatgcaatagggactctgccatctgacagccaaggaggtggttcggtttctgcacatggttttttccgctgggtcccttgaggtccatggtaacctcttcctcattctctacaggcagatcacactttgtaataagatcagaggcagagaactttgaccagatcacactttataataagatcagaggcaaagaactctgaccagatcacactttataataagatcagaggcagagaactttgacaactatctccttgccctctggccctggggtcagggctactcaaacaacacctgctgtcccaaacccggagaagtgtagattttggcactggtagaggaataacagctattgttgacacttaatcttgtgggcctggaatttcaactatgttttcacaactcggagcctattgctgccacctctgtcagggaagataaatgggcatgaataatagacagatgagtttcccaaaagcccagacaggctgcagggaacacgtaatgagcagacagtgtggttcacgccggggagcccaggtttatccaggcctcatcctcactccctttctctactgataattggacccaacaggaccattccgaatcatttttctctcttcagttattcttcagttctactcaaagggtcagtttagggcataattaaagtcaattactttctgaaaggccatcaggacaactgttagagaaaatgatagcagccccgcacttgctgtaggaattattagcttgtcagcctccaggcttatggagacaaaggatcaaaaagttagagagatccaggtgttcacctatttgttcactaattcttttattgtgagtgtgcatgtgtgtgggtgggtgtgacatttattatgaaccagagggcaggagccagtgacacagtggtgcagagaataatcatattccctgccttcctggggtcatacagcttggtggaggacacagatgtgaattcggtaatcactccaataaatattctcctacagatgaagaaagatgatacgatgtgatggacaacagagacttatatggtggggtctgggctggtctttctgaagctaagactggcaggatgagcaggagtttgccagacaaagaggagtggagttgttttccaaacacatctcagcacaaagtgttgtctttgctgggagctgaaaaaagatagtgtgggcagagaccattaggtgagacgcttgatatgagatacaacctcaacaggtggaagaagatcatgagagatgaagagaggaatatagtacagcagagaggacacagaagctgacgtcagggtgtctcagtttgaaaccagtggccaccctgttcctctcccatgtggtcccatcatgggcctctagggtctgggataagaggttaatgaatatctcataccctaagcaggggtggtccctgcactttagcaaaaagttaaggaactagggaaaagagatggaaataataaagagatgggacaaagactttgaagaccaaagcccctgggctattctcttttttaaatttttttatttaaattttcatttatttttatcaagatagggtctcactatgttgcccaggttggtctcaaacttttggcctaaagcaatcctcccaccttggcctcccaatgtgctgggattacaatgtgagccaccacgtccagcctcctgggatatttctcaatgaaacattggatgccaagattggttttgtgccacatgccaatttcacagaagccagtctatgagccaccagctctactcagcaattacagtttctggaactttggctaaattcctgtagatgcaccactgcttgtggcctgactctttgccacccaagtgcgctcagcctcccctggggagtctgccaggcttgcatggctcccactgcacttgctgtgctgggaccgaaaacagtttttgtgcccctagcttaactccactggattcatagaggctttggcctcctcaatggctgtcctgggacagggaggctggttagcacaattaacacaacctggtcatgcaaggcattgatggtccgtaacatgaactttgaccagtaggagacagagaatggaaaaaagccagcagataaatcatctggccttcctcccctatgacagactgttctgagccacagtgtttcacatgtcttcctggagatgtcccacatgacttgagcaaccagctggagctctggagaaactgtggccatcctggtaacatatgaccttgtatttgctttctctccttcctgctttatttccctatgtcccttactttggttgttgggattgcacctcccaataaagcattagcatgtccgctctgcttggggctctgtttcctgggttaagactctgactcttgaatgctgaggcattgtattgagaaggagttcaggctggactcacacctggtgaacaagagtgctgtggtgcgtgagtgagttcttccacaggtataagaaaagatacttagtacctgccacccctgaactatccttttacggcaaatgtttgcttaaagtcagcagtcccctaaacatacttgagatcacagatgaagcaaaatcagactatctcccaacatagaaaagcacaataggaaagaaatatttggtggtgagaagattatagctataagcaaattaggcaatccatctgtgagacccagcatgcagtatggtagaagttgaaaataaaaacatggataaaattgcttaatggattataataatatgcatgactgtgtgccaggcagtgtactaagactttcttgtttcatcccatttgcttattataacagtactataagacatgcactcttacaaacccttattttacagaggaagaaacaggcccagagaagttgggtaactcatcaaaggtcacagagctaagagtggcagagtcaggcctggagcccaggaagtctggtttcgaatttcatgcttctaacctgagcactgtactgcttggtggagttctctgctagtcctacctttcaggcagaggtgatgcagcaagaaagctgccaccagatgcagccccttgatctcggactgcccagcctctagaactgtgagccaattaaatttttcctttgtaaattacctagtctctggtatcctgttatagcagcataaacaggctaagatagtaagacagtagggaaacaagctccagatgtacttgaagtctcttgttcttattttaggagttgaagagcaattccctccagtttccattagaaatgcttcttcttccatatcaaatattgtgagatagcctgaaacacctttcaacactttactacccttctccaaaattcaacagatatgatttccacggactttactcacaggggcttcagtagaagaggaagaggcttgggtttaattgaaggtggcctgagacatctgtgaggaacagcccttttagagacatatcccctacaaataaagcatcagaattattatcctaatacatgaacatccatggttccttcagcaccatcgtaatgcagagaccatggggagatgcagggagagggctctgcacagcatggccaacttgccgggttgaaaacagacaacctccatggagcagggacttcaattagttaattccccatccccactgtcacttactaacatgggattctgattaaaaattagattctctgcaagaggcttaacttataatttaagaacttttgctgtataaccattgcaaaaacaattacataaagattaattagcaaattcccaaaacagtagtaaacggcaaagtagtttaattaaaaccattatctccaaaatctgaacgttaataacagttgtagctcagggagaaataagaggcacactggcacagagtggggtaaagggagggtgtccttcgacaccagcattcagtcagcccaagtctccacggctgctgtcctgttaattacactccagaactctgtggccaccgcgtcttgagaggccctgggctcctcctatgagcctctgcagctgtagccttgacgaacttgtcattgctggcctgcctccaacaagaggcctttagccctcagaagagagggaggcagcagggggcacgaacaagacttttaagtggggaattcataaaatttggaattgtcagaaaacatctgtaaccatgactcttgtccttcagaagacactgataaatttaacccaacccagaccccttaacacaaactctgaagtaaaagattggcaaaggaagcccatgagaatgaaatgtaacaatagcaactatgtagttagcacacacaccatatgatctcacacattcacaagatcctcatgaagccacatggccttcattctgttattatttacttatttatttatgagacagggtcccactctgttgccccagttggagtcagtggcacaaggcagtgtgcagtgctcagtgcagcctctaactcctggctcaagtgatcctcctaccccagagtcctgaggggctgggactacaagcacatgccactaagctcagctaattttttttcttttttaattttttgtagagatagggtctgactacattgcccaggctggtctcaaactcctagcctcaaatgatcttcctgcctcagcctctcaaagtgctgggattacatgcgtgagccactgcatgctgccatattatttttattcttaagctaaagtcactcacttagcctcgtgcatggggacccttctctttttaactctaaagcccatttgtttacctggataccacacagatgccctttgtggtgcaacatttagcccattgaaggctaattatgtgagtctcacaattgtgtgagtctgtcatgaagtatagcctagacttgacaatgattgatttctccaaagaaccccttcagcagggagatcccaaatcagagagcccttgcccttacccaggacagccaatgtctctgcagctccacacggagcaccagctaccgtggaggggttgacctgggcctggagtccaggacaggctgaggaatgcccttcccccagccctctccctgagtgtcagtccctgagttagacactgtcacaggagagggcttggaagccaccttctgactcaccacacccatcccagccatgccccctcaccctggcaagcacccaggggctgtatgttgatttgtctctcccctaatacaaggccctgacctccaccagcagagccagactgtctgcctgcaagcctggctttttattctgctgcactacagaaattatgcaaatcacagctattagtataacagcttttgcagaattcagaagaaaaaggcaaaaaaaaaaaaaaaaaccacacaatcacaaaatccctatgtttggttaaaagaccatgaatttccccattgtcctcactcactctcttgtcaatatgagatgtatacatctgaagcctgcttttcagtcttatgaacatctataaaagagacatcagtcagcagaaacctctggtactgcgacatgaaagagaatgagggaaaaacccaactctagccaggatggagaagagaggaaaggcaagatgtgggaggcagccccagaaggcccaggcggggtctctagaggaacctaagaagactctggtgtgggacaaagctccaatgtgctctgagcactctcgctgtccttccagagggcctcgttccccttctcattcatctcactcaccacactggaaggctcctgaaggcagaagctgcacacctgtgccccgtcccttccacagtcctgagcaatgagcagtcacagagctggggccgggggagggcatggagaaattgagctcctttgctcaccaacatttcagggagaccgcagtggtcttggtggatgtgaatggactgagttgcttctatcactcaaaatccccgaatgaacaggtggcgcatggacatcagaggattcaataacctgacaatttgcaaagatttcggtggaacagtgacaccagagggaggagggagcacatgattccaggcgctcagaaggaggaagctgcctcaagaggagggactcaggcagcccgaggtggccctgcagggaggacgcaggaggaatgaaggccctgtctccctcgtctctccttctgccctcctcccaagggcccccccgggagctgagggagcagaagcaagaaagccatctgggtcatccctccaggtcacctcccgaggcacagagcaaggcagaaaacttctgggccaggctctggcaggaccacttgcatttactctgtaagatgaagacaatggtcctgggagagcatagctgaccacctggcaccctgggccacatcgccttccagctctcctctcatctgaggtccatgccagctcctgcccctggctctggtgctgtcccacctcggggtcattccactttctgctatggggccctgtctgatttcatgagacacctctaggtctgcactaagacagcccagagttatgggcttatcaacgctggggataggcagtagcagatggtggataaaccaccctgccttccatctttcaggtggagaattctggaagacatcctgtccatgtcttggtgggtcctggtggacttgaacccctgctgtccatggcagcaacttaattcatctgccttccctgtctcactgtccttataccctcactctcatttcctgcagtcaccctcaaataagcaacctgcacccaaggcattttctggggctctcctttttgaggaactcaactaagtcaagtgaaagagccagtaaatggcaatgagacagttgatcaccgagataaaaaactataatgtcagattgctacctcttgccatacatacaaaccatttcttgatagattaaaaagttcagtgtaaaaacccaaagcctaaaatgtttaggagcatatatttatgagcttggagtagggaaggatgttttaaacaagacataaaaactgctaaccactaaaaaattgatcgtgattaagacctcataattaagagcttctgtttatcaaatgataccataaagaaactgaaaagcaagctatgaactagagaaggtatttgcaacactccaataagggatgattatttaatatatcctaataaaaatcaataaggagaaacatttttaaattgtaggtcacagaagaggataaatatattaaaaaactcaaaattagttatcagaaaaatgcaaattaagacccaaagtaaccatcaagaaaggcaataaaatgtggcagttgagagcaaagtcattatgtctggtggagttgagccctggcttaatcccatgggtgccagctatgtgatcttgctggcatcgcttccccactctgtggacaatagctttccatgcattaaacaggaataacagtagttcctgcctccttaggttgctgtgttacatggaagaagacatgcaaagctcttagcatgggtacttcacaaacagtaaacatgcaaactatatttaaaaaccatctccaggtgactcagagattacataatgggtgcttaataggagcacaacagtacaggtttttattttgtgtgatccaaagtactgcacttaaataacatgtgggtgacctccacaggaaggaatgggttctgccagcggtgggtctatgtaccgtactgcagcctcaaacacagacgaatgcgttagctgcatgtgagccctcatgataaaagagatctgaaaataaattgtgtatttaattcagagcgactccagagctgctgttctgggattgcagcagaaatcctggagaaagcctaagatttgggattttagatctttatgcatcacttacatccacacagaaagggcgttccagggactgcgcacccatagagcagtgcaagctggtccaccctgcggaagccaagacctccctgagcaggcagccacgctgaaggggaacagcagctccccgatggcctccaaaggactcaacacggaaagtgaagatatatctatggcctgagacaattctggcaacgatattcatatagacattacgttcctgaacagcaagggaatcctgtgaaaggagggaacagtgaactagagacccagattccagccctctctactctgaggagtctctatgacacctttaaatcagggagaatcatttctagacttcctggggttggatcgaggatccccagaagcaaccaacttgtattcagcatacaccagatgccagacacggtgtgaaattatttgtatacattttctggttcaatccaaagaactgctctatgaacaaagctaccaggacctgcagaggattaggtttaggaagtggtgaagctggtatttgatcaagcctaggtgaagtcgtgtttgagaaacagctctgtgagctgagtacaaccagaggattgtttccaaagttaggcccaagtgggcttccaagagcaggcatcaccactaaaacaaaacagtgacactcaaggcattggaggcagaccccaagcaaacctgcacgtgttggaaaaggcccgaggccaggaggaggaggtgttctctgcagctgctcagcctgttcattctgcaccaggagcagcgcaagctgctaggataccctaatggggcaagcagggcacttactccaggctctgcagcaggaatgcccaccatggggaatgcccactatgcatagccatctggggtctcatccttcaagccacaagcctgctccacctgggccctcaaccccactcttaaggtcggagcaagtattcacgcttaccccccttggaaatgagggagaaaatcgcccatggtgtgtaggggtttgtgtgtctgtgcatgcgtgtgtctgtgcatgcatgtatgtgtgtgcatgggtgtgtttctgcatgtgtgtgtgtgtgtgtgtgtggctttagttgataatggcagtccaggtctgcaagtctctaaggtgcaggcccacatctctctagagaggacagtcagaaccacattaatcgttgcgtcgcaggtactccatgcctcgcgctgttctcagcacctcacataaactaattcacgtacttctcccaataaccctatgaagcaggtgttatttttatcctgctgtggcttatggaaaaatgaaggtgcagagagattttgtatttatccaagattacacaactaacaagtggcagcgtgagatctaagcacgaagagccaggctccagagtgctttacctgagatggagacactctgaacttctgccacctactctcatatgcctgggtgatggaggatacacaggaggctgattttaattgtacttcctgtgaatgcacaattcaccaaaattgtaagaattccatccaatgtgaaaagcacacatttgcaactcactggggtgtgaaatgtcatgaaaataaaatagtgatgctgccctcgggaggttcaggacagaggcgcagtcagggttgcatgagggctccaggaaccctcctgaggactgaaggcacccctggctcccatgccccagacctcgaaagcccagtgttctggctcctgacaaggcaccggggctctggggacaggttctctacttaggaacaggctgaaggctggctccactcatgccactgccaggtacacactctgcttggtgccaggaagatctcataacaggaagccctcctggaggggaaggaggagacgctacagtccaaagacagtgtggagagaacagggggcatggcagagaggggcgaggagaggcgcagaagggctggagcctcggccctgagaagagcttgggaactgcccttgttcctgcgtgcgttcagttggccaactcgctactgaataccactgtgttctgaggcctggggagaaagtggatttaaaaaggcaagcttcctgcttgcatgaagctaacattctagaaaagaagacaggccataggtagaccgtcccgctggcctgtccaccgtcctcatctactcctctctctgaaggtcaaatagggccactctgagtgcagcacaaggggaggggaagagacaggcacccccagatcaccaaagacgagttaaaatgagagaaatgggcacactggaagtccagtccccaccgtatgcaatattcccatggagcaagcaagcatctaaaatataacagtattttttaaatagagaaagaggcaagaatagcaccaggaacacattctgcagagaagtgagccctggtatgtgctatgttgttcaaagaaacattgcagccttacctgacattcttaggtattccctggcttctaggaaaacctgttactggtgagcagacatcagggcacagattgggcctggtgtcacagtcactgtggccagggcttctggctacagtggttaagtgagcccaggaatctgttctggccccatctaaatgatgttattttaatgctagatttccttgaggtaataaaacaaaaacagggaaactgagggaaaggataatagacataaatcactaacctaggagtccaaacccccatttaaaagtaactcagaaggttaaaataaaaaggcagatgtaggggcggtgttgaaatccacaaaatcaaaaactttgctgtgccaaagacagactcaaatccactgattgccagggtctctggagccccagctaaaatgaatgaggaaaggccactacttccaccagggagggcaaatatgcgccccttctagggccagttctcccagagagctgctgggaaccttggactcatcttccctgtgagaaaagaggctgcagtcagctcagtgcccaccaggaggaccgcagagaggacagtgaccaccgctacgggtgtcattctagacctagtcgatgttttggaatctcagagaaaatgaaaatgcccatagacatctacacaggaaaagaaataagaagaaaatgagattttcttattttttaaaaataagaagtttaaaagaaatagaaatctttctgacctcagactcctctgcagtgtcaagtgtcaggaagcagtggagtcctgtccccggaaaactgggaggaagaagtgtagcaagctgcctgtcatgtctgagaggaacagaaagggcagttggagaagtggagaaagttaggtgagaccagcctgtggaaatcatgagaaatgacagagattaaatcagaaactcacacatttggaaagaagaacattaacatgatttagtaagttggagagttgaccctttgaagaacccaataaaatacaaaactttaacaaatctaattaagaaaaaatagaaataaagaaaattggaactaaggaaagagacgtaacatatgctgataaaagtaattataattatgagataatataatgcacagttatatgctaataaattccatcaacatgtaaaaatggaacacttagtgaaaataataaattaggaaaaatagctcaagaggaagtagcaccctagaacggagccatagccatggaagagatgggaaagtgttgttagcacactgccttggaaaatatttggaggtgatgagactttattagtgcatgttgtctggacttcatggaatatataaaatgcatactataaaatttatagcagaatatagaagaaaatgaaaggcaaatccatttactttatgaagaaattctattaaccaaatttggcaaaagtagcatgaaaaatagactcgccagcacttcccaaaatacagtggcagggaggcttttcttaacaataatggcaaaggaagaaatcattaggaacaagatggatacatgtaattaagtttaaatggaaaacctcgtatcagaaaacactgtagtaaaattccaagggaaatggcaaaccgaaaaccatttgtaagaaatacaagaaaggattagttattaacaaattaaaaaaatcctctcacaattacaaaaacactatataaccacaatagacaagtacattgagacaattatacaagcaacataaatgagcaataagcatggaaaacaaaggctcaagctcactagaaaggcaaagaattacaagttaaaatcagggtgtcatgttttagcctattaaattggcaatgatataagggttctctgccatgggcaacaccgtgcactgataatggaaatataaattgatgagacatttttggaaaaggatgtgacaacattttgcaagagttttaaatgggttcagacgccctttgacctggtaattccactgctgggaatctattctaaagaaatggtcaaagataaacagaaaatgcatgttcttccctagcacagctgtgagttcccctaactcagaggccttcctatcctcccatggactcctcctctatccgatctctaaacacttgggacccaggacgtagtacctgggactacttttggccacactcttcctgagggatctattactgtcccatagtttgaaaaagtcatctgcaccttgatgacttctagatatccatatccagtcccaacttctctgagttctagacttgtctatccagcagtctagtagacccaaattctctgagttttagacttgtctatccagcagtctagtagacccaacttctctgagttttagacttgtctatccagcagtctagtagacatcactacttgaatatttaataagcaccccaacgcaacaggttccaaattaaactgctggtcccctcccaagccttcctctcctttcttatctatttcagtaaatggcaccactgtttacacaattgcttagaccaaagacctacaggttataactgagttatctcttgctctgccactttacctccaacccaccagtgaatccacatcatgctcccttcaacatcaattctgaatgcagccacccctcaccaactcttctgtgactgttcacatccgtgacatgcacctgaaacagtgctctaagctcctacctggcctccctgcttccaatccagccggccctccccagtcatgagattctccatctgcagtcagagtaagctgcttaaaaacctgtgactctcaagcttccttcacacttagaataaactctgaattatttactttggccctcaagaccttgattgtgtggtcactgctcactttcctagactcttgctgtctctgctctctctggctctctctaaaccaaccacactgccccaccactgtcctccagtggccaagttcattcttgcctcaggcatctgcacttgcctgcaacaatccacacctagatttaaccagatttcgcctgctctggaaggacgttcctggcccctgggtgaaaatgacttcttccttttgctcctatttccatcaccctctagtccctaaatccatctcacttttcctcataacgctgatcacagcctgaaatgatgtttgctgcatttcctttccgttttctgtctggaatcccctggggatgggatctcatcaaaccccatcatcctcactgctgtctccagcacctgacacggaagagacagcaaatactcgctgaatgagattaacagtggtgaaaactgaaaactgcctgcatgttcaaaaatagtgccatattttttagaaatatagtggaatctccataaacccattaaaatcgtgttttcaaaaaaaagttttaaaaggaaaattttcattgttaaacaaggtaatgtgataaaaagtaagatgcagaatcatatattttggtgatcccaattttgtaaaattatttatctagctaggtatttaaatataaagaaatacactaaaacattaataatgtttggatttgtataatagaataacaggagactttttattttattatttatacttttgaattttgcaaattttattaaaagaaactgacattgatggacattttttctatttttttttattcatttatttttgacaatcattgtgtgtatttagtgggtataatgtgatgttttgatctatgtatacattgtagaaaaattcaatcaagctaattaacatatccatcaccaagttatcatatttttgtgttgaaagtgtaaaaagatctatttttagtaattttgaagtatataatacattcttattaactgtggtctccacacatcaaaatacatcagtaaaacttcctcttgcagtaaactttgcactgtctcatcagtgtctcccatcaccccgcccctcacctgccccacctctggtcaccactgttttgccctctatttctatgcagtcaactttctcagattccacatatgagtgaagccatgcaggatttgcctcctgtgcctggcttatttcatagcataatgtcccccctttccagccacttttatagaaaaaaaacttcatactctgaagtgagagagaaaaatgactcctgcctggctaacagccaggagggaggaaggtgaaggaggcgggtgagccagttctagggctggtccagaaggtggccactcttgaccaagagatagacgggagtgaggcagcgggcctcactggaggagcccgcgccattctcaggagccatcacggggacaggagatgcacacacttctctggtccttgacaaatgaacaagtgaacgcctcaatggtaacatcactattgtagaacctgtgcctggcctttggagatgtcttttcagactgtaaaaagtgaagtagaggttcctcttcaaagagactctcctccccatctgatgaagaacaagtagtaacttctcttagaagcgaaatttatacaagacctgtgctaacattcttaaatatctgccagccataataaagaaatcaatatactttgtgctcttagctcccacaatttagcctaaatatttgccctggcatgcttatactgctccaagcaagcattatgtcatggcctgttcctcttccttatttggaggtatttttacctttctcagcattccacaagttacttcctccttcctttgttctcctctgcctttgcctcttttgaaaagttctaagttgctagccaattgggacaaatacaaaatgtgaggtcccattccaagcaatggaaaccagacacagcagtaaggtggacatgttaggttataaatgaccctgtctcctttgtttggtgtattctcatggcaaaactgctggggagtgtaccctttctgcagaaagtaaaactggccttgctgagataatgaaatttgtgttcaagtgctatttctttgtggcaccggagaacaatcatttgatttttacatataacaaggcttttgcatttctgagatcagatgactccacccggacctggacctgtggctcacgactcagcagatcctgtggccccacccagaggcaaatgcagcacatgcggaccattttccatactcctatgatttcattcttaaccaatcaacagtccccattcctggcccctgcccaccgaactgtccttgaaaaaccttaacccccaagagccttggggagaatgatttgaatgataactccatcttctgcttggctggccttgtatcaggtaaactttttctttactgcgatgttgtggtctcagtgagttgattgatctgtgcagcaggcaggaagaactggtcagggaattacaggagtaacgaattaccattttaatggcaatcctcttctgatccattgacttcaccttatttaaataataataataaaactcacattttaaaacaacgttcatctattaggtgccacacaccccacagggtgctcagacagaccctgtaaagccaccagattttcctttcagaagcccttctcttgcaccaggaagagagctgttcccctttctctttcttttgcctgttaagcctctgctcctaaactcactcctcatgtgtgtctgtgtccttaatctccttggcgtgagacgatgaaccctgggtatttaccccagacaacgacaccacttaaatgtatttttgtaactggtacaacgttgagcaaacagtaggcacttaaccaaggcacactggttatttgataaagcagactaatcaggccacacaaaagccacagtcactatataatatattgctggaggggcctctgatagcttctagatcaggatttatacagtgcctcttccattagatgttatgagggtctatcttaggctgggttcccctagaagcaaacctgaaacaagggtttgcatgccacgtggctgatttgggaggcaattccagaaagcacagaaaggaagtgggaaagtgaaatagagaagagaagacagcccacaccaggaatgttggtgaacaactggggcttagtcccctggggacctctgaagggcagtgtagggcagtgatcctcatacattggcacatgaaggaatcccctgaggggttgttagagtctgtgccccaccccagagtccccgattcagtggtcccaggtgacatggctactgctgggcccaagaccacacttggagaaccacaggctcacactgtacatgacagttgcctctacccatccccaaggaagaagaagtttttttaacttttatttaaggttgagggttacatgtgcccctcaggtacatgtttgtcatataggtttgttacatatgtaaacttgtgtcatggggggttgttgtatgatgtatttcatcacccaggtattaccctagtaccccgatcctctccctcttcccaccctccatccttcattaggccccagtgtgtgtcattctgctctatgtgcccatgtgttctcatcatttagctatcacttataaattagaacatgtggtatttggatttctgttcctggattagtttgaagcttgggtatctaccatccaagtaactttcattgctggtggagggcagccctcaggggcagtggctctctagcactggtggcctgtatctgtatggggggagagaaagtccttgtgcagagaagctggcacttgcagtaaggcaccatgagctcgcctggggagagtcagcatggagccatgtgggaaccccagcagtgtctgttacagcaccctgcctgtgatggttaatcttatgtcaacttgactcggctacaggattcccagttagctaggaaaacattatttctggctgtgtctataagggtgttcccagaaaaggtcagcatttaaatcaagcaactgagtaaagactgtcttcacccacgtaagcaagtattacccaacccattcagcaccagaaggggattaaaaaaaaatgaagaggggggatttgctttctcttcttaagatgggatatccacctgctcctgctcttggacactggagctcctgagtctcgggcctttgattagaacttgtattagtttgttctcacactgctgtaaagaactacctgagactgggtaatttataaagaaaagaggtttaactgactcacagttccatggatatacaggaaacacggcttggaggccacaggaaacttatatcatggtggaaggcaaaggggaagcaagctcatcttaccatggcagagcaagagagagtgcaaaggatgctacacaccttcagacaaccagatcccatgagaactcactccccatcacaagaacagcaaggcaaggggggaatatgctcccatgatccaatcacctctcaccaggtccctcctccaacatggagaattacaattcaacatgagatctgggtgggacacagagccaaaccatatcagaactacaccctagttttcctgggcctccagcttgtaggtggcagactgtgagggctccctaggctccacagtcatgtgaaccagtcccccatgttaaatatctctctcacggccaggcatggtggttcatgctcgtaatccactttgggaggccgaggcaggcagatcacttgaggttaggagttcgagaccagctcggccaacatggtgaaaccccgcctatactaaaaatacacacacacaaaaaaaattagctgagcatggtggtgcacgcctgtagttccagctacttgggaggctgaggcaggagaatcacttgaacccaggaggcggagcttgcagtgagtcgagattgtaccactgcactctagcctggtgatagagtgagactccatctcaaaacaaaacaaaacaaaacaaaaacttcctctctctctctctctcactaggtatatagatagatagatagatagatagatagatagatagatagatggatggatatggatagataatagatagagagatagatacatgctgttcattctgtttttctacagaactctaatactctaccctaaaacaaaacttctgtagtccaagaagcccccattctaatcagaacacacaaaagccacagtcactaaataatataatatgtaatatccctttctggaaagtcacagtattcactcacatagtaagtgttctcagaagttctgaaatgaggagataccttgaactcaatatttcccacatttatttgaccctcttttgggagaaggcagtttggaaattgttgttctagattggggtttggcagatgagtcctgtaggctgaatgtgacctgcagcctctctgtgtgtgtaaactgtggttggaatgcagccatgcccatttgttcctatgctacctatagctgctttcagctgcaacaacagagctgaacacttgtaatagagaatgtgtggccacaaagcccagaacatttacaatctggcccttggcagaatagttctagactaacagacagtgagactgtgacccaaagagggaaggcattttccccaaggtcactgaggagatagtggtaaagttgggacaagagtgcctggttcctgatcctccccttttcctgaagacccttccaccactctcagctctgcctcacagttcctctcctttatctcttggtctctatccttggctcaccaaggtgagtgatgatcattctccagaaagcaatccccgtgcttctgtctaaaggctcccctggaggccactggaccactcacccatcaggtttgtgtgaggagccaggcctgttttaggaaaggggatgattcaggaagcaagacctggatggcatgcttctgttctgggtgcaggctagtggagaatgggagaccaagactctctgtaaaacaaaaaagaatatcgtttgtgctgaatgttttggagacaactgtagcaggacgagccacagacaacacccctcagacactgggttaaagaaggaagtggctttattcagccaggagcattggtagacttgctctcaagaaccgagctccattaagaaagagttcctggcccttttcagggcttacaactctaaggcgtccacgtgacagggtcgtgatagattgagcaagcaggtggtacatgactaggtgggggtggttagcaaggcaagtatttctccacaccattgtctgtgatctatagatagcacaagctctagggtgggggttaatgtttaacctacagtcctggccagtggcaccgatcagtctgttatttttcagtttttacttcctccttttctttggagacaggagacagtaagagaaatggcctctctcctcacaatgacacaagtaagccagaggccggggagtctgttgaggatggctgggaattgatggccatgggagccctttgcaaggagggacacgaagctaagatgcaaatcacagagctaagacactgtgtgaaagccgaaggacaagcatccaggcaggaggaagagcaagttaaatgggtggagagggagcaccctagcaggagaggagggagggagcattgagtcagggagggttgtggcctgaccatcgaaagccttgcggggcatgttcagaaatttggactttctcctcaggaagatggggagctggtgagtgcaagagcaattcccaggaaacagactaaaattctaacacatgtgcaggcttctccatggacaccgatggtcccagaggcctagatcatgcaagaaaaggcacatgcctgcctggggatgctccaagggacgggttaaacattcacacatctacaccttagatgaggcagcatgtgccgtccttaggatgccctacatcccagcgtgcccgggtcagtccccactcgcatatgttgccctgatattgattactcataacaccccctttcactcttaatcgtttcttggtgtgaatgataaattatatggctacctaattataccatttgcgtccacctaatttaagcctcagctcatgaggcccattactattgggtcgatggtttattctaccttgaaatataaattccttgcaattaataaaaactgtcacatgtttatgtcttatttctcctgctgcactgtgtattcccaagggcaagacacgtgtgtttatcagttcattttgataaagagcatgtattagtccattttgtgttgtgttgctatgaaggaacacctgaaactgggtaacgtacaaagaaaagaggtttgtttggcccatggttctgcaggctgtataaacatggtgccagcatctgcttggcttctggggaggcctcaggaagcttttactcatagcagaaggcaaaggaggatcaggagtgccacgtggtgaggagggagcaagagagcgaggaggaggaggtgccaggctcctttcaacaaccagcgctcccatgaactcattaccactgggagcacaccccgccatccatgagggacctgcccccatgacccagacacctcccaccaagctccatcaccaacactgaggatcacatttcaacatgagatttggagggacaaacatctaaatcatatctgagctttcccacatctaacatgaaagtaatacgcaggcttaggcacattactgctcataaatgaggtcattttgtcttcacaacaaaattattggagtatggagagtcatttcccatttatgaactggagaggtaaagtgagtcgccaaggtctcacagccattagctgtcagaatcagaacttaaacctgggtgtgacaggctccatccctaggcatctttctaagccaccaccctgccactgaaggcctggctgacctctctcccagggcagctcctgactgcctaataagacagaggagaatgcacaataacctttcctgtctgagttttgcaaatataaagcgccctgtaactgctgaataacagccgtcagccttggcgggtgatcaggacatagtgaggactgttgacggtgttgagatttttatgactatttcctaatgggtgtcaggtcagatgtaattccctgtaatgtcagagcttatcagtctcgctcgaggcagtcagacatggcccacacagccagggtgttcttggcgcacgttcaaaccatctgagtctcttctcagagggttttctgaacactagcccccagggaggtacacacggaagatgcaggtatccctgggactagttggttgagggagccacagctggggccttcactagcagccttcacctgtagcctcagggagacttgtaaggtactttgtgctctctcgggggcagagccatggtgccaggggaaccccagggactggagagtcctcatgttctttccctccctcctgaggcaggctcagagctgtggctgccaagaccattctcaccctagctcagcctacagccaccggagagaactgggtttcaatactgccaagtgccacttctcagtccctctaggcctcaaactctacccctgtaagcctcggtgacaggggccacctcacagggctgctgtgtagttgaaatgcctgggggcttgcacacagtaggtgctcagactaggggagccatcagcatcctcatcatcacatcctcgccctcttcaggggctggagctctgaaagagcagaaggtgggcatggaggaggtgacctccccccataagctgccttctatgtctctgtcctgggacaccccaaggggcaggggaaccccgagctgagagggtgacacacagaaggctaagttgtctcctgcaaaatgcttccccgggcccagctcttcccctggttttctgcaccctgcaatgagtccacaattaggttaatgagtaaattggattcggaagcctggaaaaatgatatcctggaccaccctgctctaagcaagagctgtttatcaatgccagtggggtacacacatcctccattcaattctctgttcataagttttcattttattttttactttcaattacggaaattttcaaacactccccaaagtagagaaaataatataatgaatcctcatttttaacaattacgtgtttctgtcattcttctctcagctgccccatacacatacatttttaaggcaaattcccaacatcgtgtcatttcactcctaaatacatccttgtggtgccccagccatctttggtgcatggtcggggaggcggggagaggggtgggggaggtggggagaggggtgagggaggcggggagaggggtgggggaattccacttcaaagacatgggtgaccggtcctggaatggaaccagagtccagggcctccagaactgctctttacaaacatcccataatgcacctggagtgcagggagttaggagtagatgtgggaggaatctaccttggaatcttatcttggaatctaacgccagcatggaggacatcacccagccctggaaatatccgggtgtctggagatgcatccacgccaggacccatgagcaagggagagaatgcgaccaactcctgggactctagggcagcagtcttggggaagtgtggcatcctcactgtgagagagagagagctggaggcagccaccagctccccctccctgccctcctctgccaaaggaaggccctgctatttcaacacaagcggcttgcaggaggagcctgttaagaggacggctggtccactgaaaaagcggcagcagcttcagaaaggttaaaatgtgactcccctgcccctgacaaaaaaactgttttcaattcagaaaacaaggtgtctatggccatattaccatggacgtgcctggtgtcatctgatctcagaagctaaacaggctctggattgatcaatacttggatggaagaaaacaaagtgtgcccattttacagataagaaagacaagcctcagagaaataaaaaatttatcagccaccgggtgacagaggcggctctaatccagtgattccttccctccttcctcatcttgtcttcctggttcaaggttagctcccagagctcattcccgggaggaaacagttctgggtgactgattcactgatcagcttggtttgggtttcataaaacgctgtgctggaacactgagtcggtacttctcccaagtttccagttcggagacacgaggagaatgctaaaagctcgaatatgcaaatgaacatttggacagatttcctctagagtttcggcctccaggcaaatgatttattccctgcagaaatgcatttttgtttctgcttaacgggtgaaaaaggagaaaagatttttcgggacaaccaagcttaggaataaaagtctccatgggaaatgtacttttctgaaagcaaatgttggctaaacaaggacagtgttgactaaacacgtgttcccctcacccaaaggaatggagtcagagaatcccccaagctccaaattgtgggggcagatggatcttttagaagttcacggttcgcctttctcctgcccagccccatgccttaagcaaagtgtgggatggtctcgggaggacacccacaaatgtaagtaggaaggtgggaagcagcctctcctctaatatagaaaaacaactgtgacagacagaacaaagcatgtggttcagacacgagaccctgagctagccctggggagggagacagcagctttgcagccgttatcctcaggaagccctgagcgctgagaggcactgttacagaaccgaactggggtccactcgctaggcctacctaggtgcctggaatttcccttcgaggaacgcaggagttttctttattttcatgcttgggaaggctcattaggcccctaagagagggtcccttccccatctcaggactaaaatgcaatgaagatgttgctcagaggcagctggagagggatgggtctgtggaggatgccccgcagagtgaagtcgagatgatgcagccaccagggccggaggggagggacattccactttttaaatcagctttctgaagcatgatctccatataatcacctagaagcgtacagcacaatgatcttgacagatgccagcatccttggaaccactgccaccaccaacgtctcaaaccattccatcaaacccagaacactcctggtgccctgaagcgtctcccttcagtggcagaaccagcagagattcagtggtcacaaggtgagtgaggcggcctgggtctggctcctggccattaattttaaataatttgcatttaactttgaaccaccacacctggccatattggatagtgcaggaggaataaactcactggcacatccttctggggcgtctactgtgtgcccccctccaagcggagtgtgtgggaacagagagcagcatccctgccacagtgggtggcggtctgcttgagagatattttattttcttgaaacaaataaaaaagacaaaaggatgcatggtgtaaacactggtggtcaggctaaaatcaaaaaaccattagtgggcaacacagcacagagtgggctctgcccaggccacatgtgtgcagtgccagggctcggcttcagacccagatgtccacacccagccctgcctattacacaaaggcggacagagctgtgggccagcggctggcaaaaggccttggggcaaccagaactctccatcagggcattgcagcctttaagagaaggtgggaactgctgcatttgccccgccctggatctcagcccaggaaacccactgtcacagaacaacagtcttaggagctttcttatcgagacagtaggaagcttttaaacacatcagtggtgaacgccaggcgggtctctggaactttttcatcttggaaaactgaaactctctactcattgaacactgtacacttgattgagagcaaattgtatgtgtttttgccagcctcttcctgaaggcggacatttgtcttgatctgtattggaattctttatctatgtttaaattttgtatgaga

SEQ ID NO: 525 - DNA, 3077 bp, Homo sapiens
ttggaatctaacgccagcatggaggacatcacccagccctggaaatatccgggtgtctggagatgcatccacgccaggacccatgagcaagggagagaatgcgaccaactcctgggactctagggcagcagtcttggggaagtgtggcatcctcactgtgagagagagagagctggaggcagccaccagctccccctccctgccctcctctgccaaaggaaggccctgctatttcaacacaagcggcttgcaggaggagcctgttaagaggacggctggtccactgaaaaagcggcagcagcttcagaaaggttaaaatgtgactcccctgcccctgacaaaaaaactgttttcaattcagaaaacaaggtgtctatggccatattaccatggacgtgcctggtgtcatctgatctcagaagctaaacaggctctggattgatcaatacttggatggaagaaaacaaagtgtgcccattttacagataagaaagacaagcctcagagaaataaaaaatttatcagccaccgggtgacagaggcggctctaatccagtgattccttccctccttcctcatcttgtcttcctggttcaaggttagctcccagagctcattcccgggaggaaacagttctgggtgactgattcactgatcagcttggtttgggtttcataaaacgctgtgctggaacactgagtcggtacttctcccaagtttccagttcggagacacgaggagaatgctaaaagctcgaatatgcaaatgaacatttggacagatttcctctagagtttcggcctccaggcaaatgatttattccctgcagaaatgcatttttgtttctgcttaacgggtgaaaaaggagaaaagatttttcgggacaaccaagcttaggaataaaagtctccatgggaaatgtacttttctgaaagcaaatgttggctaaacaaggacagtgttgactaaacacgtgttcccctcacccaaaggaatggagtcagagaatcccccaagctccaaattgtgggggcagatggatcttttagaagttcacggttcgcctttctcctgcccagccccatgccttaagcaaagtgtgggatggtctcgggaggacacccacaaatgtaagtaggaaggtgggaagcagcctctcctctaatatagaaaaacaactgtgacagacagaacaaagcatgtggttcagacacgagaccctgagctagccctggggagggagacagcagctttgcagccgttatcctcaggaagccctgagcgctgagaggcactgttacagaaccgaactggggtccactcgctaggcctacctaggtgcctggaatttcccttcgaggaacgcaggagttttctttattttcatgcttgggaaggctcattaggcccctaagagagggtcccttccccatctcaggactaaaatgcaatgaagatgttgctcagggagggacattccactttttaaatcagctttctgaagcatgatctccatataatcacctagaagcgtacagcacaatgatcttgacagatgccagcatccttggaaccactgccaccaccaacgtctcaaaccattccatcaaacccagaacactcctggtgccctgaagcgtctcccttcagtggcagaaccagcagagattcagtggtcacaaggctggtctggaactcctgggtgcaagcgatccttccacctcggcctcccaaagtgctgggattagaggcataagccaccgcgcccagccaggaatggattttctcacagttctcgatggcggaagtctgagatcaaggtcttggcagggctaggtctctctgaggcctttctccccagcttataggtcgccgcctcctctctctgtctttccttgtcttccttgtgtccacagttgtgtccaaattcccctttctcataaggacgtcagtcatgttggattagggccctccctcctgaccttgttttagcttaatctctgcaacttaacccttaacctcagtaaagatcctatttccaaatgtgttcacattctgaggtcctgaggattaggactttgaaaggattaaaacaggctcttctggcatattgacaatttcagctaaagactcttgagaaacagcaggtgcaaaaagatcacagtgacctccatgctgtaccttgagatgaaattccaatgcgaaagatgccctctccaccctagaagggaaagcaacatccttatctttgggagtgaaaagtccaaactgagagcatactgtgagtacctcattagcatcattccattctctgagcttccccgcagacttcagttgcttcttcacagctctgctctttgtcccgtccaatctctgagtaactaactcactgcttctgcaggtcttcatttctgcaggagggctcccatgctacataaatcctgcattacacttttctcctgttagtctatgttatgtccatttaattctcaggcccagccgggaccctaagaggacagaggtggagtttttccacccctacaactttacccaatcacaattcaatcctaacagtgcctttctctggaggggctctgccagcatgaattcctttacgggtggaagcctcacagtccagtctaccagtgaggtccacatgggattggctggagggagctacgaagtcaagcggcgtcaggtacagagaaacaaatcccacatccaagggccaggaggcggtagagcaaaccacgcacagccgggtgacttaagggcaaggaagtcttcctgcaggaggtgaatttggcacaagggatacgtttttaggccctgagtggaggatctgggtttcaaactggacttttgaaaaacacactcttattgtagaagggcctgcgggtttgttttaatcacttctcaaagctacgctaggcattcgcagctcaggatccccagtttagcctaataaaaaaaagtaattacatcatattacagataatttgattgtgtctgagacgataattgagttaaaacgcttattgtaacagacacatcagattggcaaggaggaagctcgg

SEQ ID NO: 526 - DNA, 3077 bp, Homo sapiens; identical to SEQ ID NO: 525

SEQ ID NO: 527 - DNA, 2061 bp, Homo sapiens
aaagtgtgcccattttacagataagaaagacaagcctcagagaaataaaaaatttatcagccaccgggtgacagaggcggctctaatccagtgattccttccctccttcctcatcttgtcttcctggttcaaggttagctcccagagctcattcccgggaggaaacagttctgggtgactgattcactgatcagcttggtttgggtttcataaaacgctgtgctggaacactgagtcggtacttctcccaagtttccagttcggagacacgaggagaatgctaaaagctcgaatatgcaaatgaacatttggacagatttcctctagagtttcggcctccaggcaaatgatttattccctgcagaaatgcatttttgtttctgcttaacgggtgaaaaaggagaaaagatttttcgggacaaccaagcttaggaataaaagtctccatgggaaatgtacttttctgaaagcaaatgttggctaaacaaggacagtgttgactaaacacgtgttcccctcacccaaaggaatggagtcagagaatcccccaagctccaaattgtgggggcagatggatcttttagaagttcacggttcgcctttctcctgcccagccccatgccttaagcaaagtgtgggatggtctcgggaggacacccacaaatgtaagtaggaaggtgggaagcagcctctcctctaatatagaaaaacaactgtgacagacagaacaaagcatgtggttcagacacgagaccctgagctagccctggggagggagacagcagctttgcagccgttatcctcaggaagccctgagcgctgagaggcactgttacagaaccgaactggggtccactcgctaggcctacctaggtgcctggaatttcccttcgaggaacgcaggagttttctttattttcatgcttgggaaggctcattaggcccctaagagagggtcccttccccatctcaggactaaaatgcaatgaagatgttgctcagaggcagctggagagggatgggtctgtggaggatgccccgcagagtgaagtcgagatgatgcagccaccagggccggaggggagggacattccactttttaaatcagctttctgaagcatgatctccatataatcacctagaagcgtacagcacaatgatcttgacagatgccagcatccttggaaccactgccaccaccaacgtctcaaaccattccatcaaacccagaacactcctggtgccctgaagcgtctcccttcagtggcagaaccagcagagattcagtggtcacaaggctggtctggaactcctgggtgcaagcgatccttccacctcggcctcccaaagtgctgggattagaggcataagccaccgcgcccagccaggaatggattttctcacagttctcgatggcggaagtctgagatcaaggtcttggcagggctaggtctctctgaggcctttctccccagcttataggtcgccgcctcctctctctgtctttccttgtcttccttgtgtccacagttgtgtccaaattcccctttctcataaggacgtcagtcatgttggattagggccctccctcctgaccttgttttagcttaatctctgcaacttaacccttaacctcagtaaagatcctatttccaaatgtgttcacattctgaggtcctgaggattaggactttgaaaggattaaaacaggctcttctggcatattgacaatttcagctaaagactcttgagaaacagcaggtgcaaaaagatcacagtgacctccatgctgtaccttgagatgaaattccaatgcgaaagatgccctctccaccctagaagggaaagcaacatccttatctttgggagtgaaaagtccaaactgagagcatacttgcctttctctggaggggctctgccagcatgaattcctttacgggtggaagcctcacagtccagtctaccagtgaggtccacatgggattggctggagggagctacgaagtcaagcggcgtcagactgcagtctccagcctcaccccctgggccacccaccctccc

SEQ ID NO: 528 - DNA, 2061 bp, Homo sapiens; identical to SEQ ID NO: 527

SEQ ID NO: 529 - DNA, 32739 bp, Homo sapiens
caaaatattaaacctggacctgatcaagcatctggactggcttatggatatagagaaaatgtaggggatagatgagcacgggaaatgtctccgtggggcaaaattcacgaaattcagattgttggacactctccaggacaaaaggtctagattcttcaaaaacaacaacatcgaaaaaaaaaaactgccagaaagaaaaaatacagagggagaaggacacagaacacatttatgagtcttttcaccctcatttcgttgaagattttattggccgaagaaccctcagtaggcacgaaattcattctcacaagcagagagatgcattatgctccatttattgctcatcctaaattataaacatttccagtgaatgtaaaggaagatatgattgaaaaggactctgtgaagacaggatgtttctgtacagtccttgtatctgctcacctattccaaactttccagagattttaccagaggtttaagatattctcctgagggtttgctgtagagagatttttcttaactaaggagtgcaagtagcaagcaatagcccacccagttggagacaaaaaagaagggtgtcagtgttcccactgttaaaaaacaaaaaaaaatcaccctggacacctctgagaattatacaaggggatgtacacagccctgctttatttgagttcaaaaggaaggtgggttttgaaagaagaacaaggagagtagatctctctggatcttctgatgctcacagcaaagagctcaaggtatctgagtcaactcttgaggcttcttcgaacagagggatgaagagagaatatggcaagcttgccaacagatcccagaagttttaagagaaaagaacagattgctctttgcaaaacaaaccgagctgggtgcatggagccccagtagacagaaagtgaagaaaacatcaacgttctgaagttttagataggtgcaccatcccttatggataccaatctgtgctccccataaacttctgtgcccagggtcaactggccagggacaactggctcaccaggaggcctacatagcctcttcttcaggccctaattacagctctatgcaatagggactctgccatctgacagccaaggaggtggttcggtttctgcacatggttttttccgctgggtcccttgaggtccatggtaacctcttcctcattctctacaggcagatcacactttgtaataagatcagaggcagagaactttgaccagatcacactttataataagatcagaggcaaagaactctgaccagatcacactttataataagatcagaggcagagaactttgacaactatctccttgccctctggccctggggtcagggctactcaaacaacacctgctgtcccaaacccggagaagtgtagattttggcactggtagaggaataacagctattgttgacacttaatcttgtgggcctggaatttcaactatgttttcacaactcggagcctattgctgccacctctgtcagggaagataaatgggcatgaataatagacagatgagtttcccaaaagcccagacaggctgcagggaacacgtaatgagcagacagtgtggttcacgccggggagcccaggtttatccaggcctcatcctcactccctttctctactgataattggacccaacaggaccattccgaatcatttttctctcttcagttattcttcagttctactcaaagggtcagtttagggcataattaaagtcaattactttctgaaaggccatcaggacaactgttagagaaaatgatagcagccccgcacttgctgtaggaattattagcttgtcagcctccaggcttatggagacaaaggatcaaaaagttagagagatccaggtgttcacctatttgttcactaattcttttattgtgagtgtgcatgtgtgtgggtgggtgtgacatttattatgaaccagagggcaggagccagtgacacagtggtgcagagaataatcatattccctgccttcctggggtcatacagcttggtggaggacacagatgtgaattcggtaatcactccaataaatattctcctacagatgaagaaagatgatacgatgtgatggacaacagagacttatatggtggggtctgggctggtctttctgaagctaagactggcaggatgagcaggagtttgccagacaaagaggagtggagttgttttccaaacacatctcagcacaaagtgttgtctttgctgggagctgaaaaaagatagtgtgggcagagaccattaggtgagacgcttgatatgagatacaacctcaacaggtggaagaagatcatgagagatgaagagaggaatatagtacagcagagaggacacagaagctgacgtcagggtgtctcagtttgaaaccagtggccaccctgttcctctcccatgtggtcccatcatgggcctctagggtctgggataagaggttaatgaatatctcataccctaagcaggggtggtccctgcactttagcaaaaagttaaggaactagggaaaagagatggaaataataaagagatgggacaaagactttgaagaccaaagcccctgggctattctcttttttaaatttttttatttaaattttcatttatttttatcaagatagggtctcactatgttgcccaggttggtctcaaacttttggcctaaagcaatcctcccaccttggcctcccaatgtgctgggattacaatgtgagccaccacgtccagcctcctgggatatttctcaatgaaacattggatgccaagattggttttgtgccacatgccaatttcacagaagccagtctatgagccaccagctctactcagcaattacagtttctggaactttggctaaattcctgtagatgcaccactgcttgtggcctgactctttgccacccaagtgcgctcagcctcccctggggagtctgccaggcttgcatggctcccactgcacttgctgtgctgggaccgaaaacagtttttgtgcccctagcttaactccactggattcatagaggctttggcctcctcaatggctgtcctgggacagggaggctggttagcacaattaacacaacctggtcatgcaaggcattgatggtccgtaacatgaactttgaccagtaggagacagagaatggaaaaaagccagcagataaatcatctggccttcctcccctatgacagactgttctgagccacagtgtttcacatgtcttcctggagatgtcccacatgacttgagcaaccagctggagctctggagaaactgtggccatcctgaggaagaaacaggcccagagaagttgggtaactcatcaaaggtcacagagctaagagtggcagagtcaggcctggagcccaggaagtctggtttcgaatttcatgcttctaacctgagcactgtactgcttggtggagttctctgctagtcctacctttcaggcagaggtgatgcagcaagaaagctgccaccagatgcagccccttgatctcggactgcccagcctctagaactgagttgaagagcaattccctccagtttccattagaaatgcttcttcttccatatcaaatattgtgagatagcctgaaacacctttcaacactttactacccttctccaaaattcaacagatatgatttccacggactttactcacaggggcttcagtagaagaggaagaggcttgggtttaattgaaggtggcctgagacatctgtgaggaacagcccttttagagacatatcccctacaaataaagcatcagaattattatcctaatacatgaacatccatggttccttcagcaccatcgtaatgcagagaccatggggagatgcagggagagggctctgcacagcatggccaacttgccgggttgaaaacagacaacctccatggagcagggacttcaattagttaattccccatccccactgtcacttactaacatgggattctgattaaaaattagattctctgcaagaggcttaacttataatttaagaacttttgctgtataaccattgcaaaaacaattacataaagattaattagcaaattcccaaaacagtagtaaacggcaaagtagtttaattaaaaccattatctccaaaatctgaacgttaataacagttgtagctcagggagaaataagaggcacactggcacagagtggggtaaagggagggtgtccttcgacaccagcattcagtcagcccaagtctccacggctgctgtcctgttaattacactccagaactctgtggccaccgcgtcttgagaggccctgggctcctcctatgagcctctgcagctgtagccttgacgaacttgtcattgctggcctgcctccaacaagaggcctttagccctcagaagagagggaggcagcagggggcacgaacaagacttttaagtggggaattcataaaatttggaattgtcagaaaacatctgtaaccatgactcttgtccttcagaagacactgataaatttaacccaacccagaccccttaacacaaactctgaagtaaaagattggcaaaggaagcccatgagaatgaaatgtaacaatagcaactatgtagttagcacacacaccatatgatctcacacattcacaagatcctcatgaagccacatggccttcattctgttattatttacttatttatttatgagacagggtcccactctgttgccccagttggagtcagtggcacaaggcagtgtgcagtgctcagtgcagcctctaactcctggctcaagtgatcctcctaccccagagtcctgaggggctgggactacaagcacatgccactaagctcagctaattttttttcttttttaattttttgtagagatagggtctgactacattgcccaggctggtctcaaactcctagcctcaaatgatcttcctgcctcagcctctcaaagtgctgggattacatgcgtgagccactgcatgctgccatattatttttattcttaagctaaagtcactcacttagcctcgtgcatggggacccttctctttttaactctaaagcccatttgtttacctggataccacacagatgccctttgtggtgcaacatttagcccattgaaggctaattatgtgagtctcacaattgtgtgagtctgtcatgaagtatagcctagacttgacaatgattgatttctccaaagaaccccttcagcagggagatcccaaatcagagagcccttgcccttacccaggacagccaatgtctctgcagctccacacggagcaccagctaccgtggaggggttgacctgggcctggagtccaggacaggctgaggaatgcccttcccccagccctctccctgagtgtcagtccctgagttagacactgtcacaggagagggcttggaagccaccttctgactcaccacacccatcccagccatgccccctcaccctggcaagcacccaggggctgtatgttgatttgtctctcccctaatacaaggccctgacctccaccagcagagccagactgtctgcctgcaagcctggctttttattctgctgcactacagaaattatgcaaatcacagctattagtataacagcttttgcagaattcagaagaaaaaggcaaaaaaaaaaaaaaaaaccacacaatcacaaaatccctatgtttggttaaaagaccatgaatttccccattgtcctcactcactctcttgtcaatatgagatgtatacatctgaagcctgcttttcagtcttatgaacatctataaaagagacatcagtcagcagaaacctctggtactgcgacatgaaagagaatgagggaaaaacccaactctagccaggatggagaagagaggaaaggcaagatgtgggaggcagccccagaaggcccaggcggggtctctagaggaacctaagaagactctggtgtgggacaaagctccaatgtgctctgagcactctcgctgtccttccagagggcctcgttccccttctcattcatctcactcaccacactggaaggctcctgaaggcagaagctgcacacctgtgccccgtcccttccacagtcctgagcaatgagcagtcacagagctggggccgggggagggcatggagaaattgagctcctttgctcaccaacatttcagggagaccgcagtggtcttggtggatgtgaatggactgagttgcttctatcactcaaaatccccgaatgaacaggtggcgcatggacatcagaggattcaataacctgacaatttgcaaagatttcggtggaacagtgacaccagagggaggagggagcacatgattccaggcgctcagaaggaggaagctgcctcaagaggagggactcaggcagcccgaggtggccctgcagggaggacgcaggaggaatgaaggccctgtctccctcgtctctccttctgccctcctcccaagggcccccccgggagctgagggagcagaagcaagaaagccatctgggtcatccctccaggtcacctcccgaggcacagagcaaggcagaaaacttctgggccaggctctggcaggaccacttgcatttactctgtaagatgaagacaatggtcctgggagagcatagctgaccacctggcaccctgggccacatcgccttccagctctcctctcatctgaggtccatgccagctcctgcccctggctctggtgctgtcccacctcggggtcattccactttctgctatggggccctgtctgatttcatgagacacctctaggtctgcactaagacagcccagagttatgggcttatcaacgctggggataggcagtagcagatggtggataaaccaccctgccttccatctttcaggtggagaattctggaagacatcctgtccatgtcttggtgggtcctggtggacttgaacccctgctgtccatggcagcaacttaattcatctgccttccctgtctcactgtccttataccctcactctcatttcctgcagtcaccctcaaataagcaacctgcacccaaggcattttctggggctctcctttttgaggaactcaactaagtcaagtgaaagagccagtaaatggcaatgagacagttgatcaccgagataaaaaactataatgtcagattgctacctcttgccatacatacaaaccatttcttgatagattaaaaagttcagtgtaaaaacccaaagcctaaaatgtttaggagcatatatttatgagcttggagtagggaaggatgttttaaacaagacataaaaactgctaaccactaaaaaattgatcgtgattaagacctcataattaagagcttctgtttatcaaatgataccataaagaaactgaaaagcaagctatgaactagagaaggtatttgcaacactccaataagggatgattatttaatatatcctaataaaaatcaataaggagaaacatttttaaattgtaggtcacagaagaggataaatatattaaaaaactcaaaattagttatcagaaaaatgcaaattaagacccaaagtaaccatcaagaaaggcaataaaatgtggcagttgagagcaaagtcattatgtctggtggagttgagccctggcttaatcccatgggtgccagctatgtgatcttgctggcatcgcttccccactctgtggacaatagctttccatgcattaaacaggaataacagtagttcctgcctccttaggttgctgtgttacatggaagaagacatgcaaagctcttagcatgggtacttcacaaacagtaaacatgcaaactatatttaaaaaccatctccaggtgactcagagattacataatgggtgcttaataggagcacaacagtacaggtttttattttgtgtgatccaaagtactgcacttaaataacatgtgggtgacctccacaggaaggaatgggttctgccagcggtgggtctatgtaccgtactgcagcctcaaacacagacgaatgcgttagctgcatgtgagccctcatgataaaagagatctgaaaataaattgtgtatttaattcagagcgactccagagctgctgttctgggattgcagcagaaatcctggagaaagcctaagatttgggattttagatctttatgcatcacttacatccacacagaaagggcgttccagggactgcgcacccatagagcagtgcaagctggtccaccctgcggaagccaagacctccctgagcaggcagccacgctgaaggggaacagcagctccccgatggcctccaaaggactcaacacggaaagtgaagatatatctatggcctgagacaattctggcaacgatattcatatagacattacgttcctgaacagcaagggaatcctgtgaaaggagggaacagtgaactagagacccagattccagccctctctactctgaggagtctctatgacacctttaaatcagggagaatcatttctagacttcctggggttggatcgaggatccccagaagcaaccaacttgtattcagcatacaccagatgccagacacggtgtgaaattatttgtatacattttctggttcaatccaaagaactgctctatgaacaaagctaccaggacctgcagaggattaggtttaggaagtggtgaagctggtatttgatcaagcctaggtgaagtcgtgtttgagaaacagctctgtgagctgagtacaaccagaggattgtttccaaagttaggcccaagtgggcttccaagagcaggcatcaccactaaaacaaaacagtgacactcaaggcattggaggcagaccccaagcaaacctgcacgtgttggaaaaggcccgaggccaggaggaggaggtgttctctgcagctgctcagcctgttcattctgcaccaggagcagcgcaagctgctaggataccctaatggggcaagcagggcacttactccaggctctgcagcaggaatgcccaccatggggaatgcccactatgcatagccatctggggtctcatccttcaagccacaagcctgctccacctgggccctcaaccccactcttaaggtcggagcaagtattcacgcttaccccccttggaaatgagggagaaaatcgcccatggtgtgtaggggtttgtgtgtctgtgcatgcgtgtgtctgtgcatgcatgtatgtgtgtgcatgggtgtgtttctgcatgtgtgtgtgtgtgtgtgtgtggctttagttgataatggcagtccaggtctgcaagtctctaaggtgcaggcccacatctctctagagaggacagtcagaaccacattaatcgttgcgtcgcaggtactccatgcctcgcgctgttctcagcacctcacataaactaattcacgtacttctcccaataaccctatgaagcaggtgttatttttatcctgctgtggcttatggaaaaatgaaggtgcagagagattttgtatttatccaagattacacaactaacaagtggcagcgtgagatctaagcacgaagagccaggctccagagtgctttacctgagatggagacactctgaacttctgccacctactctcatatgcctgggtgatggaggatacacaggaggctgattttaattgtacttcctgtgaatgcacaattcaccaaaattgtaagaattccatccaatgtgaaaagcacacatttgcaactcactggggtgtgaaatgtcatgaaaataaaatagtgatgctgccctcgggaggttcaggacagaggcgcagtcagggttgcatgagggctccaggaaccctcctgaggactgaaggcacccctggctcccatgccccagacctcgaaagcccagtgttctggctcctgacaaggcaccggggctctggggacaggttctctacttaggaacaggctgaaggctggctccactcatgccactgccaggtacacactctgcttggtgccaggaagatctcataacaggaagccctcctggaggggaaggaggagacgctacagtccaaagacagtgtggagagaacagggggcatggcagagaggggcgaggagaggcgcagaagggctggagcctcggccctgagaagagcttgggaactgcccttgttcctgcgtgcgttcagttggccaactcgctactgaataccactgtgttctgaggcctggggagaaagtggatttaaaaaggcaagcttcctgcttgcatgaagctaacattctagaaaagaagacaggccataggtagaccgtcccgctggcctgtccaccgtcctcatctactcctctctctgaaggtcaaatagggccactctgagtgcagcacaaggggaggggaagagacaggcacccccagatcaccaaagacgagttaaaatgagagaaatgggcacactggaagtccagtccccaccgtatgcaatattcccatggagcaagcaagcatctaaaatataacagtattttttaaatagagaaagaggcaagaatagcaccaggaacacattctgcagagaagtgagccctggtatgtgctatgttgttcaaagaaacattgcagccttacctgacattcttaggtattccctggcttctaggaaaacctgttactggtgagcagacatcagggcacagattgggcctggtgtcacagtcactgtggccagggcttctggctacagtggttaagtgagcccaggaatctgttctggccccatctaaatgatgttattttaatgctagatttccttgaggtaataaaacaaaaacagggaaactgagggaaaggataatagacataaatcactaacctaggagtccaaacccccatttaaaagtaactcagaaggttaaaataaaaaggcagatgtaggggcggtgttgaaatccacaaaatcaaaaactttgctgtgccaaagacagactcaaatccactgattgccagggtctctggagccccagctaaaatgaatgaggaaaggccactacttccaccagggagggcaaatatgcgccccttctagggccagttctcccagagagctgctgggaaccttggactcatcttccctgtgagaaaagaggctgcagtcagctcagtgcccaccaggaggaccgcagagaggacagtgaccaccgctacgggtgtcattctagacctagtcgatgttttggaatctcagagaaaatgaaaatgcccatagacatctacacaggaaaagaaataagaagaaaatgagattttcttattttttaaaaataagaagtttaaaagaaatagaaatctttctgacctcagactcctctgcagtgtcaagtgtcaggaagcagtggagtcctgtccccggaaaactgggaggaagaagtgtagcaagctgcctgtcatgtctgagaggaacagaaagggcagttggagaagtggagaaagttaggtgagaccagcctgtggaaatcatgagaaatgacagagattaaatcagaaactcacacatttggaaagaagaacattaacatgatttagtaagttggagagttgaccctttgaagaacccaataaaatacaaaactttaacaaatctaattaagaaaaaatagaaataaagaaaattggaactaaggaaagagacgtaacatatgctgataaaagtaattataattatgagataatataatgcacagttatatgctaataaattccatcaacatgtaaaaatggaacacttagtgaaaataataaattaggaaaaatagctcaagaggaagtagcaccctagaacggagccatagccatggaagagatgggaaagtgttgttagcacactgccttggaaaatatttggaggtgatgagactttattagtgcatgttgtctggacttcatggaatatataaaatgcatactataaaatttatagcagaatatagaagaaaatgaaaggcaaatccatttactttatgaagaaattctattaaccaaatttggcaaaagtagcatgaaaaatagactcgccagcacttcccaaaatacagtggcagggaggcttttcttaacaataatggcaaaggaagaaatcattaggaacaagatggatacatgtaattaagtttaaatggaaaacctcgtatcagaaaacactgtagtaaaattccaagggaaatggcaaaccgaaaaccatttgtaagaaatacaagaaaggattagttattaacaaattaaaaaaatcctctcacaattacaaaaacactatataaccacaatagacaagtacattgagacaattatacaagcaacataaatgagcaataagcatggaaaacaaaggctcaagctcactagaaaggcaaagaattacaagttaaaatcagggtgtcatgttttagcctattaaattggcaatgatataagggttctctgccatgggcaacaccgtgcactgataatggaaatataaattgatgagacatttttggaaaaggatgtgacaacattttgcaagagttttaaatgggttcagacgccctttgacctggtaattccactgctgggaatctattctaaagaaatggtcaaagataaacagaaaatgcatgttcttccctagcacagctgtgagttcccctaactcagaggccttcctatcctcccatggactcctcctctatccgatctctaaacacttgggacccaggacgtagtacctgggactacttttggccacactcttcctgagggatctattactgtcccatagtttgaaaaagtcatctgcaccttgatgacttctagatatccatatccagtcccaacttctctgagttctagacttgtctatccagcagtctagtagacccaaattctctgagttttagacttgtctatccagcagtctagtagacccaacttctctgagttttagacttgtctatccagcagtctagtagacatcactacttgaatatttaataagcaccccaacgcaacaggttccaaattaaactgctggtcccctcccaagccttcctctcctttcttatctatttcagtaaatggcaccactgtttacacaattgcttagaccaaagacctacaggttataactgagttatctcttgctctgccactttacctccaacccaccagtgaatccacatcatgctcccttcaacatcaattctgaatgcagccacccctcaccaactcttctgtgactgttcacatccgtgacatgcacctgaaacagtgctctaagctcctacctggcctccctgcttccaatccagccggccctccccagtcatgagattctccatctgcagtcagagtaagctgcttaaaaacctgtgactctcaagcttccttcacacttagaataaactctgaattatttactttggccctcaagaccttgattgtgtggtcactgctcactttcctagactcttgctgtctctgctctctctggctctctctaaaccaaccacactgccccaccactgtcctccagtggccaagttcattcttgcctcaggcatctgcacttgcctgcaacaatccacacctagatttaaccagatttcgcctgctctggaaggacgttcctggcccctgggtgaaaatgacttcttccttttgctcctatttccatcaccctctagtccctaaatccatctcacttttcctcataacgctgatcacagcctgaaatgatgtttgctgcatttcctttccgttttctgtctggaatcccctggggatgggatctcatcaaaccccatcatcctcactgctgtctccagcacctgacacggaagagacagcaaatactcgctgaatgagattaacagtggtgaaaactgaaaactgcctgcatgttcaaaaatagtgccatattttttagaaatatagtggaatctccataaacccattaaaatcgtgttttcaaaaaaaagttttaaaaggaaaattttcattgttaaacaaggtaatgtgataaaaagtaagatgcagaatcatatattttggtgatcccaattttgtaaaattatttatctagctaggtatttaaatataaagaaatacactaaaacattaataatgtttggatttgtataatagaataacaggagactttttattttattatttatacttttgaattttgcaaattttattaaaagaaactgacattgatggacattttttctatttttttttattcatttatttttgacaatcattgtgtgtatttagtgggtataatgtgatgttttgatctatgtatacattgtagaaaaattcaatcaagctaattaacatatccatcaccaagttatcatatttttgtgttgaaagtgtaaaaagatctatttttagtaattttgaagtatataatacattcttattaactgtggtctccacacatcaaaatacatcagtaaaacttcctcttgcagtaaactttgcactgtctcatcagtgtctcccatcaccccgcccctcacctgccccacctctggtcaccactgttttgccctctatttctatgcagtcaactttctcagattccacatatgagtgaagccatgcaggatttgcctcctgtgcctggcttatttcatagcataatgtcccccctttccagccacttttatagaaaaaaaacttcatactctgaagtgagagagaaaaatgactcctgcctggctaacagccaggagggaggaaggtgaaggaggcgggtgagccagttctagggctggtccagaaggtggccactcttgaccaagagatagacgggagtgaggcagcgggcctcactggaggagcccgcgccattctcaggagccatcacggggacaggagatgcacacacttctctggtccttgacaaatgaacaagtgaacgcctcaatggtaacatcactattgtagaacctgtgcctggcctttggagatgtcttttcagactgtaaaaagtgaagtagaggttcctcttcaaagagactctcctccccatctgatgaagaacaagtagtaacttctcttagaagcgaaatttatacaagacctgtgctaacattcttaaatatctgccagccataataaagaaatcaatatactttgtgctcttagctcccacaatttagcctaaatatttgccctggcatgcttatactgctccaagcaagcattatgtcatggcctgttcctcttccttatttggaggtatttttacctttctcagcattccacaagttacttcctccttcctttgttctcctctgcctttgcctcttttgaaaagttctaagttgctagccaattgggacaaatacaaaatgtgaggtcccattccaagcaatggaaaccagacacagcagtaaggtggacatgttaggttataaatgaccctgtctcctttgtttggtgtattctcatggcaaaactgctggggagtgtaccctttctgcagaaagtaaaactggccttgctgagataatgaaatttgtgttcaagtgctatttctttgtggcaccggagaacaatcatttgatttttacatataacaaggcttttgcatttctgagatcagatgactccacccggacctggacctgtggctcacgactcagcagatcctgtggccccacccagaggcaaatgcagcacatgcggaccattttccatactcctatgatttcattcttaaccaatcaacagtccccattcctggcccctgcccaccgaactgtccttgaaaaaccttaacccccaagagccttggggagaatgatttgaatgataactccatcttctgcttggctggccttgtatcaggtaaactttttctttactgcgatgttgtggtctcagtgagttgattgatctgtgcagcaggcaggaagaactggtcagggaattacaggagtaacgaattaccattttaatggcaatcctcttctgatccattgacttcaccttatttaaataataataataaaactcacattttaaaacaacgttcatctattaggtgccacacaccccacagggtgctcagacagaccctgtaaagccaccagattttcctttcagaagcccttctcttgcaccaggaagagagctgttcccctttctctttcttttgcctgttaagcctctgctcctaaactcactcctcatgtgtgtctgtgtccttaatctccttggcgtgagacgatgaaccctgggtatttaccccagacaacgacaccacttaaatgtatttttgtaactggtacaacgttgagcaaacagtaggcacttaaccaaggcacactggttatttgataaagcagactaatcaggccacacaaaagccacagtcactatataatatattgctggaggggcctctgatagcttctagatcaggatttatacagtgcctcttccattagatgttatgagggtctatcttaggctgggttcccctagaagcaaacctgaaacaagggtttgcatgccacgtggctgatttgggaggcaattccagaaagcacagaaaggaagtgggaaagtgaaatagagaagagaagacagcccacaccaggaatgttggtgaacaactggggcttagtcccctggggacctctgaagggcagtgtagggcagtgatcctcatacattggcacatgaaggaatcccctgaggggttgttagagtctgtgccccaccccagagtccccgattcagtggtcccaggtgacatggctactgctgggcccaagaccacacttggagaaccacaggctcacactgtacatgacagttgcctctacccatccccaaggaagaagaagtttttttaacttttatttaaggttgagggttacatgtgcccctcaggtacatgtttgtcatataggtttgttacatatgtaaacttgtgtcatggggggttgttgtatgatgtatttcatcacccaggtattaccctagtaccccgatcctctccctcttcccaccctccatccttcattaggccccagtgtgtgtcattctgctctatgtgcccatgtgttctcatcatttagctatcacttataaattagaacatgtggtatttggatttctgttcctggattagtttgaagcttgggtatctaccatccaagtaactttcattgctggtggagggcagccctcaggggcagtggctctctagcactggtggcctgtatctgtatggggggagagaaagtccttgtgcagagaagctggcacttgcagtaaggcaccatgagctcgcctggggagagtcagcatggagccatgtgggaaccccagcagtgtctgttacagcaccctgcctgtgatggttaatcttatgtcaacttgactcggctacaggattcccagttagctaggaaaacattatttctggctgtgtctataagggtgttcccagaaaaggtcagcatttaaatcaagcaactgagtaaagactgtcttcacccacgtaagcaagtattacccaacccattcagcaccagaaggggattaaaaaaaaatgaagaggggggatttgctttctcttcttaagatgggatatccacctgctcctgctcttggacactggagctcctgagtctcgggcctttgattagaacttgtattagtttgttctcacactgctgtaaagaactacctgagactgggtaatttataaagaaaagaggtttaactgactcacagttccatggatatacaggaaacacggcttggaggccacaggaaacttatatcatggtggaaggcaaaggggaagcaagctcatcttaccatggcagagcaagagagagtgcaaaggatgctacacaccttcagacaaccagatcccatgagaactcactccccatcacaagaacagcaaggcaaggggggaatatgctcccatgatccaatcacctctcaccaggtccctcctccaacatggagaattacaattcaacatgagatctgggtgggacacagagccaaaccatatcagaactacaccctagttttcctgggcctccagcttgtaggtggcagactgtgagggctccctaggctccacagtcatgtgaaccagtcccccatgttaaatatctctctcacggccaggcatggtggttcatgctcgtaatccactttgggaggccgaggcaggcagatcacttgaggttaggagttcgagaccagctcggccaacatggtgaaaccccgcctatactaaaaatacacacacacaaaaaaaattagctgagcatggtggtgcacgcctgtagttccagctacttgggaggctgaggcaggagaatcacttgaacccaggaggcggagcttgcagtgagtcgagattgtaccactgcactctagcctggtgatagagtgagactccatctcaaaacaaaacaaaacaaaacaaaaacttcctctctctctctctctcactaggtatatagatagatagatagatagatagatagatagatagatagatggatggatatggatagataatagatagagagatagatacatgctgttcattctgtttttctacagaactctaatactctaccctaaaacaaaacttctgtagtccaagaagcccccattctaatcagaacacacaaaagccacagtcactaaataatataatatgtaatatccctttctggaaagtcacagtattcactcacatagtaagtgttctcagaagttctgaaatgaggagataccttgaactcaatatttcccacatttatttgaccctcttttgggagaaggcagtttggaaattgttgttctagattggggtttggcagatgagtcctgtaggctgaatgtgacctgcagcctctctgtgtgtgtaaactgtggttggaatgcagccatgcccatttgttcctatgctacctatagctgctttcagctgcaacaacagagctgaacacttgtaatagagaatgtgtggccacaaagcccagaacatttacaatctggcccttggcagaatagttctagactaacagacagtgagactgtgacccaaagagggaaggcattttccccaaggtcactgaggagatagtggtaaagttgggacaagagtgcctggttcctgatcctccccttttcctgaagacccttccaccactctcagctctgcctcacagttcctctcctttatctcttggtctctatccttggctcaccaaggtgagtgatgatcattctccagaaagcaatccccgtgcttctgtctaaaggctcccctggaggccactggaccactcacccatcaggtttgtgtgaggagccaggcctgttttaggaaaggggatgattcaggaagcaagacctggatggcatgcttctgttctgggtgcaggctagtggagaatgggagaccaagactctctgtaaaacaaaaaagaatatcgtttgtgctgaatgttttggagacaactgtagcaggacgagccacagacaacacccctcagacactgggttaaagaaggaagtggctttattcagccaggagcattggtagacttgctctcaagaaccgagctccattaagaaagagttcctggcccttttcagggcttacaactctaaggcgtccacgtgacagggtcgtgatagattgagcaagcaggtggtacatgactaggtgggggtggttagcaaggcaagtatttctccacaccattgtctgtgatctatagatagcacaagctctagggtgggggttaatgtttaacctacagtcctggccagtggcaccgatcagtctgttatttttcagtttttacttcctccttttctttggagacaggagacagtaagagaaatggcctctctcctcacaatgacacaagtaagccagaggccggggagtctgttgaggatggctgggaattgatggccatgggagccctttgcaaggagggacacgaagctaagatgcaaatcacagagctaagacactgtgtgaaagccgaaggacaagcatccaggcaggaggaagagcaagttaaatgggtggagagggagcaccctagcaggagaggagggagggagcattgagtcagggagggttgtggcctgaccatcgaaagccttgcggggcatgttcagaaatttggactttctcctcaggaagatggggagctggtgagtgcaagagcaattcccaggaaacagactaaaattctaacacatgtgcaggcttctccatggacaccgatggtcccagaggcctagatcatgcaagaaaaggcacatgcctgcctggggatgctccaagggacgggttaaacattcacacatctacaccttagatgaggcagcatgtgccgtccttaggatgccctacatcccagcgtgcccgggtcagtccccactcgcatatgttgccctgatattgattactcataacaccccctttcactcttaatcgtttcttggtgtgaatgataaattatatggctacctaattataccatttgcgtccacctaatttaagcctcagctcatgaggcccattactattgggtcgatggtttattctaccttgaaatataaattccttgcaattaataaaaactgtcacatgtttatgtcttatttctcctgctgcactgtgtattcccaagggcaagacacgtgtgtttatcagttcattttgataaagagcatgtattagtccattttgtgttgtgttgctatgaaggaacacctgaaactgggtaacgtacaaagaaaagaggtttgtttggcccatggttctgcaggctgtataaacatggtgccagcatctgcttggcttctggggaggcctcaggaagcttttactcatagcagaaggcaaaggaggatcaggagtgccacgtggtgaggagggagcaagagagcgaggaggaggaggtgccaggctcctttcaacaaccagcgctcccatgaactcattaccactgggagcacaccccgccatccatgagggacctgcccccatgacccagacacctcccaccaagctccatcaccaacactgaggatcacatttcaacatgagatttggagggacaaacatctaaatcatatctgagctttcccacatctaacatgaaagtaatacgcaggcttaggcacattactgctcataaatgaggtcattttgtcttcacaacaaaattattggagtatggagagtcatttcccatttatgaactggagaggtaaagtgagtcgccaaggtctcacagccattagctgtcagaatcagaacttaaacctgggtgtgacaggctccatccctaggcatctttctaagccaccaccctgccactgaaggcctggctgacctctctcccagggcagctcctgactgcctaataagacagaggagaatgcacaataacctttcctgtctgagttttgcaaatataaagcgccctgtaactgctgaataacagccgtcagccttggcgggtgatcaggacatagtgaggactgttgacggtgttgagatttttatgactatttcctaatgggtgtcaggtcagatgtaattccctgtaatgtcagagcttatcagtctcgctcgaggcagtcagacatggcccacacagccagggtgttcttggcgcacgttcaaaccatctgagtctcttctcagagggttttctgaacactagcccccagggaggtacacacggaagatgcaggtatccctgggactagttggttgagggagccacagctggggccttcactagcagccttcacctgtagcctcagggagacttgtaaggtactttgtgctctctcgggggcagagccatggtgccaggggaaccccagggactggagagtcctcatgttctttccctccctcctgaggcaggctcagagctgtggctgccaagaccattctcaccctagctcagcctacagccaccggagagaactgggtttcaatactgccaagtgccacttctcagtccctctaggcctcaaactctacccctgtaagcctcggtgacaggggccacctcacagggctgctgtgtagttgaaatgcctgggggcttgcacacagtaggtgctcagactaggggagccatcagcatcctcatcatcacatcctcgccctcttcaggggctggagctctgaaagagcagaaggtgggcatggaggaggtgacctccccccataagctgccttctatgtctctgtcctgggacaccccaaggggcaggggaaccccgagctgagagggtgacacacagaaggctaagttgtctcctgcaaaatgcttccccgggcccagctcttcccctggttttctgcaccctgcaatgagtccacaattaggttaatgagtaaattggattcggaagcctggaaaaatgatatcctggaccaccctgctctaagcaagagctgtttatcaatgccagtggggtacacacatcctccattcaattctctgttcataagttttcattttattttttactttcaattacggaaattttcaaacactccccaaagtagagaaaataatataatgaatcctcatttttaacaattacgtgtttctgtcattcttctctcagctgccccatacacatacatttttaaggcaaattcccaacatcgtgtcatttcactcctaaatacatccttgtggtgccccagccatctttggtgcatggtcggggaggcggggagaggggtgggggaggtggggagaggggtgagggaggcggggagaggggtgggggaattccacttcaaagacatgggtgaccggtcctggaatggaaccagagtccagggcctccagaactgctctttacaaacatcccataatgcacctggagtgcagggagttaggagtagatgtgggaggaatctaccttggaatcttatcttggaatctaacgccagcatggaggacatcacccagccctggaaatatccgggtgtctggagatgcatccacgccaggacccatgagcaagggagagaatgcgaccaactcctgggactctagggcagcagtcttggggaagtgtggcatcctcactgtgagagagagagagctggaggcagccaccagctccccctccctgccctcctctgccaaaggaaggccctgctatttcaacacaagcggcttgcaggaggagcctgttaagaggacggctggtccactgaaaaagcggcagcagcttcagaaaggttaaaatgtgactcccctgcccctgacaaaaaaactgttttcaattcagaaaacaaggtgtctatggccatattaccatggacgtgcctggtgtcatctgatctcagaagctaaacaggctctggattgatcaatacttggatggaagaaaacaaagtgtgcccattttacagataagaaagacaagcctcagagaaataaaaaatttatcagccaccgggtgacagaggcggctctaatccagtgattccttccctccttcctcatcttgtcttcctggttcaaggttagctcccagagctcattcccgggaggaaacagttctgggtgactgattcactgatcagcttggtttgggtttcataaaacgctgtgctggaacactgagtcggtacttctcccaagtttccagttcggagacacgaggagaatgctaaaagctcgaatatgcaaatgaacatttggacagatttcctctagagtttcggcctccaggcaaatgatttattccctgcagaaatgcatttttgtttctgcttaacgggtgaaaaaggagaaaagatttttcgggacaaccaagcttaggaataaaagtctccatgggaaatgtacttttctgaaagcaaatgttggctaaacaaggacagtgttgactaaacacgtgttcccctcacccaaaggaatggagtcagagaatcccccaagctccaaattgtgggggcagatggatcttttagaagttcacggttcgcctttctcctgcccagccccatgccttaagcaaagtgtgggatggtctcgggaggacacccacaaatgtaagtaggaaggtgggaagcagcctctcctctaatatagaaaaacaactgtgacagacagaacaaagcatgtggttcagacacgagaccctgagctagccctggggagggagacagcagctttgcagccgttatcctcaggaagccctgagcgctgagaggcactgttacagaaccgaactggggtccactcgctaggcctacctaggtgcctggaatttcccttcgaggaacgcaggagttttctttattttcatgcttgggaaggctcattaggcccctaagagagggtcccttccccatctcaggactaaaatgcaatgaagatgttgctcagaggcagctggagagggatgggtctgtggaggatgccccgcagagtgaagtcgagatgatgcagccaccagggccggaggggagggacattccactttttaaatcagctttctgaagcatgatctccatataatcacctagaagcgtacagcacaatgatcttgacagatgccagcatccttggaaccactgccaccaccaacgtctcaaaccattccatcaaacccagaacactcctggtgccctgaagcgtctcccttcagtggcagaaccagcagagattcagtggtcacaaggctggtctggaactcctgggtgcaagcgatccttccacctcggcctcccaaagtgctgggattagaggcataagccaccgcgcccagccaggaatggattttctcacagttctcgatggcggaagtctgagatcaaggtcttggcagggctaggtctctctgaggcctttctccccagcttataggtcgccgcctcctctctctgtctttccttgtcttccttgtgtccacagttgtgtccaaattcccctttctcataaggacgtcagtcatgttggattagggccctccctcctgaccttgttttagcttaatctctgcaacttaacccttaacctcagtaaagatcctatttccaaatgtgttcacattctgaggtcctgaggattaggactttgaaaggattaaaacaggctcttctggcatattgacaatttcagctaaagactcttgagaaacagcaggtgcaaaaagatcacagtgacctccatgctgtaccttgagatgaaattccaatgcgaaagatgccctctccaccctagaagggaaagcaacatccttatctttgggagtgaaaagtccaaactgagagcatactgtgagtacctcattagcatcattccattctctgagcttccccgcagacttcagttgcttcttcacagctctgctctttgtcccgtccaatctctgagtaactaactcactgcttctgcaggtcttcatttctgcaggagggctcccatgctacataaatcctgcattacacttttctcctgttagtctatgttatgtccatttaattctcaggcccagccgggaccctaagaggacagaggtggagtttttccacccctacaactttacccaatcacaattcaatcctaacagtgcctttctctggaggggctctgccagcatgaattcctttacgggtggaagcctcacagtccagtctaccagtgaggtccacatgggattggctggagggagctacgaagtcaagcggcgtcaggtacagagaaacaaatcccacatccaagggccaggaggcggtagagcaaaccacgcacagccgggtgacttaagggcaaggaagtcttcctgcaggaggtgaatttggcacaagggatacgtttttaggccctgagtggaggatctgggtttcaaactggacttttgaaaaacacactcttattgtagaagggcctgcgggtttgttttaatcacttctcaaagctacgctaggcattcgcagctcaggatccccagtttagcctaataaaaaaaagtaattacatcatattacagataatttgattgtgtctgagacgataattgagttaaaacgcttattgtaacagacacatcagattggcaaggaggaagctcggcttaaatacaaacagtgttgagagtggaattaaaggattgccattgcagttaatccaatagtaattattttctgaacataaattcctgagtagtgaggacacaattatatctacaaacagtcataagaaaataattactccacgttccacctgaagcaacagtccataaaagctctggtgccgctctccaggaagccgggctctttccatcagaaactcacggccgatgccagtactgagaaaagggctcccaagcactgcgggactcaccaggcagcttatgacaggctttccaagtgtgattgctctgcccgcgtgacacccaggcccaccgtgtatatgaccaccccaacaggccgacacttaagacaccccagaggatgaacacgcacgtctttcgttcacagactgcagtctccagcctcaccccctgggccacccaccctcccccgctggactgacagccttcccgtaccatccagaggccatggcctactttgtcaaccctcccttgtgaagatcctcatcttcctgccatgcctgcccagccagactctagccctgcatcagccagacccactggtagatgtcggggcgatctcacactcggtcctggagctgcccaggaacctcactgtcctcctgtaatctccctcgctctccttggccacttgctcacctggtgagctttcccctctccaaagcgactccacctcctactccagatcctctccatcccaatccacagagggcatgggataaaggagaagccccagacaggaacttcttcaacttctgcctctggccctcaaagacgcctgcaaacagtgtcacctgtaaagctcttctgcttgggttttgtcctaaggagatgcctgttctcctcctcactcaggctggctcctcacagtctccaatcctgtcccatcctgactcctttgcaagcctcctatgtgggcttcggtgccccccacctcgaaagcttattccctcaactccacgggcacctcagtcaaacttccggaagatctccctccttgctcagggcagcctctttgcaccctagcctctgtctcagcatctgctagcatcgctctcgcagcaggagccgccctgctctgctcaccaagatgctgccagtgtagctgggccggagctctgcaccgcgctggagtcccgctctccccagagccccggccctgctgtgtgctgctcctccgtttctctgcaactccctcctgggcctctgaggttctttcttgtggctgctccataaaacttggtgatggccagtgttccacttctaccccagcctctttgctgccaccttatggtattctccctggtgatcaaatcctccctgaggtttaaaatacactgatgcccccagttctgtatctccaggctgaatctgcatcctgagctcagcttgtctgaatgctgtgcccactgtgttctctcctgcgggcttgctctctagctttctctctctctccctctctctctcaccctctccctctctctctttccttctctctctctccctctctctcttctctctctcctcctctccctctctctcttctctctctttctttctctcccctccttctctctctctctccctctctgtctctcccctctccctctctccctctctccctctcctcctctctttttctgcctcctctttatctctctctccctctcctcctctctctctgtctctccctctttctctccctctctctctccttttctctcttcccccctccctctctctccctctcttccactctctctccttctctctccccctctccctccctctctctcccccctctctccctctctctctccttctctctcttcttctttctctcctcctctccctctctctctgttctctctctttctttctctcccctccttctccctctctctccctctctgtctctcccctctccctctctccctctctctcctcctctctttttctgcctcctcctctttatctccctctctctctcctcctctctctctgtctctccctctttctctccctttctctctctccctctccttctctcttcctctctcttgctgtctctctccctctctctttcactttctatctccctccctctctttcctcctctcttctgtctctccctctttctctccctctctctctctctccctttctctcttccccctctctccttctctttccctctctctctccctctctgtctccttttctttcttcccccctccctctctccccctctccctctttctccctctcttcccttctctctccttctctctctttccttctctctccctctgtttctcctctcctcctccctgtccttctctctcctctctctctcctcttcctctctctctcctcttctctttttctctcccactttctctctctcttcctctttctctctccttctctctctctttccatctctcttcctttctctctctctccctctctctcctcctttctctctctcccctatctctccctttttctctctctctccctctctttccctttctctccctctgtctctcctctccccctctccctctctctctcccctgctcttcttctctctcctcgctctcctcctctttctctctctccccatctctttccctctttctcgcctctccttctctctttctgtccctctctttctccctttctcctcctcttcctctctctccctctcttttcctctctgtctctccttctctctctccctttctttccctctctctctctctctccttctctcactctctctctctctccccccacccccaccaattttcttctgacattttctaatctgaggttgcgttactccatgtgcctggagaagacgatggcaacataggattctgcatgtaaggattttcctaagggaaacagggttggaagaaaatggagggaaagtgggaaaagcctggagaatcatcaaaaggaggtgcaaacctgaccctaaatgaagggaagtgggagggaagcttgggtgggagccacctagaccatggtacagtctagggaacgtccaccaaggctgtaagggaagcctccagccaaaatcaaccagcagagtggtgccttctcccagtctgccagggcttgcctgtcttgggagccctgcctggctcagacatgggctgggagcagctcctgggaagctttggtgtaaacgctgctcagagcacagaagcttggtccagatccctgacgttggagatctgtcaggcgcattcccaggtcacggtagcgaaccagccccactgacacgggatgcttcctgcagggctccctggacacacattcacccccagtgctgaatccaacggattctttctgtactcactgaccatcctccttctccatggagggggttaggctccaggccctaggagagccaggctaagggaagagatgggaaaacatgaaattgtttgaggtagggggacatggagagggtagatgctcattggctgaagctgaggggcaggttaatgcaggaggggcaaggaatggcccccagccgctgtggcctgagggaggctgcttgctaccttgatgcaacttttaatcattatctcattttagagattagtgtatctcacactttgtcatgctgcaagaatgccgtaagctgcagaacttggcaaccagagatttctgggctctatttccagagaagttgcttttctaacaaattcccagtcatgctgatatcgccagcccagagaccacactacccaaataattttggtgagagccactttggactgccatccctagaggtggcttcttcttttctgaggaggacacccagggcccagggacatacgtgtttgccttagggagctcctggccagagccaggccatcctctcatcccaggcagctcagctccgtttgcagtgcctccatctgggggaagaaaagggaagaggtgtcaagcccagtcaaaggcaggagagaccaatgtccatgccggtctcatccctggggcctgttgtggtcacatttagtcctgccgcctactgggggctgctgaagtttgccaagggaagacattctcttgtcattggggtgacactgcaaactctgcctcctgggttcaagcgattctcctgcctcagtctcctgagtagctaggattacaggcatgcgccatcacgtccggctaatttttgtatttttagtagagacaaggtttcatcatcttggccaatctggtcccaaactcctaacctcaggtgatccacctgtctccgcctcccaaagtgctgtgattataggcgtgagccatcatgcctggctgcaaagggcattttgaagctcttgtccctgatcaatccctccatgctgcagatgagggcacaatcaagggcagagaggggagagggaggagcagctcttagtagaaacggttttcttagtgcatcctgtgcaccggtggatatgcacatgagcattttctcttcccgttttgctccaaagcgtgtgagatgtttgtgctatggcaaatacaacacctgtaggagtgtgttatgggttgaactgtgcgcccccagaaagacatgctgaagtcccaactctcaggatctcagctgtgacctcatttggagacagggtgattgagatgtgatgagttgagatgcagtcatcctggagcaaggtggcccccagtccatgctcactggcatctttacaaggagacagccttgggaaggcacagggtggcagggagcatgccatgtgaagacgcaagtggagaggggagtgatgtggccgccagccggggttggactgcctggattgtcaggagctgggagaggccaggaagcacccccctcctgaggctgcagagagtgcatggccaggctgacagcttgaatggtttggacttctggcctccagaactgtgagaggatacatttctgtctattacagaagctctagaaaagtcataacagaaagtgtctgaggaaaggtgcctgggggttcctggaagtgcctggggattcctgagggtgcatgggggtttctgggagtgcctgcggtttcctgggggtgaatggagttcctgggggtgcctggcgcatagcaggcagggacagtgcatgattgttctgctggcagtactgggggctgggctggccaccccaaatgttaccctgggcatctgcttaacagcccaaacagagggaataatagaccctcaaagatggctccgtccctgaggcctagagggctgtgtgagagctgacctcaaggccaaattcttgccccctctctctgttggtccatgagccccaggatcctcttcctggctctacactgaagcctggacttggaagctgccatcctaaggcctgcatttaatcaggagaacctgaggatgtctaagccattagaataaatcacacagatattccttttggggtgtttgcaatcacttcataattaactgacggcttcatagcagccactttcacgtgtgtccaatggtcacataacaacatcgcctactctgtgtctacaccacggcagcgtgggagggctggacgctgagggtgcatcctgccacctctgcagccccggagccctcccccagcaacaggggttcgtgggggcctgggcatcagatgggtgctcagtgcgcctcccctctcacctcatcatgaaacctactgtgggtcctctcgcaacagcagcacccttggtgaccgcctgcggatgggccactgtaccggacattgtgctgacaatgtccacgttgtcctgtggattttacagcaaccctgcagaggggagtctgaggcttggaaaggtgacatgacctgtctgaggacaaggagtcagtgagtggtggggctggggctcagcctcagccgttaggctcccgagccctgctcacaaatcagtgtcctggggagggcagcatggatttggggtttaaccacctctgggctgtctttctgcccagcactaaccctcggtgtccccctgtgggctgcagaggggctagggctggggacaaggtgaactgcccactgtctcttagtgagataaatggaaaatgaataaattccctgaggtaagtggtcaggcaggacttgcaaaaagtgaaatgattcaataatttgatttttaaaattaatgaatgaattaggactctttttgagacagggtctcactctgttgcccaggctagagtgcagtgatgtgaacacagctcactgcagcctcaacctcctaggctcaaggatcccctcaccgtcagcctcctgagtagctggtactacaggcacatgccaccatgcccacctaatcttaaatttatttttaatatatttaagatggggtcttgctgtgttgctcaggttggtctcaaacaccttggctcaatccatcctcccacctcagcctcccaaagtgctgggattacaggtgtgagccacctcacccagccaat

SEQ ID NO: 530 - DNA, 11872 bp, Homo sapiens
cacagatcctcatacctgtaccagattcctacctcttcagatattgaaagacccagatccttatacctgcaccagatcctacctcctcagacatgaacagaaccaaatcctcatactcatgccagatcttacctccagacatgacagacccagatcctcatacctgtaccagatactgcctcctcagacattgacagacccagatcctcatgcttatgccagatcctacctcctcagtcactgacagaaccagattctcataattaataccagatcccacctcctcagacactagaagatccagattctcatacctgtgccaaatgccacctcctcagacacccgaagacccagatcctcacaactgtaccagatcctacctcctcagatactgacagacccagatcctcatacatgtaccaaattcccacctcttcagaaattgacagacccggatcctcataccagggacacatcctacctgctcagacatggacagacccggattctcataccagggccagatcctacctcctcagacattgacagacccagatcctcatacctataagagatcgtacctcctaagtcactggaagacacatctcctcattcctgtaccagatggtaactcctcagactttgacagacgcagatcctcatacctgtaccagattcctacctcctctgatattgacagacccagatcctcattcctgtaccagatggtaactcctcagacatggacagtcctagatcctcataccagggccagatcttacctccttagacatggacagacccagatcctcataccaggacccgatcccacctcctcagatactgatggacacagatcctcatacttgtacccagcctcacttccccagacactagaagactcagggcttcatacctgtgccagatgctatctcctcaggcactggaagcccaagggcctcaaacctgagtccaaactcacctcctcaaacactggaagacgcagatcctcatatctgtgccaggtgctacctcctcagacatggaagacccatatcctcatacctgtgccaggtgctacctactcagacacgggaagacccagatcctcatacctgtgccaggtgctacctcctcagacacaggaagacccagatcctcatacctgtgccaggtgctacctcctcagacacgggaagacccagatactcatacctgtgccaggtgctacctcctcagacactggaagacccagattctcatacctgtgccaggtgctacctcctcagacatggaagacccatatcctcatacctgtgccagatgctacctcctcaaacattgggaagacccagatcctcatacctgtgccaggtgctaccttctcagacacaggaagacccagatttcatacctgtactagatgttacctcctcagacaccagcagacccagggcctcatacctgtaacctgctgttatctcctcagacaccagcagacccagggcctcatacttgtaccagatcctacctcctcacacactggaagacccagatgtcatacctgtacttagcccacctccttggatacctcttccagcaccacatacctgtaccaggccctacttccatagacacttgcagacccagagccccttaccggtgccaggacccaccttctcagtctcatacttgtgcccaggtatgcttccttggacaatgaaagacccagcagctctctgctacacttggctaggtctcctcagatattaaaaacccacagctacatttctgttccccagcccacctgcttgaacagtggcccagtgcctcatacttgtgccaggccccacatcctcagatactgacaaacccagatcctcacacctgtgccattctttgttgaacaatgaagactcatcactttgtacctgtgcccattcccaactcctcaggtggtactgacagatccagaaccttagacctgtgcctcaccccacctcctggacactgacaggcccagtgggtcatatctgggcttgaccgatcttctcggcctatcacctaggcctatcattcacactgcaccttctcaagccacacctgcaagctccacttggtgccatcagagtcctcagaacttcacggatgtcttcctaacagctgtttatggagcacctcccacatttctagcacaggcaacggacacagagtgtgggagagagacgtacatcaaataatcatgccaataaatgtgaaactgagaaacaagtgctgaggagaaattggaacatggtgctgaggccacttataaaaggaacctgaggggtacttgacccttgatctcaagaacgagcaggcatgacccagagaagcactgagggagcattccagcagccataacagcacatgcaaaggtcccgtggccaaagcagtctttctcaagcgtgacagaattaaggcccacagaaaatgatctgagtgacttctcagttctcccaaggatggtccaagactagtaaccttctagacacgaaggagaggtgcccacttattacatccagtagatgccttgggctgtgagggcttaattctctcctggaagcccactgaggcagggggaagcatagcaccttccagaggataaaggaaggggtggggaccgcagggtggaagctgagaggcacggtgggaggactgagaacagtctgcggctaagacaaggacagaagcaaacaagccactttgaagccccggagatggactggggagtgcagaggactcattctgggagctctccagtgtggccgagaggtttctggcttgggcaatgagatgaccggtggggccactcacttggaaaggctctgggtttccgggaaccttacctgacagacgcagtcctacagactacatcatgcttgacataggctctcacatctcatctaacagatgcagttctatttttttcttttttttttaagagacagggtcttgctctgttgcccaggtggagtgcagtggcatgatcacagctcaccgcagcctcaaactcctgggctcaagtgatcctcccatctcagcctccccagtagctgggactacaggcacacaccaccatgcttgactattttttaaattttttgtagagatggggtcttgctctgttgtccaggcaggttttgaacacctggcctcagcctcccatctcagcctcccgaagctcagggattacagccatgagccaccacacccagcccagactcagctctagaaactaaacttcagcacacagccagccctctggctgacagagtccaggctgctcaccttggccgagaacaggtcctcagatcccagttttgtgacagcccagcaatgccaagcagtgtctgacctgagcctccgaaccctcaatctgcagacatgggtctctagacctcacctttaagtgcagtggcctctgagaccatacattatagatgcagctcctcagtcagttcaatgtcctgggcctaacctgccccagtgccccagatctcaccttatctaaccatcatctacctttttcctcactttactcactttctttttttttgagacagggtctctcactctgtcgcccaggcctgagtgtagtggcatgatctcagctcactgcaacctctgcctgccaggttcaagcaattctcctgcctcagcctcctgagtaactgggattacagacatgtgccaccatgcatggctaatttttgtatttttaggagatggggtttcaccgtgttgaccagactggtctcaaactcctgacctcaagtgatccacccacctcggcctcccaaagtgctgggatgacaggcgtgagccactgcgcctggcaactttcctcacttttaactcagaccctgtgtcaactggagcacaatgccatcttggatgcagaccaacaccatggactggttacagatcctcagccctctgtattaccctgagctctgtctatcatacctgaccagggtgctgagaacagatacctgtcccagctgatctttagggttccctagacatcaccaggcagacccaggtacaaacacctacaatgactacggctttcccttgatataagagcccacactactcacctaattgtgtctgaccctaccaccgaaggtctcacctgtgtctgacccaccttccccaggcctggccagcctcaccattatgcattcctgtgctagaccccacccacttcacctaacaagcccagcagtacttttgtgcttgaacccaggtgtcaagaacccacctgagaccatgtttatacaacctctgtggaactgagcctggatccacagactcactgctaatgtcaggtcaacataccagcactgagcctgaatccacagactcagtgccaatgctaggtcaacataccagcactgagcctggatccacagactcactgacaacaccaggtcaacataccagcactgagcctggatccatggactcactgccaatgtcagctaaacataccagcactgaccctggatccacagactcactgacaacaccaggtcaacatgccagcactgagcctggatccacagactcacgacaacaccaggtaaacataccaccattgagcctggatccgtagactcactgacacaaccaagtaaatataccagcactgagcctggatccacagactcactgacataatcaggtaaacataccagcactgagcctgcatcggcagactcactgacaacaccagataaacataccagcactgagcatcgatgcaatggtttcacctgggagacctagttctgcctatttgtgtccaactccagtgcctcaggctacagagttatatacctgtcaaagatgggttccagacatctcagctgatagaccaggcttcacataacctgacccctcacaccttgactgacagacccggttcccttgcctaagcccaactcagattccttacagcctcccagggtccagctttatttatgtgagcctggcctcggcagtccacatcctgtgtctggcttggcttttcatgtctcacagacagatccaatgctgccaatctctgcttaacgtcagcaccaatgagctcactgaggagcctcagacctcatcaaatggaacatctctgcctacctgtgctccccagctgagatgcgtagttctaccaacttgtgactaacccactgtccccaggcctaagactgagtcagcacaactaagccagaaccacgcaccaatgacctcacctgcaagaccccagctgtatgtctctctagctacaaagtccttgcttgagagagatacatctacctacccacgtctaacttaggggccacagacctcctaggaaacccacaatgttctgcctgcctgtagagacccccatgctatggggttgacctgggaggccgctctatacacctaggctcaactctggttcttcaggcttcacctcaaacacccaggggcacattcctgtgcctgaatccaactcctgaaagagccaactctatctacctgcattcaacctaactcctcagctctccttcaagagactactcctggcagaccagttttgtctacctgcctgaccctggctcctcagaccacacatggtgggccagctctgcctacctgtgcttgaccctgggttctcagaccacacctgaaaggctatctctacctacctgtgcttgaacctgggttctcagaccacacgtgaaaggctatctctacctacctgtgcttgaacctgggttctcagaccacacctgaaaggctatctctacatacctgtgcttgaccctgggttctcagaccacacctgaaaggctatctctacctacctgagcttttcgctgggttctcagaccacacctagtgacccagactacctacctgtacttgatcctggctcttcagaccatacctggcaggcagctctacctacctgagtctgaccctggctcctcagaccatacctggtgggccagctttgcctacctgtgcttaccctggctcctcaaaccacacccagtgggccagctctacctacctgtagttgaccttggctccttaaaccacacctgaaagactatctctacctacctgtgtttgactctggctctttggagtacacctggcatgccagatctacctacctgagcctgatgttggctcttcagatcatacttggtgggccaagtctgcctacctgtgctcaatgctggctcctgggcttgtgcctggtggaccagcaccccctacctgcatgtgatgagggttcctgagcttgtaccttgtgggccagctctgcctacctctacttcacacctcagctgcttacacctcatccaacacacttggttcttcttacctgggcttgactatgactttttaggtctcatgaacacactcagctttgtgaagctgccctgatcctggctccaaagaccttacctgccaaaccctgttctacacacctgtgtttaactcccgttcttcagacctgatagacccgaagatgtacctgggccaggctccaaagacctcacccaagaaactcaattccacatacctacatacctgtacctggccacagctcctcaacctcacccaggagaagaacttctacccacccatcttttttcttttttttttttttttgttttttgtttgagacaaagtttcactcttgttgcccaagttgaagtgcagtggcatgatctcggctcactgcaaaccccacctcccgggttcaagcaattctcctgcctcagcctcctgagtagctgggattacaggcgtgtgccaccacacccagctaatttttgtattttttagtagaaatggggtttcaccccgtcaccatgttggccaggctggtcttgaactcctgacctcagatgatccacccaccttggcctcccaaagtgctgggattacaggcatgagccaccacacccaacccccgcttttttttttttttttttttggagatagtctcactgtcacccaggctggagtgcagtagcaccatcttggctcactctgcctccccagttcaagcaattctggtgcctcagcctcccaagtagctaggactgtaggcatgcaccaccatgcctggctaatttttgtagttttagtagagacggggtttcgctatgctggccaggctggtctcgagctcttgacttcaactgatctgcctgccttggccttccaaattgctgggattataggtgtgagccactgtgcctggcctacccatctgtcttgacaccacctgggaaatccagacctgctcactgtgccagatcccagctcctcagacctcctgagagacctggctctatccacctgccttcacttcatatcctcagaggtcatctaccacatccaggtctttctagatgagcctaatccggactccttgggcctcacctgatagatccgttctacctgtgcctgacctcaactgcaggacagtttaattggtttgaccatggctgttccggtcaacctatctttgcatgctcctggtttcatagatgtcacctgacaaactctacccaccatgcttaacacagcttctcggtcttgggatacaaaccagagcctgacctcagtggctcagaccttaacctgtgagacccaaaaatacatacctgtgtctcaccttaacccctgaaacctcgcctgctagatctgctctacgtacctcgaccagacccaggcttcatccacctttctgatggatgcggttcgtcatccctttgtctgaccccatccctttgtctggtctcttcccaggggacccaggctcacccaccagagctgctcagacatcgcccaaggacacagctccaacctggacccaatcacagattttcagccctcacttgtcagacccagctcgacctgtctgcctatctttagctccaacgtccttaccagactggtccagttctgcctacctgagtacagtcttggctcctcaggcctcccctagaaacccagccatacaaacctgtctgattccagctcctaggacctcagacagacgcggctctgaaaggctgcattatacacacctaacctgaacagacactttcctcacacatgacagatccctggctgctgacctcggcctgagggagcctggtgagagcccagtgttgacaaacactgtctgactggctcagccttgatgtctgccctgtagacccaggtctctggccctttacccaacctgagccactcagaccgcacccacccagcacagctcctcatgccacctgcctgcctcacctgccccagctcccctgtccttgcctcatatcaccaggtacattcctacctctcccgcatctgggctctgcagaccctgatgccacagacttggacttcagtcacaaattctcagaggcctctgacgccctgagctctgcccatcacacccagtcaggatgctgagaagcaggtgctgacctgtgtgtccctaatcctgggttctaaacttgtgcaatcagccacccactacctgatcctcacttttcggaaccggccagagatcccagcgtgcacacctgtcccatgccataggtctacaccacctcccacagagcccggctgacatatgcacatacatagctttggctcctcagacttcacctgacagaaccacctctaaatacctgcctctcctctggaattcacagacctatgggtccctctcctgtcctggctcctcttcagaactcacctggacctgctctggctctgcttcaggcctctccagccaaaactggccctgtggcgtgcgctgaccctggccgagccctgagagaccccatggtttcccaccacacccctgcctgatcccgacacccatggctgccgcaaaactggccctggcggaccaagaattacctcttctacatacccctaccagacgggactcttctgatctcacctgagggccggcactgcatccctaggcctgagctgatggctgtagctcacccgagaccccacctgcaggaacttcgcctgctcctatccctgggttcttcagatatcaccttcttgattcagcaggatacactctagtaactcaggcaggtccctcctccagccgttgtgggctgtctagcctggcccaggaggcctccacttaggtctcaccagccagccctggccccatgttcctgtgtccagctatcattcctaggccttacctgggaggccagacccatcctctccttaagccacaccctaactcatctctacatgctgggtggtgacaagcaaggacaccccgatctgcttggctccttggctggcagcagcacccacacatccctgcccaccacctgctcaggctccagatcccaaggaggaggtggaaggtgcctgccctccattatcagccatgcaacatttattagaagccgcacagtctctcttgaccagtgttccgcatctgagccacaggatgcagaaaatgacttgagtgattctcgtcaattcttccaaggatggtatgtaactagtctcattctagaaagaagttaactcattatacacagtggatggcttaagggattagggcttcattctctcccagaccctggtagtaaaaggcctttagagctttcaaaggaatgaggttatgtctgtggatgccatcaccaagcaaagggcctctggtccaaatgcctggagacagccccaggtgggaaaaccaccaaatgggcaatgccctctctgctgcgcctgccacagcgttagagccctgcacgtaagcccggccatgcccacagcattcacagtgcctgcatcacaccctgcactgcacccctgcaccctgggcttcacagtcagagccctcctcacaccactgctgagctcaggcaagtgcacaaggaaagctgtggctcactgctcggctccagcagaggtggtcccatggaccacctgttgctacagaggggtcggcagccctgtcactcaaggcagggtttgctctgcaagctgccccagcctggcgcctcctctacgccacccccccagctcctcctgcagctcctgttgctcctttccaggcctacccggtcatacctcatgcctcaccctgcccttggcctttacagatggtggctgcagttcagagaaaggtcatcactgagaataactcacaacctcaactctgtgagcgtggcaagggggactcgggttaccccacagtgggtgttgcaggcaggcacccaagggagtgtcatgtggccctgcaagctcagcccgccctcaggtggaagtggagccctcatcctgcctgggttgctcttgccctccaagcctctctgagggcctctctacctttccccaagctaggtatgcagcaggtactcaataaacactgacctgacctcatgggcctctcaacagccatgacttggcaaaggacacttaattcacccagtgcagaagtgcttgtacttacatcccagaactcgaacatgttttgagggtcaattccaaactccttcactttggtctacaaaaaaaaaaacaaagggagagaaatgcaaagaagcatttgctagcgggatgggaacaggagctccgggaggcagggagctgtgctccgtgagctgagcctcaccttccccagagccagggatggggcagggctggagcagcctgtgagtcgagggcagggcccaggatctgcccaccccaagctggacaccagatcagtccatgaccagcacgccagtgacgttgtgcctgcaaagccccctgctgagggcagctgtaaccccgtgtgaggacctggcccacacactgctctgcaacagctctcacccaggcctgcctgggacaccagagcatgatacccctggacatctgggaaccgaacctaggactgggacccaagtgtgggcaggggccacctaccaggccaggcaaacaaacacaggctgaacagccacccagcccttcccatgtgtgggagggtgactgcaccaggaagctctgaggagccatcaggtattctggtccccagggcagacagggccagcaattccttacctattccacataggaggagaagccctactgaccagtcagttgcaggcaggcaacagtgctatggttagccagccttatggcgtcctgctgcagctgggtaggcactggaggcagagatgtggggatgatggtggagggggtgggagggagatgtgggtgtagtccccagctctgacacagcacagtgcccactggctgactgctgctgtcactcctggagcatccctcactctgtcatgccctgctgagcctgcacaacctcgaggccaggcagactgtgagaacttggagacaggagacccaggttctaatcctggcatcacctactcatacagtcactaagtgggccgggtacagtggctcatgcctataatcccaacactttggtaggccgaggtgggcagatcacttgaggtcaagaattcgagaccagcctggccaccatggagaaaacctgtctctaccaaaaatacaaaaattacctggacgtggtagtgggcgcctgtaatcccagaatcagcaggctgaggcataaaaattacttgaacccagaaggcagaggttgcagtgagccaagatcgtaccactgcactctagcctgagtgacagagtgaccttgtctcaaaaaataagctggacatggtggcacacacctgtaatcccagcactttgggaggctgaggtgggcagatcacttaaggtcaggagtcagagaccagcctgg

SEQ ID NO: 531 - DNA, 11872 bp, Homo sapiens; identical to SEQ ID NO: 530

SEQ ID NO: 532 - DNA, 5173 bp, Homo sapiens
aggcggcgtctccgggagcgggtctccggctccgccggctctttcgccacggccagggcctggcacccacctgactggcgggggcccgcgcgcgaccttctgggagcagtagtcccggcgcggggcgtcgcgcccagtgacgtcagagagcccgtggccggccctgggtcccaccgctgccggcccagcgctttggggagtgacttccggccatgcggggcctctaccgctgccatcgcggtcccggtctcctgaagtggaacccggcttggagtcgagcgcgacccctcgcccgtgggcgcaggcgatcgagtaagggtggggcgggcctcaaacccggatcagaacccgccctgaccggcgcagagatacgggacgcagccgtgagcactgttttttatttcaccatggacccatcggcgtggggcgcccgccccgggtgtccttcctcccccgggcagccagatgctggaacgggaggcacatgttccggccccggcccctgggaaggaaagaaaggaccttcccgtttcacttgtctcggctgaacatgtagcggaggaggtcgaccacccggtgactgtagccatattcgttgtcgtacctgtggaggaggggtcgggaggttcaagggggttccttccgaccaccccttagttcccctccctctaagtctccagctccttcccccttaccatgaaatgagcttcacgaaattgtcattgagcgcaatgccggccttagcatcgaagatggacgagtgggtatcaccgaggaagtccgtagagacgacctggaagtcagaatttcaaagataagtgtgtccggcagagcaaggacctccaggagctgaggccccgactcttaactctatcgcccatccatgcattcatctataatatttgatgtagccctactgtgtccagtctctggactggagggtatgaccaagtgcagggtatgaccaaggcactgtgtcagggtctggccaaagggcacaggtcacaaacaccctcatgctgtaccagtacatccctttcctaggaataatgcaagcgtttggaatgggccagcatggagggcctctctgaggggtggccatgagcctgggtctagatgactagaaagatctgaccggctggggccctcagcacagtgtctgaggtagaaggagctgcaggaagggaggacctgagggttttagccctagtgtcatgaaaggccacaggagtgttttcaatcctgaaaacgggtgatgcaatgtgattccattaaaacaaaagatcccagtgactgtgggaaagtggacctgcaggagttaatgcagggagacagcaccaaggtggatgtacaggggtccaccatgaccatggcatccactcctcacagagaaggcatctggccatggcctggccctgagcaagtattgaaaaaaatgggagctgttgtcttttgttcactaagcatgtattagtcacctgctgtatgccaggttggagccacaaaagtgaaaaggcagcccctaaatccctgttttcttggagtgcacacaccactggggccaacagtgactatgaaatgaaatttcaggtgaggaatatggccacaaaaagaacatattttgagggggtgccttgctgaagagggaggttcctccagagacttggaggaagtaaggacagactgtatggtcacctggcaagggaagcattccagactaaaggaacagcaagtgcaaaggccctgaggcagggagatctcccttcctgccctgcagtttctgacttggcacattgagagcagctccctggcaagtggaaatcatgtcccttcccagagggctcctcccagggtctcctctcctcagcccctacctcatcctcggtgtaggcaaggatgccagccatgggccccttggctgctgcttttacagcctccttgatggctgagtagggggcaggctgggcgaggcggcaggtcaggtccacgacagacacatccggggttggtacccggaacgccatccctgtcagcttcctggagaatcccccatgaggaacaggagtcagaacttagggacgttgccctccattccccctttccctgtggctgggccaggcccctgctttcctcttaaggactgagggccgggccagtccagtcctcctggcgtatgcccccaccctggttgcagcttcttgtcctcataccctttgagctctgggatgactttggtcacagctttcgcagccccagtggaggctgggatgatgttctggtgggcaccccgcccatctcgccaggccttccttgatggcccgtccactgtcttctgggtggccgtgtaggaatggactgtggtcttggggaagagaaggaccaagatgaggccttcatgctcctaagctcccatgcctcttttttccaggactaagttggtggcctaggtgtggaggctggtggggccaccaccacagaccacaggaggggatgtgtgcaggccagggtccagccttgcctgagggttgcacagtgttttaagtgacttctgcactggtgggcctctcctcccgaaaccagtctctccctcttaactccatacagtaagcaaggcccgggaagaagttgggtttccctgccatccttcctgccccagcccctcatcctcaactcaccatcaacccttccacgatcccaaatcgctcgtggatgactttggcgaggggagccaaacagttggtggtgcaggacgcgttgctgaaacagccaaggtgtgcacggacactgtgaggtgagtcgcagagccacccctccacccttacccctcttggggtatgcacgcagacttggttttatgaaacgtcaggatgagggtgagagggatctgtggggacactgtcagactgaaggaggcactgaggtgcagctggggaggctccccaagcttgtcctctggaagtcatgcgtttttagcagatagtttcgggaaggagaagcagaagccaagcgaccaggaatccagtggggctgagggtggggaggacgagtctaccctcccttccacacattgcaggatgtcactgcccacattacctcacaatgttcatggagccagggttatagtcattttcattgacacccatgacgaacattggtgcatccggtgagggcgcggagatgaccacacgttgagcacctgcagagatgtggtcctggggaggaagcgcaggtgtcaggggcttctggcaccatcatccccccagctagccctgggcacctctccccagcttaccgaagctgcctgtatggagaggtacacgcctgtggactccaccacgtaggggctcccgacagccctccaggggatctgtttgggctctttgctgtggggaagtggcagggctgagtcagtctcccctgcttgagccccaccttcatagtccatggctttcaccatttgacaggctgagcaggtaccggcccacctgcaaccacctgcgtcccctaccccacacacctacttgttccagatgggctccaccccgctggcctagcttttcaccactgccccacttcagaccactttccctttgctgattgcaccacccctgttatgcctgggtacaggtggtgacctccccaactcagccctcaacctcctcagaggcgccaatgctgactgctgtcagccagcccagaccctttctccatatgctgcccgggacgtggactctgtgactgtgaggcctgcccggctgctttctgcttcccagctctgacaacctcgccatgaaccctcctagaccctcagctcctgcaataggaagctggctgccaaaggccaggagggtccctgaaaacagacactgcattaaagaaaaagctcctggaggactcctgaagcctgaggcagccttggggcagcagtggctcatggtttacattggaaaggtttatcatgagtaaccgggtgctttgcttctgtgattcttggccagtgtcggtctgtttcctttgccattgagcctgctcccctcaatggggggttcaatcaatgtttgtggggtttgtttgttttgagacagggtcttcctctgtcgcccaggctggagtgcagtggtgcaatcagagctcactgcagccttgatcttcctggctccggccatcctcctgccttggcctcccgagtagctgggactacaggcgcacaccaccatgccaagctaatttttaaatttttttgtagagatggggtctcacttttgttgcccagggtgctttagaacccctgggctcaagtgatccttgacctcccacagtgctgggattacaggtgtgagccaccgtgcctggcctcatgggttttctttgttttgttttgttttgtttttgagacagagtctcactctgtcactcaggctggagtgcagtggcacgattttggctcactgcaacctccaccttccgggttcaagcgattctcctgcctccgcctcccgagtagttggggttacaggcatgcgctaccacacctggctagttttttattgttgttgttttttgtatttttagtggtgacggggtttgctctgttggccaggctggtctcaaactcctgacctcaggtgatccccacttcagcctcccaaagtgctgggatgacaggcatgagcctctgcacctggcctcgtgttttttttttagttagccattttatacgtgtttactgaacacctgtcctgtgcccatattctaagtgccttacctgcattaaactcatgtaaccttcacaacccgatgaggaagtgctaccgctgtcattttttgcatttttttactgctgtcagggcagaggggaggggagtgagagggagagcctgctggagtgcaggtggctggtcccacctcgggtctgcactcctgtttccactgcctgaatgaatgaatgaatgggctgccctgcaaagccatcacacatgcatggttatcctcttcctgtctcctgctctgtcagtccactttccatcatctggcccaacgagctcttctcagataccccccatttcctgccttccaaattagggacacttgcgattcctctgcaacaattgctgagttggcctgaggcaaagactgtgcccccagaagaccccaggccctccccaaggctgtc

SEQ ID NO: 533 - DNA, 1615 bp, Homo sapiens
cacgtttcccattggccgccgtttccggaagcccgccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagtagacacggggtttcaccatgttggccaggccggtcttgaacttgtgacgtcaggtgatgcacccgccttggcctcccaaagtgctgggattacaggtccagattttgaacaaatctcgctagagattgaacagagctgcgcctggatcccgccacagtgaggagacctgaagaccagagaaaacacagcaagcccctggatcctcctggaatccccgatccctcttgctccctggcagagttttctagtccctcttacttgaagcatgtctttcagagcccggcaccacccatcttgagtatctgataccccatcagcctgagtctcttaaaggcctttatacacatatgtctacacatagggatttggatgatctcgggatcccacatcctcgctgtcccctgtccccccgcaacatcccccaccaatacctttctgaagttttctagtccctcctttttgtttgtgctccttaaagcccagccccatgcctgactttggttcccagtgagcattgtacatttgtggatattaaatctttggcaaagtcatttacctgggctggaatagggctcttggctgattctttttcctaaacacccacccaatgggagaggctgatactcaacatgcaaaccttgtgttttatttctccaggcgaagggatgttggaagacattctggaaggggtggggtgtgaagatttacaaataatctttgaatatctgcttcatgataggtcttggaggtgccttgtgggtgtggctttggggggatggttacgaggaaattgtggatattaaggaagtcaggaaaggaaaagatcagtcacaattcaacaattcagagaaagctcctaagggactttctggctgcttgatgcccagaggccaggccctcacttcgtattaaggctcaggactgtggatagagaatttaaaggggcaccaaaaaaaacattaaaatagataaacatatttttaatggaatacctttaaaaatgcaaatcaatgcacaaagaaaacgccca

SEQ ID NO: 534 - DNA, 1615 bp, Homo sapiens; identical to SEQ ID NO: 533

SEQ ID NO: 535 - DNA, 1615 bp, Homo sapiens; identical to SEQ ID NO: 533

SEQ ID NO: 536 - DNA, 6207 bp, Homo sapiens
cacgtttcccattggccgccgtttccggaagcccgccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcaggtccagattttgaacaaatctcgctagagattgaacagagctgcgcctggatcccgccacagtgaggagacctgaagaccagagaaaacacagcaaacggagtcttgctctgttgtccaggctggagtgtagtgtggcgatctcggctccctgcaagaatctgcctcccagattcacgccattttcccacctcagcccctggagtagctggaagtacaggctcccgccaccacgcctggctaattttgtttttgtatttttagtagagacggggtttcactgtgttaggtaggatggtctcgatctcctgacctcatgatccatccgccttggcctctcaaagtgctgggattacaggcatgagccaccgcacctggctgttttttcatttctattatgatttgttctgtggaatgtcagtgacttagcggtgtttttcacatgtttataaagctgaatagttctgtatgtcagctcagcacccctagtgtcagtcatgctactctcctgctgtgcatagatgggggcctgtccacacccaaatctcctgggttcccgctgtccgcacctgaaggtacccaccagatgtgtctgtcactgccctccatccacctttcttgtggttctcatgtttctgcctccctagagaccatttctctctacagcagtagtttccaatagaaatacaatgccagacacatacgtcattttagattttctagtagtcactttagaaaagtgaaaaagaggccagctgcagtggctcacacctgtaatcccagcactttggaaggctgaggtgggtggatcacgaggtcaggagatcgagaccatcctggccaacatggtgaaaccccctctctactaaaaatacaaaaaattagctgggcgtggtggcaggcgcctgtagtcccagctactcgagaggctgaggcaggagaatggcgtgaacccggtaggcagagcttgcagtgagccgagatagcgccactgcactccagcctgggcgacagagggagactccatctcaaaaaaaaaaaaaaggttacaaagaaacaggtgaaattagttttatttcacctaaaatgttagcattatccaaaatatcacttcaacatcttatcaaaataaaaattattaatgagatagcttacagtctttcttttctttgagacagggtcttgctttgtggtccaggctggaatgcagtggcaccagcatagctcattgcagtttcagactcctgggcttgagatcctcctgcctcagtcttcctagtattcggactacaggcacacaccaccatgccacgctagtttttttttttttttaaagacagggtctcactctgtcagccgggctggagtgcagtggcacaatctcggctcactgcagcctcgatctccggggctgaaatgatcctcccacctcagcctcccaagtagctgggaccaaaaacatgtgccaccacgcctgaataatttttgtatttttttgttaagacagggtttcggcatgttgtccaggctggtcttgaactccagagctgaagtgatccacccaccttggcttcccaaagtgttgggattacaggcatgagccactgcactcggcctaattttttttttttctgaagagatgaggtcttgctatgttgcccagtccagtctcaaacttctggctcaagcagtcctcccgccttggccttccaaagtgctgggattacagatgtgagccaccacactggcccattctttcttttatactgagtattcagaatttttttaaaatgtgttttccacttacagcatttctcaggttggactagccatctttcaagtgctcagcagccacatgtggcaagtggctgccttattggacagcacagctctggagggtgattttatgtacatccccactgctctctctgcctcctttattcccatctaccccacacccctgcagtctgtgactatcgtgtccctctctcctctctttctgtctcttgtaattctttaatatggagaattatttccaattccttaacatcctgcgctgatttttttctgtcttacattcaagggtcacagttttcctctcaccctcatttcagtcttttcccataacacgtgacgtgcctttttgtcttggttgggtatttatttgcaatacaagaatgattgttttctttgatacattagtgacttacatagttttcatgttttttgagtacctctttcttgacagaatttcaaattaattctagcgttaaactagaaatctttttttttttttttgagacacagtcttcctatggcaaccagtctggagtgcagtggtgcaatctcagctcactacaacctctgccttccagattcaagtgattctcctgcctcagcctcccgagtacccgggattacagatgtgcaccaccatgcctggctaatttttgtctttttagtagagacagttttttgccattttggctaggctggtcttgaactcctgacctcaagtgatctgcctgcctcagcttcccaaagtgctgggattacaggggtgagccactgtgcccaacctagaaagcttattttattttattattataattaattttatttttttgagatggagtctcgctctgttgcccaggctggagtgcagtggcgcaatctctgctcactgcaagctccacctcccaggttcacgccattctcctccctcagcctcctgagtagctgtgactacaggcgcccgccaccacacctggctaattttttgtatttttcatggagacagggtttcaccatgttagccaggatggtctcaatttcctgacctcgtgatccacccgccgtggcctcccaaagtgctgggattacaggcgtgagccaccgcgcctggcctataattaatttttttgagatggagtcttactctgtctcccaggctggagtacagtggcacatcttggacccctgcaacctctgcctcctgggttcaagcagttctctctacctcagcctctccagtagctgggattacaggtgcccaccaccatgcccagctaatttttgtatttttagtagagatggggtttcaccatgttggccaggctggtctcgaacccctgacctcaggtgatacgcccgcctcggcctcccaaagtgtgagattacaggcatcagccactgcacccggccagaaagcttattttaaaaggtgtgtatagagccccttatgtttctgcttgattttttaaataacatatttatgtctatatattttaggatgtaatatctcactgtatgtgttgctttgcatcattgaacatttttggtaattattttctatatattttagatatttcattaaactaatacagaatttcatattcagggccaggcatagtggctcatgcctgtaatcccagcactttgagagtccaaggcgggcgcatcacctgaggtcaggggttcgagaccatcctggccaacaagggaaaaccccatctctattaaaaatacaaaattagccgggtgtggtgttgcacgcctgtaatcccagctacttggaaggctgaggcaggagaatcgcatgaccccgggggcagagattgcagtgagctgagatcttgccacttcattccagcctgggccacagagcaagactccttctcaaaaaaaaaaaaaaaaaaaaaaaattcatattcgctcatatcaaaaatgaaaatttatttttgcaaatttctaagtgatagaattattttaatgtaggaaaggttcatcaaaaatgggtgtagtgattgtgttctttcctatgctcgaatggaaaatgatgaggggacacgatgttagagttgcagtgggaaggggtggaaaagagggattccagagtgccaggcacacaggttttctggaaggtttacatgaggactgctgtggtttgaatgtgttccccaaagttcatgtgttggaaactcaacccctaatgcaacagtgttgaccagtggaacctttaagaggtgattaggtcatgaaggctctgccctcatgaatggatgaagctagagtgggttagttatcttgggagggggttcctgataaaaggatgaggttggcttccttccctttctctttccccctcccccctctcacatgtggtcactctcttgcccttccaccttccaccataggacggcacagtgagaccttcaccagatgcaggcccctcactttcccagtgttcagaaccgtaaaccaagtgaactcttgcttataaatcacccagtctgtggtattctgttatagcaacacaaacggactaagagagggacactcagtgggctcttctacttgatggagcactccctgcgtggtgccttgtatttgtagacatgatgctgtaaatgctctttgaatgtcttgaaggcttttatgtttgaggagtttacagagaagcacctacaggcttcaggtcccttcttctgttgcttctttgctccttagttcctcccctaacctggtgctaaattagatcatagtgtggtccttggaccaacagtatcaatagcacctgaaaatcatgctggaaatacagattcacaggctgctccctagaatactgaagaagaaactctaggagtgagacccaacaatctgtatttaacaagtccccaggcccctggatcctcctggaatccccgatccctcttgctccctggcagagttttctagtccctcttacttgaagcatgtctttcagagcccggcaccacccatcttgagtatctggtggattttcacatctcaagccagctaagagtatgggaaataggactcgttaaagcacagatatcacacaagtgattcagattcacgagggtaatccagatgaagataccccatcagcctgagtctcttaaaggcctttatacacatatgtctacacatagggatttggatgatctcgggatcccacatcctcgctgtcccctgtccccccgcaacatcccccaccaatacctttctgaagttttctagtccctcctttttgtttgtgctccttaaagcccagccccatgcctgactttggttcccagtgagcattgtacatttgtggatattaaatctttggcaaagtcatttacctgggctggaatagggctcttggctgattctttttcctaaacacccacccaatgggagaggctgatactcaacatgcaaaccttgtgttttatttctccaggcgaagggatgttggaagacattctggaaggggtggggtgtgaagatttacaaataatctttgaatatctgcttcatgataggtcttggaggtgccttgtgggtgtggctttggggggatggttacgaggaaattgtggatattaaggaagtcaggaaaggaaaagatcagtcacaattcaacaattcagagaaagctcctaagggactttctggctgcttgatgcccagaggccaggccctcacttcgtattaaggctcaggactgtggatagagaatttaaaggggcaccaaaaaaaacattaaaatagataaacatatttttaatggaatacctttaaaaatgcaaatcaatgcacaaagaaaacgccca

SEQ ID NO: 537 - DNA, 6207 bp, Homo sapiens; identical to SEQ ID NO: 536

SEQ ID NO: 538 - DNA, 1519 bp, Homo sapiens
cacgtttcccattggccgccgtttccggaagcccgccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcaggtccagattttgaacaaatctcgctagagattgaacagagctgcgcctggatcccgccacagtgaggagacctgaagaccagagaaaacacagcaagcccctggatcctcctggaatccccgatccctcttgctccctggcagagttttctagtccctcttacttgaagcatgtctttcagagcccggcaccacccatcttgagtatctgataccccatcagcctgagtctcttaaaggcctttatacacatatgtctacacatagggatttggatgatctcgggatcccacatcctcgctgtcccctgtccccccgcaacatcccccaccaatacctttctgaagttttctagtccctcctttttgtttgtgctccttaaagcccagccccatgcctgactttggttcccagtgagcattgtacatttgtggatattaaatctttggcaaagtcatttacctgggctggaatagggctcttggctgattctttttcctaaacacccacccaatgggagaggctgatactcaacatgcaaaccttgtgttttatttctccaggcgaagggatgttggaagacattctggaaggggtggggtgtgaagatttacaaataatctttgaatatctgcttcatgataggtcttggaggtgccttgtgggtgtggctttggggggatggttacgaggaaattgtggatattaaggaagtcaggaaaggaaaagatcagtcacaattcaacaattcagagaaagctcctaagggactttctggctgcttgatgcccagaggccaggccctcacttcgtattaaggctcaggactgtggatagagaatttaaaggggcaccaaaaaaaacattaaaatagataaacatatttttaatggaatacctttaaaaatgcaaatcaatgcacaaagaaaacgccca

SEQ ID NO: 539 - DNA, 4249 bp, Homo sapiens
cacgtttcccattggccgccgtttccggaagcccgccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagtagacacggggtttcaccatgttggccaggccggtcttgaacttgtgacgtcaggtgatgcacccgccttggcctcccaaagtgctgggattacaggtccagattttgaacaaatctcgctagagattgaacagagctgcgcctggatcccgccacagtgaggagacctgaagaccagagaaaacacagcaagcccctggatcctcctggaatccccgatccctcttgctccctggcagagttttctagtccctcttacttgaagcatgtctttcagagcccggcaccacccatcttgagtatctggtgagttctgtggtctgcatgtccatgtttgggacattctgggaagggtggcccaggctgtgatttgccatctactgcaggctatggatggtattcagaagggaggggagatgctgtgtgcgtgttctgaagggtttcccactaaacagatcaaccctctccataactatttgatttttactttatctcctcgttgacttcacagtgtcagtgcagtttgtgtaaacatctctatggggtgatgcatgcagataaatgtttatgtgaacatataaagtctgcatgtgtgggtgaacactccacatcaggtcattgtccatcattacatatctgtggtgtctggctcattcgtctcgttttctgtcattttacctacttttacctgaagtacaatgactatttaataactattaaatgtttcatttcagctacacctctatggtatttttttcacctcatatcataccttcctccctcactggacttcagtgtgggacctgcaggtctcaggccttctgggaagtcccagcttttcttgaatgttttctctctctggccagctcaggctggagcagtgggtgttggtgccatcctgtggctataggtgataagccggctgttcttcactgacctggtcttaccttgaaccctggagttctcacatgcatggatttaaatgctgtgtctttctaagggcacattatggccattttccttatctccctcccaaggggctgtttgctgtgtttattgactccctgtttaaaaaacatatatatatatatatatatagacgaattaggttgtaccccataaattgcatgtttgaaaaatatttcaaagaatagtttatttttttttgctgatttttatgtatcttctaaattgtatatatttatggggtataaaatgatgttgtgatttttcaatacagtgtggaatgagaatcaaattaacctatccgttacctcaagtacttgactttttttgtgatgagaaggctgtttatcactttcactcaccagctcctgctgtcttccatgctggggacaggaaaggctccacgcttgactttccctcctgttttcttatctgctgtcaacccctgaatgtaccctccaggattgccttctagaccttctacatctagctcgatcattgtgcacccaccttcctcccagggactgtccttagggagtgactttatgcacaaacttcacatgctcttcctgcctccttcatccccataagcccccatctcagccccatctgattatttcttccctgtctcatttcctgttatgctgttggttttctaacctgaagggtaacttcttactccttagttttttgccttaatttctaagtcataggctactttcaggctaaaagttttcctccagccatggttttagtctcattctataagtcttgctaggtagtttattcattggaaattttttgtttttgagacagagtctcgctctgtcacccaggctgtagtacagtggtgccatctcagctcactgcaacctccggttcccgggctcaagcagttctctttcctcagcctcctgagtagctgggattatgggtgcctgccaccacacccagctaatttttgtatttttagtagagacggcatttcaccatgtcagccaggttggtctcgaactcttgacctcaagtgatccgcccaccttggcctcccaaaatactgggattacaggggtgagtcaccacaccccaccccttggcactatatttaagtgatgatatttttggacactgaggtagcctcattccacaggtttagatctgaagcattttcactattgcttctttccatgtatttcctggtttgcaggtcagtttcttcttttaattcatcattgacacagtggtttatatggcttttaatttcaaaagattttttaaaatatctttttgccgatttttatctatgttaattttaactagacatgttccctggaaggacatcactagttttttttttttttttttcactctgtttataatttaggtggattttcacatctcaagccagctaagagtatgggaaataggactcgttaaagcacagatatcacacaagtgattcagattcacgagggtaatccagatgaaggtatatcattgtacctggcccgcatcactcagtaactgtcacctttgatttattgatttacttgagatggagtttggttctgtccccgaggccggagtgcaatggcgtgatctctgctcactacaacctctgcctcccaggttcagagtgattctcctgcctcagcctctttagctgggattacaggcacccaccaacatgcccagctaatttttgtatttttagtagagaggagctttcaccataatggccaggctggtcttgaacctcaaatgatctgcccaccttggcctcccaaagtgctaggattacaggctggagctacagagcccagcctgtcaccttgatttaaatgaatgcagctttcttggtgtcttgatgtttgtgaatttctgtggagtttgatactgctccttttgctgcttgtttttccagagtccccttatcacttgacgtgctgttatattatgtttgatttattacagataccccatcagcctgagtctcttaaaggcctttatacacatatgtctacacatagggatttggatgatctcgggatcccacatcctcgctgtcccctgtccccccgcaacatcccccaccaatacctttctgaagttttctagtccctcctttttgtttgtgctccttaaagcccagccccatgcctgactttggttcccagtgagcattgtacatttgtggatattaaatctttggcaaagtcatttacctgggctggaatagggctcttggctgattctttttcctaaacacccacccaatgggagaggctgatactcaacatgcaaaccttgtgttttatttctccaggcgaagggatgttggaagacattctggaaggggtggggtgtgaagatttacaaataatctttgaatatctgcttcatgataggtcttggaggtgccttgtgggtgtggctttggggggatggttacgaggaaattgtggatattaaggaagtcaggaaaggaaaagatcagtcacaattcaacaattcagagaaagctcctaagggactttctggctgcttgatgcccagaggccaggccctcacttcgtattaaggctcaggactgtggatagagaatttaaaggggcaccaaaaaaaacattaaaatagataaacatatttttaatggaatacctttaaaaatgcaaatcaatgcacaaagaaaacgccca

SEQ ID NO: 540 - DNA, 10952 bp, Homo sapiens
cacgtttcccattggccgccgtttccggaagcccgccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcaggaactgttggaaactactgaaactggccgacctgatcttcaaaatgtgcccctaggaaaggtggatgccaccgtgttcacagacagtagcagcttcctcgagaagggactacgaaaggccggtgcagctgttaccatggagacagatgtgttgtgggctcaggctttaccagcaaacacctcagcacaaaaggctgaattgatcgccctcactcaggctctccgatggggtaaggatattaacgttaacactgacagcaggtacgcctttgctactgtgcatgtacgtggagccatctaccaggagcgtgggctactcacctcagcaggtggctgtaatccactgtaaaggacatcaaaaggaaaacacggctgttgcccgtggtaaccagaaagctgattcagcagctcaagatgcagtgtgactttcagtcacgcctctaaacttgctgcccacagtctcctttccacagccagatctgcctgacaatcccgcatactcaacagaagaagaaaactggcctcagaactcagagccaataaaaatcaggaaggttggtggattcttcctgactctagaatcttcataccccgaactcttgggaaaactttaatcagtcacctacagtctaccacccatttaggaggagcaaagctacctcagctcctccggagccgttttaagatcccccatcttcaaagcctaacagatcaagcagctctccggtgcacaacctgcgcccaggtaaatgccaaaaaaggtcctaaacccagcccaggccaccgtctccaagaaaactcaccaggagaaaagtgggaaattgactttacagaagtaaaaccacaccgggctgggtacaaataccttctagtactggtagacaccttctctggatggactgaagcatttgctaccaaaaacgaaactgtcaatatggtagttaagtttttactcaatgaaatcatccctcgacatgggctgcctgttgccatagggtctgataatggaccggccttcgccttgtctatagtttagtcagtcagtaaggcgttaaacattcaatggaagctccattgtgcctatcgaccccagagctctgggcaagtagaacgcatgaactgcaccctaaaaaacactcttacaaaattaatcttagaaaccggtgtaaattgtgtaagtctccttcctttagccctacttagagtaaggtgcaccccttactgggctgggttcttaccttttgaaatcatgtatgggagggcgctgcctatcttgcctaagctaagagatgcccaattggcaaaaatatcacaaactaatttattacagtacctacagtctccccaacaggtacaagatatcatcctgccacttgttcgaggaacccatcccaatccaattcctgaacagacagggccctgccattcattcccgccaggtgacctgttgtttgttaaaaagttccagagagaaggactccctcctgcttggaagagacctcacaccgtcatcacgatgccaacggctctgaaggtggatggcattcctgcgtggattcatcactcccgcatcaaaaaggccaacggagcccaactagaaacatgggtccccagggctgggtcaggccccttaaaactgcacctaagttgggtgaagccattagattaattctttttcttaattttgtaaaacaatgcatagcttctgtcaaacttatgtatcttaagactcaatataacccccttgttataactgaggaatcaatgatttgattccccaaaaacacaagtggggaatgtagtgtccaacctggtttttactaaccctgtttttagactctccctttcctttaatcactcagccttgtttccacctgaattgactctcccttagctaagagcgccagatggactccatcttggctctttcactggcagccgcttcctcaaggacttaacttgtgcaagctgactcccagcacatccaagaatgcaattaactgataagatactgtggcaagctatatccgcagttcccaggaattcgtccaattgattacacccaaaagccccgcgtctatcaccttgtaataatcttaaagcccctgcacctggaactattaacgttcctgtaaccatttatccttttaacttttttgcctactttatttctgtaaaattgttttaactagaccccccctctcctttctaaaccaaagtataaaagcaaatctagccccttcttcaggccgagagaatttcgagcgttagccgtctcttggccaccagctaaataaacggattcttcatgtgtctcaaagtgtggcgttttctctaactcgctcagtaggaatcaggagcttcttttgctgttcttctgttttggatgcattggaaggtaagtttccttgtgaaccatattttggactcattttgtaggctttgccaaatggcctttttaccctcctataatgcattttctttggatattctcctagattctcagggatatttccatattttactattcatgagtttagaagagtgtttactttcctgagttttcatttccttctttttcttctgtcataggtaatttacagagcaaatagccaccagagaggataccgtaagggatgtggaaaatgagttcttttgcgcttatccagtgaggttgattttcagtcaatgagcattcagtatatgcctgggactctggctttattttttagctttgtgatgccaaacccatcaatgaacttctctgtatatttgattcatcatgaaatggtgacactgagggtggctgatttccaggtttacatcagttgccccaggggaagtgcctggcccttgtctggttgttgctgctctaactttgccctgttaattgaagaaatgcggctgtaaacacttcctggggtgttgctggtattttctgtcctcacagtttacagagaaacccatattttcagcctcttcctctgctttctgtcttttctgaaccatctcacccgacctggtgtaatcttcattgtgtgtgagtttgcacagatgtaacatctcctcaaagcctagtgcccacctcccacctccacgaaaatctggagctcaggaaccaccactctccccaacccattgcaggcttgaacatttgatggtggaaaccctgccctgagtttgtattatggtgggttctcttgggtcttgttctctgtgggtctgtcctgcgctatagtgtgtggagccggggggattttcactgtgttcctaaaggaagggcacaaggagttgttgggcaaatggtctgatatttccttttttttttttttgaaacagagtctcactctgtttcccaggctggagttctgtggcaccgtgttggctcactgcaacctccgtctcctgggttcaagcaattctcttgcctcagcctccagagtagctgggattacaggtgcccaccaccacacccggctaatttttttatatttttagtagacacggggtttcaccatgttggccaggccggtcttgaacttgtgacgtcaggtgatgcacccgccttggcctcccaaagtgctgggattacaggtccagattttgaacaaatctcgctagagattgaacagagctgcgcctggatcccgccacagtgaggagacctgaagaccagagaaaacacagcaaacggagtcttgctctgttgtccaggctggagtgtagtgtggcgatctcggctccctgcaagaatctgcctcccagattcacgccattttcccacctcagcccctggagtagctggaagtacaggctcccgccaccacgcctggctaattttgtttttgtatttttagtagagacggggtttcactgtgttaggtaggatggtctcgatctcctgacctcatgatccatccgccttggcctctcaaagtgctgggattacaggcatgagccaccgcacctggctgttttttcatttctattatgatttgttctgtggaatgtcagtgacttagcggtgtttttcacatgtttataaagctgaatagttctgtatgtcagctcagcacccctagtgtcagtcatgctactctcctgctgtgcatagatgggggcctgtccacacccaaatctcctgggttcccgctgtccgcacctgaaggtacccaccagatgtgtctgtcactgccctccatccacctttcttgtggttctcatgtttctgcctccctagagaccatttctctctacagcagtagtttccaatagaaatacaatgccagacacatacgtcattttagattttctagtagtcactttagaaaagtgaaaaagaggccagctgcagtggctcacacctgtaatcccagcactttggaaggctgaggtgggtggatcacgaggtcaggagatcgagaccatcctggccaacatggtgaaaccccctctctactaaaaatacaaaaaattagctgggcgtggtggcaggcgcctgtagtcccagctactcgagaggctgaggcaggagaatggcgtgaacccggtaggcagagcttgcagtgagccgagatagcgccactgcactccagcctgggcgacagagggagactccatctcaaaaaaaaaaaaaaggttacaaagaaacaggtgaaattagttttatttcacctaaaatgttagcattatccaaaatatcacttcaacatcttatcaaaataaaaattattaatgagatagcttacagtctttcttttctttgagacagggtcttgctttgtggtccaggctggaatgcagtggcaccagcatagctcattgcagtttcagactcctgggcttgagatcctcctgcctcagtcttcctagtattcggactacaggcacacaccaccatgccacgctagtttttttttttttttaaagacagggtctcactctgtcagccgggctggagtgcagtggcacaatctcggctcactgcagcctcgatctccggggctgaaatgatcctcccacctcagcctcccaagtagctgggaccaaaaacatgtgccaccacgcctgaataatttttgtatttttttgttaagacagggtttcggcatgttgtccaggctggtcttgaactccagagctgaagtgatccacccaccttggcttcccaaagtgttgggattacaggcatgagccactgcactcggcctaattttttttttttctgaagagatgaggtcttgctatgttgcccagtccagtctcaaacttctggctcaagcagtcctcccgccttggccttccaaagtgctgggattacagatgtgagccaccacactggcccattctttcttttatactgagtattcagaatttttttaaaatgtgttttccacttacagcatttctcaggttggactagccatctttcaagtgctcagcagccacatgtggcaagtggctgccttattggacagcacagctctggagggtgattttatgtacatccccactgctctctctgcctcctttattcccatctaccccacacccctgcagtctgtgactatcgtgtccctctctcctctctttctgtctcttgtaattctttaatatggagaattatttccaattccttaacatcctgcgctgatttttttctgtcttacattcaagggtcacagttttcctctcaccctcatttcagtcttttcccataacacgtgacgtgcctttttgtcttggttgggtatttatttgcaatacaagaatgattgttttctttgatacattagtgacttacatagttttcatgttttttgagtacctctttcttgacagaatttcaaattaattctagcgttaaactagaaatctttttttttttttttgagacacagtcttcctatggcaaccagtctggagtgcagtggtgcaatctcagctcactacaacctctgccttccagattcaagtgattctcctgcctcagcctcccgagtacccgggattacagatgtgcaccaccatgcctggctaatttttgtctttttagtagagacagttttttgccattttggctaggctggtcttgaactcctgacctcaagtgatctgcctgcctcagcttcccaaagtgctgggattacaggggtgagccactgtgcccaacctagaaagcttattttattttattattataattaattttatttttttgagatggagtctcgctctgttgcccaggctggagtgcagtggcgcaatctctgctcactgcaagctccacctcccaggttcacgccattctcctccctcagcctcctgagtagctgtgactacaggcgcccgccaccacacctggctaattttttgtatttttcatggagacagggtttcaccatgttagccaggatggtctcaatttcctgacctcgtgatccacccgccgtggcctcccaaagtgctgggattacaggcgtgagccaccgcgcctggcctataattaatttttttgagatggagtcttactctgtctcccaggctggagtacagtggcacatcttggacccctgcaacctctgcctcctgggttcaagcagttctctctacctcagcctctccagtagctgggattacaggtgcccaccaccatgcccagctaatttttgtatttttagtagagatggggtttcaccatgttggccaggctggtctcgaacccctgacctcaggtgatacgcccgcctcggcctcccaaagtgtgagattacaggcatcagccactgcacccggccagaaagcttattttaaaagattcacaggctgctccctagaatactgaagaagaaactctaggagtgagacccaacaatctgtatttaacaagtccccaggcccctggatcctcctggaatccccgatccctcttgctccctggcagagttttctagtccctcttacttgaagcatgtctttcagagcccggcaccacccatcttgagtatctggtgagttctgtggtctgcatgtccatgtttgggacattctgggaagggtggcccaggctgtgatttgccatctactgcaggctatggatggtattcagaagggaggggagatgctgtgtgcgtgttctgaagggtttcccactaaacagatcaaccctctccataactatttgatttttactttatctcctcgttgacttcacagtgtcagtgcagtttgtgtaaacatctctatggggtgatgcatgcagataaatgtttatgtgaacatataaagtctgcatgtgtgggtgaacactccacatcaggtcattgtccatcattacatatctgtggtgtctggctcattcgtctcgttttctgtcattttacctacttttacctgaagtacaatgactatttaataactattaaatgtttcatttcagctacacctctatggtatttttttcacctcatatcataccttcctccctcactggacttcagtgtgggacctgcaggtctcaggccttctgggaagtcccagcttttcttgaatgttttctctctctggccagctcaggctggagcagtgggtgttggtgccatcctgtggctataggtgataagccggctgttcttcactgacctggtcttaccttgaaccctggagttctcacatgcatggatttaaatgctgtgtctttctaagggcacattatggccattttccttatctccctcccaaggggctgtttgctgtgtttattgactccctgtttaaaaaacatatatatatatatatatatagacgaattaggttgtaccccataaattgcatgtttgaaaaatatttcaaagaatagtttatttttttttgctgatttttatgtatcttctaaattgtatatatttatggggtataaaatgatgttgtgatttttcaatacagtgtggaatgagaatcaaattaacctatccgttacctcaagtacttgactttttttgtgatgagaaggctgtttatcactttcactcaccagctcctgctgtcttccatgctggggacaggaaaggctccacgcttgactttccctcctgttttcttatctgctgtcaacccctgaatgtaccctccaggattgccttctagaccttctacatctagctcgatcattgtgcacccaccttcctcccagggactgtccttagggagtgactttatgcacaaacttcacatgctcttcctgcctccttcatccccataagcccccatctcagccccatctgattatttcttccctgtctcatttcctgttatgctgttggttttctaacctgaagggtaacttcttactccttagttttttgccttaatttctaagtcataggctactttcaggctaaaagttttcctccagccatggttttagtctcattctataagtcttgctaggtagtttattcattggaaattttttgtttttgagacagagtctcgctctgtcacccaggctgtagtacagtggtgccatctcagctcactgcaacctccggttcccgggctcaagcagttctctttcctcagcctcctgagtagctgggattatgggtgcctgccaccacacccagctaatttttgtatttttagtagagacggcatttcaccatgtcagccaggttggtctcgaactcttgacctcaagtgatccgcccaccttggcctcccaaaatactgggattacaggggtgagtcaccacaccccaccccttggcactatatttaagtgatgatatttttggacactgaggtagcctcattccacaggtttagatctgaagcattttcactattgcttctttccatgtatttcctggtttgcaggtcagtttcttcttttaattcatcattgacacagtggtttatatggcttttaatttcaaaagattttttaaaatatctttttgccgatttttatctatgttaattttaactagacatgttccctggaaggacatcactagttttttttttttttttttcactctgtttataatttaggtggattttcacatctcaagccagctaagagtatgggaaataggactcgttaaagcacagatatcacacaagtgattcagattcacgagggtaatccagatgaaggtatatcattgtacctggcccgcatcactcagtaactgtcacctttgatttattgatttacttgagatggagtttggttctgtccccgaggccggagtgcaatggcgtgatctctgctcactacaacctctgcctcccaggttcagagtgattctcctgcctcagcctctttagctgggattacaggcacccaccaacatgcccagctaatttttgtatttttagtagagaggagctttcaccataatggccaggctggtcttgaacctcaaatgatctgcccaccttggcctcccaaagtgctaggattacaggctggagctacagagcccagcctgtcaccttgatttaaatgaatgcagctttcttggtgtcttgatgtttgtgaatttctgtggagtttgatactgctccttttgctgcttgtttttccagagtccccttatcacttgacgtgctgttatattatgtttgatttattacagataccccatcagcctgagtctcttaaaggcctttatacacatatgtctacacatagggatttggatgatctcgggatcccacatcctcgctgtcccctgtccccccgcaacatcccccaccaatacctttctgaagttttctagtccctcctttttgtttgtgctccttaaagcccagccccatgcctgactttggttcccagtgagcattgtacatttgtggatattaaatctttggcaaagtcatttacctgggctggaatagggctcttggctgattctttttcctaaacacccacccaatgggagaggctgatactcaacatgcaaaccttgtgttttatttctccaggcgaagggatgttggaagacattctggaaggggtggggtgtgaagatttacaaataatctttgaatatctgcttcatgataggtcttggaggtgccttgtgggtgtggctttggggggatggttacgaggaaattgtggatattaaggaagtcaggaaaggaaaagatcagtcacaattcaacaattcagagaaagctcctaagggactttctggctgcttgatgcccagaggccaggccctcacttcgtattaaggctcaggactgtggatagagaatttaaaggggcaccaaaaaaaacattaaaatagataaacatatttttaatggaatacctttaaaaatgcaaatcaatgcacaaagaaaacgccca

SEQ ID NO: 541 - DNA, 10952 bp, Homo sapiens; identical to SEQ ID NO: 540

SEQ ID NO: 542 - DNA, 333 bp, Homo sapiens
aattaaattaaaatttttttaaagtcatggaaaggatgaggagaccatgataccatggacaagagttggagaggcagaggccaggggttgggaaagtggcacacacagaagcatggctggaggacacaacagggaccctcatgaggcaacgagggaggaaagagatggtggcacgagaaggaagcacgactgcagctagagccagggagatggaaggaggagggtggaggagatggtggaagaaaggtccctgccagcgcagagaggagggagacctgcccgggcccttgcctggcacggtcctggccaggtacagttgggtaggaggtgaca

SEQ ID NO: 543 - DNA, 1437 bp, Homo sapiens
cgggaggtggaggttgcggtcagccgagatcgtgccactacaatccagcctgggtgacagagcaagacttcatctcaaaaaaataaaattaaattaaattaaaaaaaattagtccagttgttacccttggggaatttacagtttagctgggaccttgtgttccagagactcagagaaaggaagagcccattctttctggaaggagcataaatcagggagggcttcctggaggaagtgacatttgagggacgccttgaaggaaattattgatgatgaagagcaagagcattggagtcaaaactgggatcaaattccagctgtctggtgttcttgctgtgtgatcttgggtaaatgacctcccctcccaggacctcagcttataaaatgaagcatgccaccctatctccctgggctgttgtgagaatgaccttaaaggagaaactatatgtgaagtgctgttctggagtaatgaccgcagacacaggtatcactactatgttatttatttatttatttatttagcggcagggtcccgctccgtcacctaggctagagtgcagtgatgagatcacggctcactgcagcctcaacctcccaggctgaagcaatcctcccacttcagtctccctagtagctggcactacaggcatgtgccaccaaaccaggctaattttcttttttttattttttgacttaaaacaatacaaatgtattttcttaaaggtctgcggatcagaggtctaaaagtgtcaggaggtctgtgttccttctgggagcttcagagagaatctgtttccttgtctgtttcagcttctggaagctgcctgcatttcttggcacctcctcacgtcactatgacatctgcttccgttgtcacctcctgtgactgaccctgaccctcctgcctccctcttaaaaggaccctcgtgactccattgagcccacccagacaatccaggataaccaccccttctcaagatcctttacttaatctcacctgcaaagtcccttttgccatggaaggtcacctcttcacaggttcaggggattaagatgtggacatcaccgggggtcatgattctgattgctacagggtctgagaagctagagagtaagtgtgtccagtggtggagagaagccttgaatgccgagctaaggagcctggacttggcctttccttcaaaatagatgcatgacctgtcagcctctcaccacctcagctctgttaccctgatccaaatcgctatcacctcctgcttggaccattacagtagcctcctctctgggatcttcactgcccctacaccatactctcacctccaccagcaaccagagggatcctattaaaatcttttggccgggtgcggtggctcacgcctgtaatcccagcactttgggaggctgaggcgggtggatcaccaggtcaggagatcaaga

SEQ ID NO: 544 - DNA, 1437 bp, Homo sapiens; identical to SEQ ID NO: 543

SEQ ID NO: 545 - DNA, 1437 bp, Homo sapiens; identical to SEQ ID NO: 543

SEQ ID NO: 546 - DNA, 1437 bp, Homo sapiens; identical to SEQ ID NO: 543

SEQ ID NO: 547 - DNA, 1437 bp, Homo sapiens; identical to SEQ ID NO: 543

SEQ ID NO: 548 - DNA, 2401 bp, Homo sapiens
ggcaggtatatcgtcacccctgtccagcctgaagaagtcacagaagttgtatcttcctccctctacaacccttaggattaaaggttctcttataaaagggagcggggaaatgtcagaggcatgtgaaccagagtgactccatcttgaacaggagctgggtgaaataaggctgagacctatgggctgcattcccaggaggttaggtattctaagtcaaggataaggccgggaacggtggctcatgcctgtattcccagcactttgggaggccaaggtgggtggatcacctgaggtcaggagttcgagaccagcctggccaacatggtgaaaccctgtctctactaaaaatacaaaaattagccaagtgtggtggcagcgcctgtaatcccagctactcgggaggctgaggcataagaatcgcttgaacccgggaggtggaggttgcggtcagccgagatcgtgccactacaatccagcctgggtgacagagcaagacttcatctcaaaaaaataaaattaaattaaattaaaaaaaattagtccagttgttacccttggggaatttacagtttagctgggaccttgtgttccagagactcagagaaaggaagagcccattctttctggaaggagcataaatcagggagggcttcctggaggaagtgacatttgagggacgccttgaaggaaattattgatgatgaagagcaagagcattggagtcaaaactgggatcaaattccagctgtctggtgttcttgctgtgtgatcttgggtaaatgacctcccctcccaggacctcagcttataaaatgaagcatgccaccctatctccctgggctgttgtgagaatgaccttaaaggagaaactatatgtgaagtgctgttctggagtaatgaccgcagacacaggtatcactactatgttatttatttatttatttatttagcggcagggtcccgctccgtcacctaggctagagtgcagtgatgagatcacggctcactgcagcctcaacctcccaggctgaagcaatcctcccacttcagtctccctagtagctggcactacaggcatgtgccaccaaaccaggctaattttcttttttttatttttgtagagatggggtcttgctctgttgcccaggcaggtctccagcttctgggctcaagggatcctcccgactgggcctccgaaagtgctgggatcacaggcgtgagccaccatgcctggcctaccatgtaatttaaaagatctgagcaggtagagttcaaaagtaaattctagaacagcattttgtaacagaaatctctgttatgatggcaatgttctatagctgtgctgtcgaatatggcagtcaccagccatatgtggctactgagcacttgaactatggccagtgtgcccgaggaactaaatttgaaatgaaaatttattctttctttctttttttttttgagatggagtctcattctgacatccaggctggagtgcagcggtgtgatctaagctcactgcaaactccacttcccgggctcaagcaatctacctgctttaaggaggattgaagcagaaggattcaagcaactccctcctcagtagctggaactacaggcacgccccaccacgtctggctaatttttgtatttttttgacttaaaacaatacaaatgtattttcttaaaggtctgcggatcagaggtctaaaagtgtcaggaggtctgtgttccttctgggagcttcagagagaatctgtttccttgtctgtttcagcttctggaagctgcctgcatttcttggcacctcctcacgtcactatgacatctgcttccgttgtcacctcctgtgactgaccctgaccctcctgcctccctcttaaaaggaccctcgtgactccattgagcccacccagacaatccaggataaccaccccttctcaagatcctttacttaatctcacctgcaaagtcccttttgccatggaaggtcacctcttcacaggttcaggggattaagatgtggacatcaccgggggtcatgattctgattgctacagggtctgagaagctagagagtaagtgtgtccagtggtggagagaagccttgaatgccgagctaaggagcctggacttggcctttccttcaaaatagatgcatgacctgtcagcctctcaccacctcagctctgttaccctgatccaaatcgctatcacctcctgcttggaccattacagtagcctcctctctgggatcttcactgcccctacaccatactctcacctccaccagcaaccagagggatcctattaaaatcttttggccgggtgcggtggctcacgcctgtaatcccagcactttgggaggctgaggcgggtggatcaccaggtcaggagatcaaga

SEQ ID NO: 549 - DNA, 2401 bp, Homo sapiens; identical to SEQ ID NO: 548

SEQ ID NO: 550 - DNA, 2146 bp, Homo sapiens
gaaattaaaacaaattgagtgtgagagagattattaagactgtccaagccaagtcactgaagtcataaatttaagttatgacaggatgccgagcttccagagggttttgtttttaacaagggaggggccctatttccccttctgacacgctcatatgaacttctcactttgtcgtactccttccttgctgactaagaggaacagaacacagagcagcctggcggtgtcctaccaacaagcctccgtttctccttcctgtacactagggctcctgaaactcacctgatgaagtctccgtctgtcacccaggctggagtgtaatggagcaatctcggctcactgcaacctctgcctcccaggttcaagcgattctcttgcctcagcctcccgagtagctggaattataggtgcatgccaccacgctcggctaattttttgtatttttagtaaagacggagtttcaccatgttggtcaggatggtctccgtctcttgacctcgagatcagcccgcctcggcctcccaaagtgctgggattacaggcgtgagccactgtgcccggccttggtttctaaatactattttgaagtatctgtggagaaatggttacttcgagggctggggcaggaatatataagataacattggaacaaattctgacgccagaacatgaagaaatatttgaaaaaggatggggcatattgactgaacacagaagacaaacatgcatgacctcagcctaatcgtgagaaaacatcaaagaaatccaaattgataaacattctgtaaaataattggccatgctcagcaaaagtgtcacaatcacaaaagacaagggaagaataagaaacggtcacagcctggaggaatctaaggacataacaactgagtgcaatgtgagatcctcgattcgatcttggagaagaaagaggacgttaagagaaatattgacaaaattcaaataaggtctgcacattaggtaatggtaagatacgttgacatcaatttcctggttggatacttgtattacatatactattatgtatataattattatattacaattacatatacagttgtatattatatataatacaataaatgtatatatatgattataatacaataaatgtatatatacagttttatatataacaactattatacatataatacaattatatatatagctaacatcaggataggctggttgaggatttatatgaatctttgctaattttgcatgtttaaaattatttcaacataaaaaaattatatgggtcatgtagttttttgtgcagtttaattctaggcaccatagtttctgttttaatgggtgtattttcttctttcaaggaattgggatagtctgttgtattaaaaacctattcatttttgtacattaagattcttctggccaggcgcaatggctcaagcctataatcccagcacttgggaacctgaggcaggcagatcacctgaggtcaggagttcaagaccagcatgtccaacatggtgaaaccccatctctactaaaaatacaaaaaaaattagccaggcatggtggcacatgcctgtaatcccagctacttgggaggctgaggaggagactcactagaactcaggaagcagaggttgcagtgagccaagactgcgccactgcactctggcctaagcaacagagggagactccatctcaaaaaaaaaaaaagattatttctctaacttactggtttatcttttatagcttatttcaggtgatttgttgtgtttgtctatagagtaaaataacatgtctaatgagttataatttaatgtccttccattcaatcactgtatttcaaatttattccaatattttggaataagcttccaatattttaacttaaatagggaaggtcatacttggtattttcctgacctcagctggaatgccttcatagtgttcacatgaacacatttggcctgagagagacttattatgccgagaatgtgtgtaaccctttttacttaggaattgtgggtggagtttttccccccgcccaagaatgattgttaatttccgtccatcattttcctttgattgttcttcatctcgaaaacaaataataaaataataaaataaataaataaaacttactggtctt

SEQ ID NO: 551 - DNA, 2146 bp, Homo sapiens; identical to SEQ ID NO: 550

SEQ ID NO: 552 - DNA, 2146 bp, Homo sapiens; identical to SEQ ID NO: 550

SEQ ID NO: 553 - DNA, 2146 bp, Homo sapiens; identical to SEQ ID NO: 550

SEQ ID NO: 554 - DNA, 2146 bp, Homo sapiens; identical to SEQ ID NO: 550

SEQ ID NO: 555 - DNA, 6262 bp, Homo sapiens
ggcaacgccggaactcccggaactcccgtggcccgcgcctcccctcgctcggcgcccctcacgccacgacctccattcccggctctcctcgcggcgcggctgggtcgttgccaaggcgataagggagggcgccgctagctcctgaagcgggacgtgaactacatttcccataaggagcctcgacgtggggccgttcagacttggccaatggcggcccaggaacgggaacgttcgggcgggccctgcgtggggcggggcttccggcgtcggctttcggcgctggctttggggcggtttgcggcagtgggatcattgggcggtgggcggtgtggaggagtctccgctggtccgcagaaacgaacgaaggcgcgagaatcgggaagttctgcctcagtgacctgtacgcgtcctagccgcagtgaatgttgctgaaccccggtgacctcacagtggaggggcggccccatggggccatcggaccgcgccgcgcgggggcgttcgccagggcctccgcagaagcccgcctgtgcccgcaaccgccccgaaattctctccctggcaccgtgtccgctttacggagcccggagcaaggctcagaaaaatgtcccagccaaaaacatgtcgctgttggtcgtggcactgaggcccagatcatgccacctcctctaacaagtggctgagtggacaccccacacattctacccaagggccgtgagtggccaagatcggggctcagaagtctctgaatcttcacagctggtcacgttcagctcggtcacttcctgtaagattccaggcactgcatgcactgacatgggtgcgtgtgggcccactgggtcctgcctgggagccttccctgaatgttcattttttgcaggtctgtgtttgtcttggagtaaggattattctcgcttgctggggtcatggtgttttggcctctcctggcctggactctcaaaaactcatcatccttcataggtctgaaggcttctacattcccaccagcaggtggaccatatgaactcaaaactagttgtggcagagggaccctgaagagatctacccctggtgaatgcccccaggagtgggctgttctcacacctggtgcccagcctgtgccctcgcaggtcttggtgcctccactcagctcaattccagttttctggccatgccccgctgtgtccctttctctctccttagtgcctagctgtgcaatgtttgcctctccttaacatgtcctcagctgaccccatatcctcagtccttgcaaccctgttcctcagtgacacctgtgtattctctccagtggagacacaggtgggacacccccaagctcatggtacatgcctgtcatcagtacccctggactgtcatggtgggtcagtctgccctaggctggactgaccaacctgttcattcccccacaggattgccctttacagttcatgagttcccccaactggagtgcagacaagagcactgattgatggaccaggtagacttgaaaccaggaatagcacaaaagttatcaaagaggctcagccatggagattgcaagctggggatggaagtatccctggaattgagctgttctcacacctggtacctgagttatacccctggtgtctgggtaccaaggtcactagccttgccacttttctatgttcctgatcccctactaaacagtccaccttttcgcctacttcccctgactcctgtaccctgtcccctctttctgcctagtttgaagacactggtcatcccataacatgtcctgggctaatacatatcctcaaatcgttcttgaaaatctgttcctcttccctcctccccctccccctccccccccccccgctctttccacggtctccctctgatgccgagccgaagctggacggtactgctgccatctcggctcactgcaacctccctgcctgattctcttgcctcagcctgccgagtgcctgcgattgcaggcgcgtgccgccacgcctgactggttttcgtattttttttggtggagacggggtttcgctgtgttggccgggctggtctccagctcctaaccacgagtgatccgccagcctcggcctcccgaggtgccgggattgcagacggagtctcgttcattcagtgctcaatggtgtccaggctggagtgcagtggcgtgatctcggctcgctacaacctccacctcccagcaacccgccttggcctcccaaagtgccgagattgcagcctctgcccggcggccaccccgtctgggaagtgaggagcgtctccgcctggccgcccatcatctgggatgtgaggagcccctctgcctggctgcccagtctggaaagtgaggagcgtctctgcccggccgccatcccatctaggaagtgaggagcgcctcttcccggccgccatcacatctgggaagtgaggagcgtctctgcccggccgcccatcgtctgagatgtggggagcatctctgccctgccgccccgtccgggatgtgaggagcgtctctgcccggccgccccgtctgagaagtgaggagaccctctgcctggcaactgccccgtctgagaagtgaggagcccctccgcccggcagccgccccgtctgagaagtgaggagcccctccgcccagcagccaccccgtctgggaagtgaggagcatctccgcccggcagccgccccgtctgagaagtgaggagcctctccgcccagcagccacctcgtccgggagggaggtgggggggtcagccccccgcccggccagccgccccgtccgggagggaggtggggggatcagtcccccacccggccagccgccctgtccgggagatgaggggcgcctctgcccggccgcccctactgggaagtgaggagcccttctgcccggccagccgctccgtccgggagggaggtgggggggtcagccccccgcccggccagccgccctgtccggaagggaggtgggggggtcagccccccgcgcggccagccgacccgtccgggagggaggtgggggggtcagccccctgcccggccagccgccccgtccgggaggtgcggggcgcctctgcccggccgcccctactgggaagtgaggagcccctctgcccggccagccgccccatctgggagggaggtgggggggtcagccccccgccctgccagccgccctgtccgggagggaggtgggggggtcagccccccgcctggccagccaccccgtccgggaggtgaggggcgcctctgcccggccgcccctactgggaagtgaggagcccctctgcctggccagccgccccgtccaggagggaggtgggggggggggtcagccccccgcctggcgagccgccctgtccgggaggtgaggggcgcctctgcccggccgcccctactgggaaatgaggagcccctctgcccggccaccaccccatctgggaggtgtacccaacagctcgttgagaacgggccatgatgacaatggcggttttgtggaatagaaaggggggaaagatggggaaaagattgagaaatcggatggttgccgtgtctgtgtagaaagaggtagacgtgggagacttttcattttgttctgtactaagaaaaattcttctgccttgggatcctgttgatctgtgaccttacccccaaccctgtgctctctgaaacatgtgctgtatccactcagggttgaatggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctcccctattgtcctgtgaccctgccaaatccccctctacgagaaacacccaagaatgatcaataaaaaaaaaagaaaaaaaaaaaatctgttcctctgtgagatgggcctgatctctcccacgggtggagcagaggagtagagggtccagggcctgagtctcccataggctaagtatttgccctgagtcataaagccagtgggaggcagtgctacagtttgattccaggaagtctcagaccaaagttctctcttaaccacttacctttcctgggcttaatagttagttcatttatgtttttcctggcactacttcattggacctcattttagtttcttcttttttttttttttttttgagacggagttgctctgacacccaggctggagtgcagtgccacgatctcacagtaacctccgcctcccgggttcaagcaattctgtctcagcctcacgaatagctgggacgacaagcgcgtgccaccacacccggctaatttttgtatttttagtagagttggggtttcaccattttggccaggatggtctccatctcctgacctcgtgatccgccccgctcagcctcccaaaatgctgggattacaggcatgagctaccgcacccggcccatttgttaacattgtaaaatgaatattagtacattattattaatgtacattatatgggttttcacaaatgcataaattcatgtatccaccattacaatatagtacaaaatacttttactgcccccaaaaattacttgtgctactattcattcctccctccctccctccctccctcccactgagtccctggcagtcactgctttactgtctctatagctttaccttttccagaatgtcataaacttgtaatcatacagtatgtagctttttcagtctggcttctgtcacttaccaatgtgcatttcagactcctccatgcctttcataacttggtagcacagttaattttattgctgaatgatattccattgtgtggatgtaacacagattagccatttatctattgaaggacatctgggttgattcaagttttgagcaattatgaataaagctgctataataatttgtgtggttttcgcatggacataagttctcaactcatttgtgcaaatacccaggagtgtgattgctgtatcatatggtaagactatatttaactttctgtaagaaactgccaaactgtcttccaaagtggctataccattttgcctttctatcagcagtaaacgagagttcccattgcctcacaaccttgctagcatatggtgctatcagtgttttgcattgtagccattctaatagatgtatagtagtatctcattattgtttcaatttgcagttccctaatggcatatgatgtggagcatattttcatgtgcctatttgccagctatgtatctatttttcttaggtgaggggtctattcagacctacggcctttttttttttttttttttttttttgagacgcagtttcgctcttgttgcccaggctggagtgcaatggtgcaatctcggctcgccgcaacctccgcctcccgagttcaagcgattctcctgcctgtcagcctcccgaggagctgggataacaggcatgtgccaccacgcccagctaattttgtatttttagtacagatggggtttctccatgttggtcaggctggtctcgaactcctgacctcaggtgatccgcccacctcagcctcccaaagtggtgggattacaggcgtgagccaccgcgcccagccttgaattgtacactcaaaatgggcaaattatatggtatgtaaattgttttttaaaaaaatctgttatgttttgaaagaacaagtagatgtctgggagattctttggagaagtacttaatgtgaaattttccacaacgataaaaatgaaagcacccatccccctggtggggggacacagatcacaggtagcttgtggcccctcttgggcacttcttctcccaccaccctctgctccttctgcagaggcttacagagcagaggaaaccccaacctagggcgagactcccagctttgccacgccaagccgggccccaggggagccagtgcgaactctagcctactccctgggatgagaggacctcagcactaaccaggtctgcaagtgggtgtggggttagagtggatcaactatgtgatcctatcaacctacgttcgaatttgactgcatttaaaaaaacactttacccccccaaacggagtctctcgctctgtcgcccgggctggagtgcagtggcgcgatttcggctcactgaagcctccgcctcccggcttcaagcgattctcctgcctcagcctcccgagtggttgggactacaggcgcccgc

SEQ ID NO: 556 - DNA, 3565 bp, Homo sapiens
gtcgggagcagatcgggtaataaaatgtattttgagaataagacggccttttcaccttttagggtctagggctgtaaagcgtctcagggttgctgccaaacaggtcatgaactgggctggatttttatatttgatgaaaaagagcctaaacgctatctgatttgggataaagaaaaaggagcattcaccttgactatgcctttggctccagccacctttttaagagtaaactgctgggcaggtgggggagggctagtcacagaacgaaactgtaagccagaccaggtgtgaggggggaggtgataaaaggattacaaggtggaggaacggaggctgagaaagaattgggacctagctcggcctggcgaggagcagcctggggaggaagggagaggtcagatgggtctgtagaaaaggaagattagaaagactcagcgacgcttggggttggtactgaggggacaggcgggagggaaagaaggaagatttgggacaagttgcactgggcacagggactaggaagggactgagtgtgtaaaagaatgcctggagtcaggcacctcagaccatttgcctattttatgacaagaattatttagattttgcaggttggaaaaattcaaagtgccattttctggctatttggaactactgtcgagtttgtattggggtcaagcggcattgcagaagaaaataaggcatttaggttttaggtcaggtgtgagttgaagaggtttttaatttttgagaacacaggctaagggagaagaaggaggaatggaaggtggaaacttacccatagtgaaggaggcaagcccagagaaaagagtagagacacagagaaggggttgtgggggggtgcggttcttgccctccagaaaagcagagaaggggttggggcatggaaataagggattggggcacagacataagaggtcagggtgcagaaataagggattggggcacagagataagaggttggggtgtggaaataagggattggggcacagagataagaggttgggatgtggtaataagcgattagggggttcttgccccctaggaaagcgggacttgctactaagggtgaaggagaaggggctgaggggtacttgcccctgccccagaaaagcaggacttgccactaagggtgaaggagaaggggttgaggggtacttgcccctgccccagaaaagcaggacttgccactaagggtgaaggagaaggggttgaggggtacttgcccctcccccagaaaagcaggacttgccactaagggtgaaggagaaggggttgaggggtacttgcccctgccccagaaaagcaggacttgccactaagggtgaaggagaaggggttgaggggtacttgcccctcccccagaaaagcaggacttgccactaagggtgaaggagaaggggttgaggggtacttgcccctcccccagaaaagcaggacttgccactaagggtgaaggagaagcggttgaggggtacttgcccctgccccagaaaagcaggacttgccactaagggtgaaggagaaggggttgaggggtacttgcccctctcccagaaaagcagagaaggggtagagacaaggagagaaggggttggggtacttgcccttccccagaaaagcaggacttgccgctaagggtgaaggaccaaggcaggcgtccctgcgtggtctgacacccttgaaacatgagtgtataatcagaggcgtccctgcaatgattaaacaccaagggaaggctgccttcccagtccatgaccggcgccggagttttgggtccacggataaaacgtgtctcctttgtctctaccagaaaatgaaaggaattgaaattaagagaagggagaaattgaagtgtggcaccaagattgaaaggagaaagaggttgagggatagtgagggaggttggagaagagagtaaaaagaggccgcttgccggatttgaaattggtgagatgtttcttgggctggtcactctgaggacctgaggtcgtaggtggatctttctcatggagcaaagaacaggaggacaggggattgatctcccaagggaggtcccccgatccgagtcacggcaccaaatctcatgcgcgtccgtatgaagagaccaccaaacaggctttgtggagaagatgtcgaagacacaggagaagacaagccagggagaggggcttagagcagattctcccttgcagcctcagaaggaatcagtcctggtcacaccttgatctcagacttctggcctccagaatggtagcagcagcaaaaatggcaaaatgaggacttttgagaattcctttctctatggaaacaaaaccctgggggaaaatggtctgaatcaaccttttcagaactctggaaattagcccgagacttgaagcaattcaggttgcatttgtataagaaaagtgacagaatctcagtaagaacagcaagctttgaaggatttgaacttgcccagttgccttccttctttctccatctctgcaggggacttaaaaccaacatcccacactcataatgaaaacctggcaggaggcagaacaggattggagctgcttcaaagccttaggtccagagaactcatcacctatgcagatcctcaataagactcaaagctgattccgcctcagaaaccatggagacccaaagccaaattcaaagtgctgaaagttaactcatccaatcagtcaactcttgtacagacctcctttttttttgttcttggagtttgttttattctaataaaggtgttttatattgttgttgtattattcttaaataccatattttagttgctattataaatggtacttctattgccgttttgtctaacattttctggtggtcaaatttctagctagtgtggaagaacactgatggtttttacttattgattttctctctggcaatctcactaaaccttatgataagtaataaaccttatgatagtagaaaaggttgatatgatatgatagtagtaatcctctggattacccatcccctcttgataatctctgttgaaataatcacattatgtgcaactaatgacaatgtcactgctcttatagtctctatgtgcatttctttttcttgtcttactgctttgactcattcagttgactgccattcacagaacagatgtggaacggttgttttcgttatcatgtgcctaaaaagaatgtgattaaaatttgccagttcaatataatattggatgtagggttttaataaataactttcaacaaactgcaagagtcatcttccctttctagtattctaatggcactggttttttaaaaataataaattggtattgaagttgtcttatgcttttttctgtatccatttccattaagataattatttggattttttctacttttcattatatgatatattgaataattatattttctgaggctgaactctccttgaatctctgttacaaatgctgcttgtcatgagatactatttttcatgctgtcgttaaattagtaaattaatttttatttaggatcttaaatctacatatgtaagtaaaact

SEQ ID NO: 557 - DNA, 1898 bp, Homo sapiens
tagtagattaattatttcaataaaacaataaaatttctatgagagggtaaatggcataacaatacactccttctcaagtgcagaacttgaaaacaccattcccaagcagaatataaatgcattttttggtgtattattctctgatatttcctcttttgaatagcagagaaagaagtatgtgtgtggcactgtggttaaatatggaatgcaggctctaaaggattccttttcctctgaaagtcttaacaggcgcctcacctttctctggttttccttctagtctcatgcaaagactaaacaacaacaatcaactcgataaaatagtgtccataggccagcttaggttaggctggttgcatggaaagaatgtgactgggaattcatatcctagagtcaagccagaaacttaatgattaaacaaatcacttccttgaacgcagtctttttccaaggttctgttagccatactctcaggaagctgtgaagtagggagatctacgtgggggtctctttgtactgagactcatcagcatctcggaaagcagaagggcctgaattattgcaggcacaagtgggaggctgggacagcatttctgacttcctggtagcagcagcaaaaatggcaaaatgaggacttttgagaattcctttctctatggaaacaaaaccctgggggaaaatggtctgaatcaaccttttcagaactctggaaattagcccgagacttgaagcaattcaggttgcatttgtataagaaaagtgacagaatctcagtaagaacagcaagctttgaaggatttgaacttgcccagttgccttccttctttctccatctctgcaggggacttaaaaccaacatcccacactcataatgaaaacctggcaggaggcagaacaggattggagctgcttcaaagccttaggtccagagaactcatcacctatgcagatcctcaataagactcaaagctgattccgcctcagaaaccatggagacccaaagccaaattcaaagtgctgaaagttaactcatccaatcagtcaactcttgtacagacctcctttttttttgttcttggagtttgttttattctaataaaggtgttttatattgttgttgtattattcttaaataccatattttagttgctattataaatggtacttctattgccgttttgtctaacattttctggtggtcaaatttctagctagtgtggaagaacactgatggtttttacttattgattttctctctggcaatctcactaaaccttatgataagtaataaaccttatgatagtagaaaaggttgatatgatatgatagtagtaatcctctggattacccatcccctcttgataatctctgttgaaataatcacattatgtgcaactaatgacaatgtcactgctcttatagtctctatgtgcatttctttttcttgtcttactgctttgactcattcagttgactgccattcacagaacagatgtggaacggttgttttcgttatcatgtgcctaaaaagaatgtgattaaaatttgccagttcaatataatattggatgtagggttttaataaataactttcaacaaactgcaagagtcatcttccctttctagtattctaatggcactggttttttaaaaataataaattggtattgaagttgtcttatgcttttttctgtatccatttccattaagataattatttggattttttctacttttcattatatgatatattgaataattatattttctgaggctgaactctccttgaatctctgttacaaatgctgcttgtcatgagatactatttttcatgctgtcgttaaattagtaaattaatttttatttaggatcttaaatctacatatgtaagtaaaact

SEQ ID NO: 558 - DNA, 2063 bp, Homo sapiens
gtatgtatggaatacccatttgctttctatagtcttcaaggtccttttcccttacgtaaaacaccaagcctaaatcttacattcagctttttagaaggcagaacaagcagccattgagctcttgctgtgggactgaccccgccttctgcctgatgtcagtggggatactgcttaccttccttcctgcaaggaaatccacacactcttatttcatccggcctggggaggaggggaaagaggaagtcacctgtgaaattgtctttgcgctttggactcaagcccccagcaaagaaaacacttctatgctcccagcaagactcacctggccatgcctaagtcaacaccctcaagaggcagtagatgagtgaacatgtaagtgctgtcagcctccagggatggataaggcttgcttcctctgactgcatgtctgcctggaaaatgggaggacagtgagttttaggcggacaaccaaaattgttatctacaagaagtttacagacatggaggttcacaaacaagaagctcatacccagtcttgacatataaaaagaggtgggaataagtgttattatcatgatgaaatcaacgtgctgctgcgagggagactaattcaggccaaggtccaggtgacatctgagctgcagatttcatattaaaggtgacatcttagttgcgccttaatttaaaaagaatatgattttgactgctggataaaggggaaaagaccggggaaggcaaatagatgaccacattgctcatggagaaagtgattcttttcaagtgactcattcaaaatggctgctgcatagcacatgatgagaaatgcctgtgacagatgaggcagaagaaatgacctctttagcatgatggttacttgaactcaggagaaccaggaacacctttgtttggtggtgaacttcatcttgaaatctttggccttagcagcctacagatgctgagtgattgttaaatggacaagtgtatttgcagggaaattcaattcctgttttaaaattacttattcctcccatctgacaagggattcataaccagaatatacaaggagctcaaacaactctatagggaaaaaaatctaagaatctgatcaaaatgggcaaaagttctggatagacatttcttaaaagaagacatacaagtggcctatgaagaggttctcaacatcgtgtatcactagagaaatgcaaatataaactgcaatgaaatatcatctcattctggttaaaatggcctgtatccaaaagacacgcaatagcaaatgctggtgaggatgtggagaaaagggatcacgtgtacactgtgggaatgtaaattagtacaaccaccatgaagatcagtttgtaggttcctcaaaaaaactaaaaattgagctaccatatgatccagcaatcccactgtggggcatatactcgaaagaaaggaaatcagtgagtcaaagagatatctgcacttctacgttgcaacactgtttataataactaagatttagaagcaatgtaagtgttcatcaaccaatgaatgggtaaagaaaatgtggtacagatacacagtggagtactattcagccataaaaaaggagatcctgtcatttgcaacaacatgggtggaactggagatcattacattaagcaaaataaacctggaacagaaagacaaacatcacatgttctcacctatttgtgggatctaaaaatcaaaacaattgaactcatggacatagagagtggaaggatggttaccagaggctgggaagggtggtggggggctggaggggaggcagggatggttaatgggtacaaaaaaatagaaagaataaataagacttactatttgatagcacaacacagtgactattaaatagtagcttaattgcacattttaaaataaagagtgtaattggattgtttataactcaaaggataaacgcttgaggggatagatacctcattctccatgatgtgctcatttcacattgcatgcatgtatcaaaacatctcatgtgtgccataaatacatctacgatgtacccacaaaaatttttaaaa

SEQ ID NO: 559 - DNA, 4360 bp, Homo sapiens
ccctcggggttaaagagcctcctcgaggaagaggctgggacacagctgaaagagattgacccacaaccactctaggggccatcacctgcccttcttcagtcctgggcgtgaaggtagatttctcccctagcctgtgcgggagaggagccctggtttttctaacaaggactactgtaggttcgccgagttcgagggacgctacgtatgcagcgcctacgcccggacacaggcttccgcgttaccgacaccgcgtgggggaggagggcaagacccgaggcttgcagagatggggggtgcacggtggccacagtagggaaggtgcggagcatgatggtgctctgtaggagcgcagacgctgaaaggcgcgctgctgtggctgggagaagagcggagccaggagtttgttcccaatatcttagtgctatggcaaaagaagggggaggagtaattgtggggccccccacacacccgctgcggcgatacactcaccctcgccaaagtccttccggaagtctaagttcgaagatggcgccgcctgtctggtcgcggtcttatgacgaaatcttgttagctgctcttcactgacgcccccaccccagtgcacaaggcgcggccagagtcaccgagccctccgaagccagccgagttccagggcgtcttcagcggcgccagggacgctgcagggcctcatgggagttgcagtgtcaaaaaggggagatcgacgcctgcgcggccaacgggatcccacgcggcctcgacgggagccgggagtaggcggactcccaggccgggctcgcgctctggatccctgaatccggcctttccggccggactgccgcgcctgtggccggaagagccagctagaccagagagtctgtacctgcaaccctggcggcgtccgagcccaaggcggagtctgggagacaaagaagtcctcgccgccggccgctggaggattctgccagtagtgaagtcagggatgggcccgagagagcttggaaagaggacaaggaagggaaggagtaggagtagaaaagcatgactttggctggagatggggtctcgttatgttgaccaggctggtcttgaacacctgacctgaagtgatcctcttgcctcagcctcccatagtgctgcgatcacaggtgtaagtcactgagtttggccattattccatttctgtacacaaaaacctttctcattctgtgctataactagttagcatttaattgggtggatgtggtataactagtgccttgttgatattgatgcatatttacatggttttgctgttataaacaatggtcccttgctattataaatcacactgctataagtaaccttgcatctaaattacttcaaatgtgtaactatatgggtaggataatttctagaagtggaattgtgaaccaaagttttaggtgcatttgtaattttgatttataaccaatcttttcactgatctacttctctgcctctaatttctactaggtgtttgtttgtttgtttgtttgttttgagacagggtcttgctctgtcacccaggctggaggacagtggtgcaatcacggctcactgcagcctcaacctgccacctcagcctcctgaatagttggggtgtgtggcaggtgtataccaccacttccaggtttttttgttgttgttgtttaatagagatgaggtcttgctatattgcccaggcaggtctcacactactgagcgcaagcgatcctcctgcctatgcctcccaaagtgctgggattacaggtgtgagttgccatgcctggcccggttatctttctaaagcataaagcaaccctgttgatcctctgcttaattttgatgattaagtagtatgttcaaaatatagaaatccatgtattgataatgatcttttaaaaaaagtaaaagccaaaatatcagctactcatcctacaccattgaaagtagtgaccattaaactgctctacctctacctccacctctctacctctctacctctctacctctacctctacccacggtctccctctctttccatggtctccctctcatgtggagccgaagctggactgtactgctgccatctcggctcactgcaacctccctgcctgattctcctgcctcagcctgccgagtgcctgcgattgcaggcacgcgctgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcgctacaacctacacctcccagccgcctgccttggcctcccaaagtgccgagattgcagcctctgcccagccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagtgcctcttcccagccgccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccgccccgtctgagaagtgaggagccaccccatctgggaagtgaggagcatctccgcccggcagccaccccgtccgggagggaggtggggggtcagccccccgcccggccagccgccccgtccgggagggaggtgggggggtcagccccctgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctctgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactgttgtcccatgaccctgccaaatccccctctgtgagaaacacccaagaattagcaataaaaaaataaattaaaaaataaaaaaataaaaaaataaaaaaaactcattaagctctaaaaaaaaaaaaaaaaaagaaagaaaaaaagaaagtagtgaccaattcctgaaaattggcaaaaaaaaaaaaaaggcaagagtaaggcatttatcttgtctttccagtatgaactctagttcaaaataactgatgagaggaaggttttgtttgttttttgagactgagtctcactctgtcgcccaggctggagtgcagtggcgcgatctcggctcactgcaacctctgcctcccaggttcaagcaattcttgtgcctcagcctcctgagtagctgggattacaggcgcccgccaccactcccggctaatttttgtatttttttagtagagacggggtttcaccatgttggcgaggctggtcttgaactcctgacctcaggtgatccgcacacctaagcctcccaacgtgctgggattacgggtgtgagccattgcccagcccgggatttttttttttttttatagattaacagctagtaattgtgcaaagaatgatagaaaaaaatcactattttgcatgtcccagtgaaataattcaggcaacaatcaccagtggatgaaatccctaaagagcttttaggaagctttaaaatgcctggacccactcatcactgaacatgaaaccaccagtcattgtttgcctcctgatgtgaggcaatataaagcacacagaaccacttattaaacattcttgcccaaaaaattgaataggaatacaggacttaggggccaggcgtggtggctcacacctgtaatcccagcactttgggaggccaaggagggcggataatctgaggtcaggagttcaagaccagcctggcc

SEQ ID NO: 560 - DNA, 4360 bp, Homo sapiens; identical to SEQ ID NO: 559

SEQ ID NO: 561 - DNA, 4284 bp, Homo sapiens
caaccctcggggttaaagagcctcctcgaggaagaggctgggacacagctgaaagagattgacccacaaccactctaggggccatcacctgcccttcttcagtcctgggcgtgaaggtagatttctcccctagcctgtgcgggagaggagccctggtttttctaacaaggactactgtaggttcgccgagttcgagggacgctacgtatgcagcgcctacgcccggacacaggcttccgcgttaccgacaccgcgtgggggaggagggcaagacccgaggcttgcagagatggggggtgcacggtggccacagtagggaaggtgcggagcatgatggtgctctgtaggagcgcagacgctgaaaggcgcgctgctgtggctgggagaagagcggagccaggagtttgttcccaatatcttagtgctatggcaaaagaagggggaggagtaattgtggggccccccacacacccgctgcggcgatacactcaccctcgccaaagtccttccggaagtctaagttcgaagatggcgccgcctgtctggtcgcggtcttatgacgaaatcttgttagctgctcttcactgacgcccccaccccagtgcacaagagcgcggccagagtcaccgagccctccgaagccagccgagttccagggcgtcttcagcggcgccagggacgctgcagggcctcatgggagttgcagtgtcaaaaaggggagatcgacgcctgcgcggccaacgggatcccacgcggcctcgacgggagccgggagtaggcggactcccaggccgggctcgcgctctggatccctgaatccggcctttccggccggactgccgcgcctgtggccggaagagccagctagaccagagagtctgtacctgcaaccctggcggcgtccgagcccaaggcggagtctgggagacaaagaagtcctcgccgccggccgctggaggattctgccagtagtgaaagatggggtctcgttatgttgaccaggctggtcttgaacacctgacctgaagtgatcctcttgcctcagcctcccatagtgctgcgatcacaggtgtaagtcactgagtttggccattattccatttctgtacacaaaaacctttctcattctgtgctataactagttagcatttaattgggtggatgtggtataactagtgccttgttgatattgatgcatatttacatggttttgctgttataaacaatggtcccttgctattataaatcacactgctataagtaaccttgcatctaaattacttcaaatgtgtaactatatgggtaggataatttctagaagtggaattgtgaaccaaagttttaggtgcatttgtaattttgatttataaccaatcttttcactgatctacttctctgcctctaatttctactaggtgtttgtttgtttgtttgtttgttttgagacagggtcttgctctgtcacccaggctggaggacagtggtgcaatcacggctcactgcagcctcaacctgccacctcagcctcctgaatagttggggtgtgtggcaggtgtataccaccacttccaggtttttttgttgttgttgtttaatagagatgaggtcttgctatattgcccaggcaggtctcacactactgagcgcaagcgatcctcctgcctatgcctcccaaagtgctgggattacaggtgtgagttgccatgcctggcccggttatctttctaaagcataaagcaaccctgttgatcctctgcttaattttgatgattaagtagtatgttcaaaatatagaaatccatgtattgataatgatcttttaaaaaaagtaaaagccaaaatatcagctactcatcctacaccattgaaagtagtgaccattaaactgctctacctctacctccacctctctacctctctacctctctacctctacctctacccacggtctccctctctttccatggtctccctctcatgtggagccgaagctggactgtactgctgccatctcggctcactgcaacctccctgcctgattctcctgcctcagcctgccgagtgcctgcgattgcaggcacgcgctgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcgctacaacctacacctcccagccgcctgccttggcctcccaaagtgccgagattgcagcctctgcccagccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagtgcctcttcccagccgccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccgccccgtctgagaagtgaggagccaccccatctgggaagtgaggagcatctccgcccggcagccaccccgtccgggagggaggtggggggtcagccccccgcccggccagccgccccgtccgggagggaggtgggggggtcagccccctgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctctgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactgttgtcccatgaccctgccaaatccccctctgtgagaaacacccaagaattagcaataaaaaaataaattaaaaaataaaaaaataaaaaaataaaaaaaactcattaagctctaaaaaaaaaaaaaaaaaagaaagaaaaaaagaaagtagtgaccaattcctgaaaattggcaaaaaaaaaaaaaaggcaagagtaaggcatttatcttgtctttccagtatgaactctagttcaaaataactgatgagaggaaggttttgtttgttttttgagactgagtctcactctgtcgcccaggctggagtgcagtggcgcgatctcggctcactgcaacctctgcctcccaggttcaagcaattcttgtgcctcagcctcctgagtagctgggattacaggcgcccgccaccactcccggctaatttttgtatttttttagtagagacggggtttcaccatgttggcgaggctggtcttgaactcctgacctcaggtgatccgcacacctaagcctcccaacgtgctgggattacgggtgtgagccattgcccagcccgggatttttttttttttttatagattaacagctagtaattgtgcaaagaatgatagaaaaaaatcactattttgcatgtcccagtgaaataattcaggcaacaatcaccagtggatgaaatccctaaagagcttttaggaagctttaaaatgcctggacccactcatcactgaacatgaaaccaccagtcattgtttgcctcctgatgtgaggcaatataaagcacacagaaccacttattaaacattcttgcccaaaaaattgaataggaatacaggacttaggggccaggcgtggtggctcacacctgtaatcccagcactttgggaggccaaggagggcggataatctgaggtcaggagttcaagaccagcctggcc

SEQ ID NO: 562 - DNA, 4284 bp, Homo sapiens; identical to SEQ ID NO: 561

SEQ ID NO: 563 - DNA, 7435 bp, Homo sapiens
cacccacctcggcctcccaatcaacttagttttaatagaaacaataactctttcatattaaaatttatttcccctgtcacccaggctggaatgcagtagtgcgatgatcatggctcactgcaccttgacctcctgggcccaagtgctcctccccatctcagcctctcaggtcactgggaccacatgcacacaccagcaggcctagctaatttttattttttttgtagagacagggtctcaactatcttactcagactggtctcaaattcctgggctcaagtgatcctctagcttcaacttccaaagtgctaggattacaggtttgagtcaccacacccagcctataacgtatgtataaagacaaagcaaaacattaaaaaaaaaaaaaaaaagggtgggagcctggacaacataacaaaatcctgtctcaacaacaacaacaaaaatgtttaattagctgggtgtggtggcaaatacctgtagctctagctattcgagaggctgaggcaggaggatcgcctgagcccaggagttcaaggttacagtgagctgtgatcatgccactcgactccagcctgggtgacagagcaagatcttgtctcaaaaaaagtgggaaccaatacaatgactcttggcaagcattcaactcaactagtggaagcagactgaccacgtctacaggagaaaaaccttcaagcttcaagcatttagagaggaaataagagtatgtcagttaacataaggagctaaatggaaatcagttaagagagcttctatacaagtcttaaggattttctaggccaagtgctgtgactcacgcctgtaatcccagcactttgggaggccaaggcagatggatcacttgaggtcaggagactagcctggccaacatggtgaaaccccatctctactaaaaatataaaaattagcccggcgtggtggcaggcgcctgtaatcccatctactcgggaggctgagacaggagaatcacttgaacccaagaggcagagggagaggttgcagtgagccgatatcacgccactgcactccagcctgagtgacagaggaagattccggttttttttaaaggattttctacatcagtatacatatatttatctcattcttcctaattgctgcatggcattccatagaattagttatttagacaatcttcatttaatgaacaaatgagttaaaatactatttcaaaaaatactgcaataaatattctagtacaaatctcttcattaattcatcaataaattatttttctcgaataatcatctgaacatggaattactgtactacactgaagaacatgcacatttcaaaatttgatactaccaaacggctcaccaaaattaaaactatttatgtatattagtacccattttatcataccgttactgatctttttaattttcgccaatctgataggtgaaagaattcttccccactctatttatttgcactgataataattggtgtcagcaacttctttctatatattggacatccatatgacttttatgaattgcctgtacatataatttgcctggccgggcacggtggctcacgcctgtaatcccagcactttaggaggccgaggtgggcggataacgaggtcacaagttcgagaccagcctgaccaacatggtaaaaccccgtctctactaaaaatacaaaagtagccgggcatggtggcacgcgcctgtaattccagctactcaggaggctgaggcaggagaatcgcttgaacccgggaggcggaggttgcagtgagccgagatcacgccactgcactccagcctgggcaacaagaacaaaactccgtatcaaaaaaaaaaaaaatacacttctcatggaaggcagcagcaggatgtaatggtacaaattctggatacacagtaaaggaatagatgatcagtaaattcgtactgagtttctaaaaccttccattgcaccccaatctgtctggttcccatgctgctccaggatgccagcttgacctccccagccaagaaaaaataatgacacaacactgcaccttaagtatgaaattactttgaatacactgcttagcttaatatattgtttcctaaagtgttcctagggtacaactggcggtatgcaagatgattttaatggtacgaaaacgaacattttaatgactagtgcttttatttcaacttacataaacaattataagtagcccatgaaacccacggtttcatttatattgcttaggtcgagactaatgcatttaaactttttaagtaagtcaatttaaagagaactattcagaaaacaatagtacaattgataagagattgcaaaaatagtgatggcacgggattgacttaaaattgtatatgcctctggaacaaagaggtttgtccataccctatacatccctccaacaaagtgagttgcctccgacggagttgaagtcgccacctctgacttccccaacaggcagccaacttgccacgggacaaaaggactagacagggaaacacaactggcccttggttacgccaatggcgttgcagcgcgcggggcacaaccctcggggttaaagagcctcctcgaggaagaggctgggacacagctgaaagagattgacccacaaccactctaggggccatcacctgcccttcttcagtcctgggcgtgaaggtagatttctcccctagcctgtgcgggagaggagccctggtttttctaacaaggactactgtaggttcgccgagttcgagggacgctacgtatgcagcgcctacgcccggacacaggcttccgcgttaccgacaccgcgtgggggaggagggcaagacccgaggcttgcagagatggggggtgcacggtggccacagtagggaaggtgcggagcatgatggtgctctgtaggagcgcagacgctgaaaggcgcgctgctgtggctgggagaagagcggagccaggagtttgttcccaatatcttagtgctatggcaaaagaagggggaggagtaattgtggggccccccacacacccgctgcggcgatacactcaccctcgccaaagtccttccggaagtctaagttcgaagatggcgccgcctgtctggtcgcggtcttatgacgaaatcttgttagctgctcttcactgacgcccccaccccagtgcacaaggtaaacacgtgtgcttggtccggagtcggtgccgggctagttttctcttagactctgtattccataatgcagcgcggccagagtcaccgagccctccgaagccagccgagttccagggcgtcttcagcggcgccagggacgctgcagggcctcatgggagttgcagtgtcaaaaaggggagatcgacgcctgcgcggccaacgggatcccacgcggcctcgacgggagccgggagtaggcggactcccaggccgggctcgcgctctggatccctgaatccggcctttccggccggactgccgcgcctgtggccggaagagccagctagaccagagagtctgtacctgcaaccctggcggcgtccgagcccaaggcggagtctgggagacaaagaagtcctcgccgccggccgctggaggattctgccagtagtgaagtcagggatgggcccgagagagcttggaaagaggacaaggaagggaaggagtaggagtagaaaagcatgactttggctgggtatggtagctcctgtctgtaatcccagcactttgggaggccaaggcgggggaggatcacttgagcccaggaattcgataccagcctgggcaacatagtgagaccccgtttttatttttatttttattttttcctgagatggagtcttgctctgtccccaggctggagtgcagtggcgcgatctcggctcactgcaaactccgcctcccgggttcaagcaattgtcctgcctcagcctcccgagtagctgagattacaggcgcccgccaccaagcccggataatttttgtctttttagtagagaaggggtttcactatgttggccaggctggtctcgaactcctgaccttgtgatacgcctgcctcagcctcccaaagtgctgggattacaggcatgagccaccgcgcccggcctaattttttaattttttctagagatggggtctcgttatgttgaccaggctggtcttgaacacctgacctgaagtgatcctcttgcctcagcctcccatagtgctgcgatcacaggtgtaagtcactgagtttggccattattccatttctgtacacaaaaacctttctcattctgtgctataactagttagcatttaattgggtggatgtggtataactagtgccttgttgatattgatgcatatttacatggttttgctgttataaacaatggtcccttgctattataaatcacactgctataagtaaccttgcatctaaattacttcaaatgtgtaactatatgggtaggataatttctagaagtggaattgtgaaccaaagttttaggtgcatttgtaattttgatttataaccaatcttttcactgatctacttctctgcctctaatttctactaggtgtttgtttgtttgtttgtttgttttgagacagggtcttgctctgtcacccaggctggaggacagtggtgcaatcacggctcactgcagcctcaacctgccacctcagcctcctgaatagttggggtgtgtggcaggtgtataccaccacttccaggtttttttgttgttgttgtttaatagagatgaggtcttgctatattgcccaggcaggtctcacactactgagcgcaagcgatcctcctgcctatgcctcccaaagtgctgggattacaggtgtgagttgccatgcctggcccggttatctttctaaagcataaagcaaccctgttgatcctctgcttaattttgatgattaagtagtatgttcaaaatatagaaatccatgtattgataatgatcttttaaaaaaagtaaaagccaaaatatcagctactcatcctacaccattgaaagtagtgaccattaaactgctctacctctacctccacctctctacctctctacctctctacctctacctctacccacggtctccctctctttccatggtctccctctcatgtggagccgaagctggactgtactgctgccatctcggctcactgcaacctccctgcctgattctcctgcctcagcctgccgagtgcctgcgattgcaggcacgcgctgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcgctacaacctacacctcccagccgcctgccttggcctcccaaagtgccgagattgcagcctctgcccagccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagtgcctcttcccagccgccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccgccccgtctgagaagtgaggagccaccccatctgggaagtgaggagcatctccgcccggcagccaccccgtccgggagggaggtggggggtcagccccccgcccggccagccgccccgtccgggagggaggtgggggggtcagccccctgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctctgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactgttgtcccatgaccctgccaaatccccctctgtgagaaacacccaagaattagcaataaaaaaataaattaaaaaataaaaaaataaaaaaataaaaaaaactcattaagctctaaaaaaaaaaaaaaaaaagaaagaaaaaaagaaagtagtgaccaattcctgaaaattggcaaaaaaaaaaaaaaggcaagagtaaggcatttatcttgtctttccagtatgaactctagttcaaaataactgatgagaggaaggttttgtttgttttttgagactgagtctcactctgtcgcccaggctggagtgcagtggcgcgatctcggctcactgcaacctctgcctcccaggttcaagcaattcttgtgcctcagcctcctgagtagctgggattacaggcgcccgccaccactcccggctaatttttgtatttttttagtagagacggggtttcaccatgttggcgaggctggtcttgaactcctgacctcaggtgatccgcacacctaagcctcccaacgtgctgggattacgggtgtgagccattgcccagcccgggatttttttttttttttatagattaacagctagtaattgtgcaaagaatgatagaaaaaaatcactattttgcatgtcccagtgaaataattcaggcaacaatcaccagtggatgaaatccctaaagagcttttaggaagctttaaaatgcctggacccactcatcactgaacatgaaaccaccagtcattgtttgcctcctgatgtgaggcaatataaagcacacagaaccacttattaaacattcttgcccaaaaaattgaataggaatacaggacttaggggccaggcgtggtggctcacacctgtaatcccagcactttgggaggccaaggagggcggataatctgaggtcaggagttcaagaccagcctggcc

SEQ ID NO: 564 - DNA, 7435 bp, Homo sapiens; identical to SEQ ID NO: 563

SEQ ID NO: 565 - DNA, 1445 bp, Homo sapiens
gggcccggcagctacatttacaatacaaacgttgtacatctgcccctctgatatggtttggctgtgttcccacacaaatctcaacttgaattgtgtctcccagaattcccacgtattgtgggagggacccaggaagaggtaagtgaatcatgggggctggtctttcccgtgctattctcgtgatagtgaataagtctcacgagctctgatgtgtttatcaggggtttctgcttttgcttcttcctcatttttctcttgctgccaccacgtaagaagtgccttttgcctcccaccattattctgaggcctcctcagccatgtggaactgatgacacatctagaagaccctcaccttatgcttatgctggccccttgatcttggcctccagaaatgtataatgaagaatcttgaggtcctcctggattaccaaagtgggccctaaatccagtggcagaagacacagacacagagaggagaccaggtgaagacaaaagaagaggctggagtgatgcaaccatcagagagtgaaaatactcagttacctcctggtttatgaggcaatgaagtattccagcacataaatattgacgctgagacccatgggatgtaggagtgctgagcacatttgcaagacataaagaccgaagtgtgtgtggtatctagatgagatgcatggtgatgactggagactgggcgtgatgaatgacttaggaaacctctggagggtgcctgctttgtggccataaaccactgtgcccatgtggaaaacactgcagtcctggggcagaagataaacttcatgcttgataaaaaaaaaaaaaacaaccaaaaggtaaggttttcttctggtgtgctgcagtctttagtcttcttctgttttccattcccactggcagttcaaagatgtccttaatccatcatatgcctcttgaatgtgtgctgtgggtttactgtcatgatgaaaaactacttcatgaacttagtgaaggaactcgggattgagtccgagctgcttacatagcttctggggaaaattcacccaaatgtgggggaagcaatccaagaggcacttcaagtatttgttttgaaataaaaatattgacagtggtacatattttttttcccaaaggtgtttgttattccataaatccagataggtgaatttcattagcgaacttcagatcactgatttgatgatactacctctgttatgtctcaaatctgccccggcacctctatcctactgctgctagtataattcagaccctctcccctgaactgttaccttagactcctcatgtctctaatttgttttacctttctcagctagattaatcttcctgaagcacaaatccaatcatgtcaatatttttctcagaaacaaaatagtatccctttgcctggagaataaagtctaatcttagccagttgactcagctccggc

SEQ ID NO: 566 - DNA, 2173 bp, Homo sapiens
gggcccggcagctacatttacaatacaaacgttgtacatctgcccctctgatatggtttggctgtgttcccacacaaatctcaacttgaattgtgtctcccagaattcccacgtattgtgggagggacccaggaagaggtaagtgaatcatgggggctggtctttcccgtgctattctcgtgatagtgaataagtctcacgagctctgatgtgtttatcaggggtttctgcttttgcttcttcctcatttttctcttgctgccaccacgtaagaagtgccttttgcctcccaccattattctgaggcctcctcagccatgtggaactgatgacacatctagaagaccctcaccttatgcttatgctggccccttgatcttggcctccagaaatgtataatgaagaatcttgaggtcctcctggattaccaaagtgggccctaaatccagtggcagaagacacagacacagagaggagaccaggtgaagacaaaagaagaggctggagtgatgcaaccatcagagagtgaaaatactcagttacctcctggtttatgaggcaatgaagtattccagcacataaatattgacgctgagacccatgggatgtaggagtgctgagcacatttgcaagacataaagaccgaagtgtgtgtggtatctagatgagatgcatggtgatgactggagactgggcgtgatgaatgacttaggaaacctctggagggtgcctgctttgtggccataaaccactgtgcccatgtggaaaacactgcagtcctggggcagaagataaacttcatgcttgataaaaaaaaaaaaaacaaccaaaagaggtgaatcacttcaaagagaaggaccagattctcatggaccccactgccatgctggccagacatcttgctgccattgttttcctgttatttactcccaaacagatggagtgtcgctctgtcacccaggctggagtgcagtggcacgatctcggcttactgcaagatctacctcccgggttcacgccattctcctgcctcagcctcccgagtagctgggactacaggcgtccgccaccacgcccggctaattttttgttttttttagtatagacggggtttcaccgtgttagccaggatggtctcaatctcctgacctcgtgacccgcccgccttggcctcccaaagtgaagtctcttttcaaaatcttaatgcttacctgtgtttcttttatgaggaacgtcacggaatcaagagtttttgtcttcattcttattaacttgtaaaaattctaagttaaagacataaccctttgttgtatttgttgtaaatattttgaaaatttgatgtttctctttacattttgttttcgtgactttttcaagtctaatatttaggtataatggacgtatgcccattaaacctgtgacttccttttattagtcttctagccatagtattctgcttagaaagatttagcccaaatttttaaaaatattctccttcttattcatcttgttattttttattgttatgttctaattcatatttaataattttggtatgcatgatatgcatctctgtcataccaaatggaggattaattgtccctgaatttacgtggacttagccctcagtctatataatttccttcctaatcttcagcataaatccatacctcatactgtttctgtaaaatacttgtcttctctgtttcatccattattatgattcacatcttatttggccaaatttaattcttaagcaactcttttcagaataacatgattggtattataccttctgagcctttaatgaccaatataggtttttttttccctcagagatgaagaataggttaaatatgccagaatttcctaaatactccactgactctccaatgagattttaacatattttaaagtagaaggggcactgttgtccaataaatttgggaaagtgtgttaacagaattaaaactctttttgatgtgtgcgtttacgtttgaatttattgcagggtttctcagagctcttaataaaacgtggtgttttatgtttttctaggaaataaatgtaatatatattacatttataagtacgcataaagtaggcataagatagggactcccctccacttcagactgggcaaataggaagaccccaagtgtatatacggaag

SEQ ID NO: 567 - DNA, 2427 bp, Homo sapiens
gggcccggcagctacatttacaatacaaacgttgtacatctgcccctctgatatggtttggctgtgttcccacacaaatctcaacttgaattgtgtctcccagaattcccacgtattgtgggagggacccaggaagaggtaagtgaatcatgggggctggtctttcccgtgctattctcgtgatagtgaataagtctcacgagctctgatgtgtttatcaggggtttctgcttttgcttcttcctcatttttctcttgctgccaccacgtaagaagtgccttttgcctcccaccattattctgaggcctcctcagccatgtggaactgatgacacatctagaagaccctcaccttatgcttatgctggccccttgatcttggcctccagaaatgtataatgaagaatcttgaggtcctcctggattaccaaagtgggccctaaatccagtggcagaagacacagacacagagaggagaccaggtgaagacaaaagaagaggctggagtgatgcaaccatcagagagtgaaaatactcagttacctcctggtttatgaggcaatgaagtattccagcacataaatattgacgctgagacccatgggatgtaggagtgctgagcacatttgcaagacataaagaccgaagtgtgtgtggtatctagatgagatgcatggtgatgactggagactgggcgtgatgaatgacttaggaaacctctggagggtgcctgctttgtggccataaaccactgtgcccatgtggaaaacactgcagtcctggggcagaagataaacttcatgcttgataaaaaaaaaaaaaacaaccaaaaggttattctctggaccatagctgtgaatcattcaccccaagtctgagagcaatatggtgggccacgttcaaccagggttctgattttacctactgtgcgtgagcatgtcacaggtgtactgatgtaaatctggaacatgggaggaggaaacactccaatttccattctgtctccagcggcatgtctgacaggggtgggaccatccatgactccaactcctttccaatagatcagtcatgttccagtttctttcagaggtgaatcacttcaaagagaaggaccagattctcatggaccccactgccatgctggccagacatcttgctgccattgttttcctgttatttactcccaaacagatggagtgtcgctctgtcacccaggctggagtgcagtggcacgatctcggcttactgcaagatctacctcccgggttcacgccattctcctgcctcagcctcccgagtagctgggactacaggcgtccgccaccacgcccggctaattttttgttttttttagtatagacggggtttcaccgtgttagccaggatggtctcaatctcctgacctcgtgacccgcccgccttggcctcccaaagtgaagtctcttttcaaaatcttaatgcttacctgtgtttcttttatgaggaacgtcacggaatcaagagtttttgtcttcattcttattaacttgtaaaaattctaagttaaagacataaccctttgttgtatttgttgtaaatattttgaaaatttgatgtttctctttacattttgttttcgtgactttttcaagtctaatatttaggtataatggacgtatgcccattaaacctgtgacttccttttattagtcttctagccatagtattctgcttagaaagatttagcccaaatttttaaaaatattctccttcttattcatcttgttattttttattgttatgttctaattcatatttaataattttggtatgcatgatatgcatctctgtcataccaaatggaggattaattgtccctgaatttacgtggacttagccctcagtctatataatttccttcctaatcttcagcataaatccatacctcatactgtttctgtaaaatacttgtcttctctgtttcatccattattatgattcacatcttatttggccaaatttaattcttaagcaactcttttcagaataacatgattggtattataccttctgagcctttaatgaccaatataggtttttttttccctcagagatgaagaataggttaaatatgccagaatttcctaaatactccactgactctccaatgagattttaacatattttaaagtagaaggggcactgttgtccaataaatttgggaaagtgtgttaacagaattaaaactctttttgatgtgtgcgtttacgtttgaatttattgcagggtttctcagagctcttaataaaacgtggtgttttatgtttttctaggaaataaatgtaatatatattacatttataagtacgcataaagtaggcataagatagggactcccctccacttcagactgggcaaataggaagaccccaagtgtatatacggaag

SEQ ID NO: 568 - DNA, 12408 bp, Homo sapiens
tctgtttctctctgaccactggtgcatgcagcccctgtcacgtattccttgcttgctgaaatcaatcacaaccctttcatgtgaaatccttagtgttgtgagctcttaaaagggacagaaattgtgcacttggggtgctcggattttaaggcagcagcttgccgatcctcccagctgaataaagcccttccttctacaacttggtgtctgagaggttttgtctgcggctcgtccttctacatttcttggtcccctgaccgggaatcgaggtaactgagggatggccgaggtagccccttaggcagcttaggcctgccctgtggagcatccctgcaggggactctggccagcctgagtgacgtgatccaaagagcactcctgggtagaaaattgcctgggtggaacgcctcaccagaacagcacgtagcaggcccctgtggaggattaacacagtggctgaacaccgggaaggaactggcacttggagtccggacatctgaaacttgaattgacaagccgacatcagtctccagagtgaatccaaggagtggacccaagacatttgtgttctgtgatgtggtggcatgttacctgtcatctccgatgcataactcctaaagtgcgtctggggcagttgtacagattgcagaggataatactcaagatgttctccaaggccaactagtcatcagtttattcatagctcccaagatggtggtgggccacttccaagatggtggcaagagtcgtattctctgacctggggttcttggtctcatggattccaaggaatggaatcttgcgccatgtggagaagcgtcagataattaggcagcagtccaacaattaggttttgtggaacttttactatgtcatctatttattggaattccccctggataccaggaccccctccagcagagcttaaagttatagttacaggaagtacaaattccttatgtggatccctggaagtgtgatgagaagaaccactgtttccaagatctatttattctatttatcaggcctataaaatcatgtaatggccatggcttcaactagactccacatcttgaatcacagaactcaacgaatggcatcaactacaagctggtattctgctatacatttaagaggccattttaatattctattagtctagcagcttctaagtgatgagggatatggggggactggaggatcccgtgctcacttccttttctgtaaaaggagctctttgatccaaggtgacatggtatgggatccaatgacaataaatcagttattctgtgaaccctgatcaaaacttgactaaacttttgacagttaggttttttcctgaccacagactcctcacctttcttttcttagaaaatttacattggaaaacagatgtaaattttctccagcctcttgcaaggtttacagtccaggactttgaggtcctgggagtcatccttttgaaatacaatcatcaaagaagatagtgctccaatctcctagtctctgtgggagggttggaacctaacttcagtaaactaatcaccaattagcaaacacagaggggctgatcatactgacccactttcccactaaaatgtctagtactttccaccagctcaccacagtgcttaaaaactctcctgtcttttgttttactagagttgagtccaatctctttcatctattgcaatagtgttgaataaagtcttccttgcctaacttgtcatgtgtattttttctctgactgccttcagagagtgttattgtccaagacactgaaaaatagaaacacaaccttcatctagaaaatgcaagaatctcagtaaagatgaatcattgttctgccaccatggaaggcagctagttgtagtcaattagccaaaaagtacctggttggtttccttgaggggatggcatgcgtattaatctggatccagtcaggacatagaaatcatagcaacaatttaaacaagaaaaattaatgtaaggtattattaactactaacaggagtgaaagagtgttgtacatgtaagactgagagagcaagaacaaggaaggaataagaacttagaagagacaccatcccccagcctgagaatcagatcttattagaaagagtgttgctaccccaaaaatatgcaaaagatcagtggggaagaagtttgctggaacatgtgggcttggattgttgggtagaaaagtcgtgtggggtggtcaaaaaattactacagagtgtttgccactaggtctctggcacactaatttcctagtagctacatcacaggaaaacaaaagtacaccagtaccaaggagagaagccccttcctcttactataacctttcaatgtccttccattgccccctgttgacaaagcttaacattgcaccagctggcaaaggagaaatgttcacgggattaagggccagtatcacagatcaggtcaaagaaaggtgaactaggagtttacagacaataaattaataaccagtgtcatatcaaggggtcagtgttggtctaaatttctgactggtcacacattcagtagcagcactggccgcttagtgagaaggagcccatagtgaaggtcccacttgtggcctgactttctccaatgctggcaactacaattgtgggattatatgcaagcactggagtggctgaagtcaaagggtggctagccactgttagatgagtctttctaacctagttgtctgtgctttctctgtgatgaatgttggtgggcaccgccatgagacacaaaaatcctcacattttatttactttctcatagtaaaatctgcatacttttcttcaaatgtctgctcttccagtcttactctgtactgtttttttttttctttttgactgagtctcattctctcataaggctggagtgcagtggtgcaatctcagttcacagcaacctctgcctcctgggttcaagtgattctcctacctcagcctcccaagtagctgggactacgggcatgtgccaccacgcccagctaatttttttgtatttttagtagagacggggtttcaccatgttggccaggatggtcccgatctcctgaccttgtgatctgtccacctcggcctcccaaagtgctgggattacaggcatgagccaccgcacccagctggttcttgacgaagaaactaggtctttcatctctgccccaaaatttattaataccctcagtgcaagcgtcttcttctacgtcaaagtgataacctaaagctttgttcaaaattctgtccattagtaagattttccctcaatgctgttttctgaagccatttctatttttggctggtatcaatacattggtttatagtaactagcctcttcataaatctgggccagatttacgtccacaggctggacataaggaattccatatgaagtcatagctgtgagctgaggatgagatactggaacaacagaatttggtacttggagtcttggtcacctctttttgtaacttacttgtcatctctgaattcatgtctctgaattctgattaggctgtaggcctaatttttgtcattgctatcatatggtggatttatattgtgcctatacaacttcattatttgataggttgataattcccaatttataattagtagcaccaataatatccttaatagtcacttgatatactggcactggacacttagtccctttgaggttaagctataagttaataaccaaatacttatcagtcaacttttttttaaactgtgattatgaagataagctccataaagagaaaagctaagtctgtctcatatactaagcctagtcatcatgaatattaaagttaggcacatagtaggtgttcagtaaatatttgttgagtaaatacatcctagagtaacttcatggaattatttgatgatgagagatttaaatcagtgccataagtcagccgataacaggtaatactttttcaattagacaatataagcatagctcagaattcaggttgtcctattttgcagcagcatcaggagaagaggaggaacaaggaaatgaggaagaagaggaaaaggaggaagaggaaaaggagaagatagtatttttcgtatctaaaactaagatttcaacatgccgtattcacagtgttcaaagggtgataccagtcagtgtgggagaaggaggagtgtgcttattattttatctagatgtcactgctattttttatgaatcaacttgctactttattagaatatgaaatatttcttttgtcttaaatttatatatgctggtgcaaaacttcttgagaattataaaatggctatgaccaactgtagagtcattttcagaatctatagcttgcgattccagaaatgaaatgctattaaacattagcaattaaagatgcagttgtcgttactgacctaaattcaccagttgtagtgatactaacataaagatttacaacatttttatgaaacattaataatctgtgactatgtcaaggtggggctgggagataaaaggcaaataccctttccatttcacttatgaagctgctttacaaggtttcaattagatctttctttttacccctgagagaaactaacaaatctattgcattaattatggtttcaagacaggatcatgacagccaaaattataaaattacagtcattgcagttgtgtaggctctacttctctcattctgtgtgcctgtagagttggaatgtaactttacaactgatatcttaagaggcagtgcaaatgcagaacaaatatgctgtgcagagcgagagaaagagaagtgataaagccaaagaacattgtctgattaatcaaacaaatcattgaatgtggcttataatatttaaaatgcaagactttaatccatcgattaccatttgaagtatattcatgtttttaaagaacagaacacgattatatttcaatatataatttctgtacagccaaaaaataaaacaccacagtaaaataatgggagaaacataatatttaaaatgcttgacaaaatgttaacatccttaatcataaatgagctcttagtaacaaagagattaactttacaagggaaatgaaaaagaaaaagaggaaaatgaaatagcacaaatgacttataaggttatgtaaagatgatatagcctaatgttaatagataaaaggcaatttcattataaattatattatcaatgcttacaaatattgatacctaatgtttgtatggctgtaggaaatgaggaattctcaaatactgggaaaatttactcctgtcatgagaaatttagtcaaaatatagattttgcatattctttgccctggcagtttcaatccataggaatcattccaacaaagtagttggatgaatttatatatatatatatatatatataatatatatatttttatataatataatatatattatataaaaatatttttatataatataaaattatattttatataatataaaattatatatatatatacacatgaatgtttactacatagaaaatgtgtaagtgatatatcatctgccgagtaaccacttaagtatcaactggtttataaaataagagattgggaggtggaattagaaagaaaaaaggcacttaagtaaaaatactagatttcacaacattctatgtcctttgaattcttaaaaaagatcatgttttaatgaatcagttttatgtttaccctgcgataagtaaaaattataaatatatgcattttatacttaggaaagcactgagatgaaacccttttaattccaccatcctgtctcctttgttcaataatgtatattcatgcttctatcaaattcagttttagtttttcatgtgtatgcatatatgcttgtatacacacatgcatacatagagtgggaaagagctatctctgaatatatattgttgtatttgtgtgtgtttatatgtgtgtttgcatatgaatgtttgtatgtgtgtgtgcatgtaggtgtagctagaaagaaagaaatgggaacttttaactatgagtccacagaactgtcccaaatcacaatacagctatttgaaaatagaaaggattggcatggtcatttattatttcccttaacatttttttaatctaaaaactaattgaatgcctcttctgaaaaatatattatgccaataatataccttatgactaaggcagtcagcagggtaaatttccagattattatttaaaaagctattgtctgtagaaaagaaaagccatgcataaaaatcttatctcttttgatatgggtagtatgttaaagaacactgtcacagcatttcctaaatctagaaaataaaatttgttggaaatatccgtattttaggatattgtctaaaaacatgattaaagttttaaaatggaatgtatcaagtgatccagagccacttaggtaactagctaatgccatagatgaaaagcacttgcaggcagagataactagttgtgagctgattttatatattcaaaaggaatgattttatttttgatgaaataaaatttaaaaaataatgtgcaatcaattaaaaatcataatatgcaggagacagacttagtagtattacatttaataatcaaggcaatgctttctgaaatacctaacttgtagaataaatcatatttatagcatgaataaattaggaaataggtgactgaaagagtaggttaattaaaattagtgcattttctgaactggaaaaggaaataccgtggtgagctagtctatcagagtctggcagtgatttcagccaaagtaatcaaagcagatgggcattcagaaatgaccccaaaagactttatttttatggtcatatactgagtcacagagcttaccatattatctttattcaaaacattattatcacatgaatatttgtgcagactaaatataattgcataacttcttgagaattaggcaagttatctattatacctttctttcaactcatttgcctcacttatgaaataaagataataataatactcatctcctatgatttttttaaagattgaatcaaataatatataagatagaacattggcacagactaaagctttcaataaatgaaaactagtacgttttaaaatattagctgtgctttgacgtttttggtatagcccccattaaagacgtttacaatttacaattatgtaaatttttgtttcattttatggtgtttgggtttataacagctttgcaagcagttaaatagattacaactaagtagactatgctaatctaatcaaagaggcgaccgaattaggcttctgtttttgtttttctttagcagttttatctatatgaaaattatcctcttcaagatctttcaggaaagcttttccactgttggagcacttttaataaatagggttttggttaagggaagaaaattaacaagagacctcaaagaaaattcacttcataaaggatatagacttttagatgacatagcaccttacagcgagtttggagatggagaagagtcagctgggaaataaaaagtcagctggggaaaaaaaaaaaagagtcagctgggaaaaaaaataaaataagattcaggggctaaaaatgaaatctgtaattggaaaaggtctacaagatcattatgtcttttgaattgcaaacaccaggtattataacttatgagaaagatgttttggagtatgcagacaacaggtgatctaatgcttctatttgttcctatacgatcagaggtcctagttcacattgcttattaatcagaaagaaggttttcaatttattggccttactcctgacctttcattccgttgaaactaaagaatcccacatgttggtattgcaaaatgagacaacttcatttacagttagatctgattttatatagcatattatatatagcatattgtgttttaattttgtttttagtagggggagtgggagaaggatgctgtaacattcacaaagatcaagaatacatgttatagacaaacaggtttaattcctacaagtgacatatgctatgtgactctgggcacacattctttaatgttaaggcctgttccttatttgttatttaatcaatagcacccaccacagagtgtgtatgaaacaatcacacaagaaatgcatattgaaaaagcaaatggtattttttaacttcatgttctctttcctatttaaaatgggaataaaaattctttataaattcgtgggaattaaataacgtccactaaacactggatagagaaagtacctgatgtatagtaagtcctcaatcaatagtagcttttattatttgtattaaaaatattcaactgcatgacaagattttttttggacagagagaactattactgctttaaacatcaggcctgtcaggaatttatatcatttactattattttatttatatacaaatttgtcaattattttgatacacattagaaaataaatttttttatcactggataattatgacagagttttaggttagcatttttatagttcggttggatttggaacagatttgatacagataaatcttgaaaacctaaattaagtgagaaagaagtttaatcccaggaaacatttttgtccctttttttacttttccttccttaaatacagtgggaatttagatggaagtgccaaatgcagttccctatatggggataaaattgcctggtaagaagttgtttttcttcctaccaatcgtttgtttcctggattttaatctatgaaagtcatcccaactgtcccttcttattattatcatacttttttaatcaaagtactcactagatttgatacactttaatttcaaaccttaatcaagcattgggttcatttctatgccatccttttgattgtcaacatggcttctaagtgtcattgagaactgtattgggaaaagccagccatttctgaagtctccttataagaattttctttatctgtttattatataaagtgcaatttgtaactaagctgtcctgtatttcttttgctgacagcacttgcagccagcgaaacagttcaggtccatgacttcatccgatacccactgattacccagtacaggatgatgatttttaactccaaatcagcactagctccctgatgactctaattccagtaatagcaatattgcttcaacaaaaagagaaggaccatctgagaccttctacatttattcttatacattagcttatcctgaagtgttcaaaaacctttggtggaggagatagtggaggaaagggataatattttatttttattaaactaaaggtatattcagaggcactcctgttggcttaatggaaaaggatatgactcattagtagctttttttattggtaattttgggtactagcagaggaacagtatcacttctattctctaagagccgaagttgatctatgctccttttgccaagagaactgctcccagggaggaaagtcttttctaccatgcctgttggcattattgctctgtcaatacagacctactttctccacatagcctctaatagccccgaacttacagatctgatagccaggttctatcacctgagacaactttggatcttttgaacttctgagtccacaatcctaaagaaaaaactattattctagggaaaaattaggtctagtcccttgggtctatcaattttagctaaagtaatatgattatataaaatcataatatctccaataggaaccagatgaatataagggggagaggagaagtcttttggcagtttgtcatgttttctacagtgtctcacttccacaccctcttcccaattagaattatccatttctgcacagaatggtaaaataatctattttgggctaccagaaaactatcaccaaacctcagcttgaccttgtttgttaatgtctcgttattgagtctagaaagtggtggtatctgagtccttaatcattcaaatttctctgctgtgtattaaattgcagaacttacaaaacatgtcaactagttttcaaatcctgatccaatgaatttctggtattgattctaggtttaaaattgcaccgtttctctagatcccattttacagttgatctttaagtgacaatttgatatatagtagcttttcatataatctatgttcatattacttcctagtcttttgtaacggtggtaggagaaatcattgtcaaccatttcaatgaactacaaagaaatagatgtacagaaaaagttaaggaaaaaatataccagaaatcttccattaaaaaacaggcagatgaatctgtacaagattgtagtacaaaactagcatgaacattgggaatcctaaatcaaaagctcttcacttagtttaagttcttgggacttaccactaatgagacttgaaattccttcaaaatttagtatagaataaaaatcagatttccaggaagacttgtcaaaaatatctaagcaattgaatcagaaacctattggattattttctcttaagtagaatacatcattttctttccataaatagacaacataaacaccacctgttaacaatgattcaattaattcaatcaatagagtcagtcttgctttgaggatcaaaactaagccaaaaccaaacaaagctcaaaacaatgttttccccacaataatagaatatttgtaccttagcttgttataaacatactaaaagtaatatgccatattaattagtctatgatgtcacaattgttgatgactcattactttttaattttttttttactttggcctcatctttattcttacaagtctaaaactcaaaattaataagatagtggtaaatcaatgataaaaagaccaaaattataattgtttcttacatcatatacaaaaatcaactcaagatggatttaagacctaaatgtaaagcctaaactataaaaaccctggatgataacctaggacattctggacataagacctggcaaacatttcatgatgaaaatgccaaaagcaactgcaacaaaaacaaaaaaaattgacaaatgggacctaattaaagagcttctgcaccataaaagtaactattaagagagtaaacagacaacctacagaatgggaaaaaatattttcaagctatgcatctaacaaacgtctaatatacaggatctataaggaacttaaatctacaagcgaaaacaacccccttaaaaagtgaccaagcacatgaacagacacttttcaaaagaagacatagaagtggccaacaagcatatgaaaagctcaacatcaccaatcgttagagaaatgcaaatcaaaaccacaaggagataccatctcacactagtcacaatggctattactaaaatgtaaaaaattaacagatgctggagaggttgtgcaaaaaagggaatgcttatacactgctgattgaaatgtaaattagttcagtcactttggaaagcagtttaaggatttctcaaaaaactaaaacagaattaccatatgacccagcaatcccattatagagaaatataaattattctaccgtaaagtcacatatatgtgtacattcatcacagcactgttcacaataacaaaatcacggaattaacctaaatgcctatcaatagtacaatggacaaataaaataatgtggtacatatataccatggaatactatgcagccataaaaaatgagatcatgtcctttgtgggaacatggatgaagctggaggctgttattgtacaccaactaatacagggacagaaacacaaatactgtatgttcttacttgtaagtgggagctaaacaatgagtacatatgaacacaagggaacaacacacatcaaggcctacttgagggtgaagggtgggatgagggtgatgatcaaaaactatgtatcaggtactgattaccggggtgacaaatgatccctacacaaaactgctgcaacatgcaatttacctatataaggacatgcacatgtacccctgaacctaaaataatagtaaagaaaaagaaaatagttacaataagttccataatattaatgagttagttaagtggatgctttacctattggttccatcatgtgtgcttgtttaattatttttttgtatgacagtttattagaagcatgattaatttttgaataaaaaactccctgaagctttctagagaaaagaataatattttactgttttaagcagtatttaatctaaacaaactttttatttatttagacacagggtcttgctgtcatccaggctggaatgcagtggtgtgatcattgctcactgcagcctcaaattcctaggctcaagcaatcttcccacttcagcttcccaagtagctgggaccaaaggagtgcaccaccacatctggctaatttattattattattactattatttgtag

SEQ ID NO: 569 - DNA, 7403 bp, Homo sapiens
agattccggacattgtatagaagaacactgtgaaactccctgccctgttctgtttctctctgaccactggtgcatgcagcccctgtcacgtattccttgcttgctgaaatcaatcacaaccctttcatgtgaaatccttagtgttgtgagctcttaaaagggacagaaattgtgcacttggggtgctcggattttaaggcagcagcttgccgatcctcccagctgaataaagcccttccttctacaacttggtgtctgagaggttttgtctgcggctcgtccttctacatttcttggtcccctgaccgggaatcgaggtaactgagggatggccgaggtagccccttaggcagcttaggcctgccctgtggagcatccctgcaggggactctggccagcctgagtgacgtgatccaaagagcactcctgggtagaaaattgcctgggtggaacgcctcaccagaacagcacgtagcaggcccctgtggaggattaacacagtggctgaacaccgggaaggaactggcacttggagtccggacatctgaaacttgaattgacaagccgacatcagtctccagagtgaatccaaggagtggacccaagacatttgtgttctgtgatgtggtggcatgttacctgtcatctccgatgcataactcctaaagtgcgtctggggcagttgtacagattgcagaggataatactcaagatgttctccaaggccaactagtcatcagtttattcatggatgccagtgaaatttggtgccgtgactcggatcggggaacctcccttaggagatcaatcccctgtcctcctgctctttgtttcgtgaggaagatccacctacgacctctggtcctcagaccaaccagcccaaggaacatctcaccaattttaaatccgttcctttcctttcctggtagagacgaaggagacgcattttatccgtagacacaaaactccggtgctggtcacagactcgggaagacagtcttcccttggtgtttaatcacgcggggatgcctgcctgattattcatccacgtttcagaggtgtctgaccacgcagggacacctgccttggtccttcacccttagtggtaagtaccacttttctagggggcaataagcccccaatcccttctcttcgtgtctctaccccttctctgcttttctggggggcaagaaccccccaacctcttctccttcacccttagcagcaagtaccgcttttctggggggcaagaatcccccccagccccttgtctccatttctctaccccttctccacttttctggagggcaagaaccccccaaccccttctctccgtgtctctactctctctttttactgggcttgcctccttcactatgggcaaccttccaccctccattcctccctcttcccccttagcctctgttgtcaagaacttaaaaccacttcaactcacacctgacctaaacctaaatgccttattttcttctgcaatgctgcttgaccccagtacaaactcaacagcagttccaaatagccagaaaatggcactttcgatttttccatcctacaagatctaaataattcttgtcgtaaaataggcaaacagtctgaggtgcctgatgtccaggcattcttttacacattggtccctccctagcctctgttcccaatgcgactcgtcccaaatcctccttctttccctcttgcctgtcccctcagtcccaaccccaagtgtcgctgagtttttctaatcttccttttctgcagacccatctgacctctcccctcctccccaggctgctccttgccaggctgagctaggtcccaattcttcctcagcctccccacctccaccctataatcttttaatcacttcccctcctcacaccgggtccggcttacagtttcgttctgtgactagccctcccccacctacccaggaatttcctcttaaaaagatggctggagctaaaggcatagtcaaagttaatgctcctttttctttatctgacctctcccaaatcagttagcgtttaggctctttttcttcaaatatgaaaaacccagcccagttcatggctcatttggcagccaccctgagatgctttacagccctagaccctaaaaggtcaaaaggccgtcttattctcaatgtacattttattacccaattcgctcccgactttaaataaagctccaaaaattaaattctgaccctcaaaccccacaacaggacttaattaacatcgccttcaaggtgtacagtaacagaaaaaagttgcaattccttgtctccactgtgagacaaaccccagccacatctccagcacacaagaacttccaaacgcctgaaccatagcggccaggcattcctccagaacctcctcccccaggagcttgctacaagtgctggaaatctggccactgggccaaggaatgcccgcagcctgggattcctcctaagctgcgtcccgtctgtgcggaaccccaatgaaaatcggactcttcaactcacctggcagccactcccagagcccctggaactctggcccaaggctctctgactccttcccagatcttcttggcttagcggctgaagactgacgctgccagttcgcctcagaagccccctaaaccatcacggacgccaagcttcgggtatctctcacagcagaaggtaagtccgtccccttaatcaatacggaggctacccactccacattaccttcttttcaagggtctgtttcccttgcctccataactattgtgggtatggatggccaggcttctaaacctcttaaaactccccaattctggtgccaacttagacaaaactcttttaagcactcctttttagttatctccacctgcccagttcccttgttaggccaagacactttaactaaattgtttgcttccctgactattcctgggctacagccacacctcattgctgccttttcccccagttcaaagcctccttcatattctcccccttgtatctccccaccttaacccacaagtataagacacctctactccctcgttagtgaccgatcatgcaccccttaccatcccactgaaacctaatcactcttaccccgctcaatgccaatatcccatcccacagcataatttaaaaggattaaaatctgttatcactcgcctgctatagcatggccgtttaaaacctataaactccccttacaattcccccatctcagatgtcctaaaaccagacaaggcttacaggttagttcaggctctgcgccttatcatccaaattgttttgcctatccaccccatggtgccaaacccatatactctcctagcctcaatacctccctccacaacccagtattctattctggatctcaaacatgctttctttactattcctttgcactcttcatctgagcctctctttgctttcacttggactgaccctgacacccatcaggctcagcaaattacctgggctgtactgccgcaaggctttacagacagctcccattacttcagtcaagcccaaatttcatcctcatctgttacctatctcggcataattctcataaaaacacacgtgctctccctgctgattgtgtcccgctaatctcccaaacctcaatcccttctacaaaacagcaactcctttccttcctaggcatggttaatgcagtcagaattcttacacaagagccaggaccacgccctgtagcctttctgtccaaacaacttgaccttactattttagcctagccctcatgtctgcatgcagcggctgccactgctttaatacttttagaagccccaaaaatcacaaactatgctcaacttactctctacagttctcctaacttccaaaatctattttcttcctcacacctgacacttatactttctgctcctggctccttcagctgtactcactctttgttgagtctcccacgattaccattgttcctggtccagacttcaatctggcctcccacagtattctggataccacacctgacccccatgactgtatctctctgatccacctgacatttaccccatttccccttctttcctgttcctcaccctgaacacacttggtttattgatagtagttccaccaggcctaatcaccacacaccagcaaaggcaggctatgctatagtacaagccaccagcccgtctcttagaacttctcatttcctttccatcctagaaatctatcctcaaggaaataacttctcagtgttccatgtgctattctactactcctcagggattattcaggccccctcccttccctgcaaagctggtggatttgccctcacccaggactggcaactcttaactccctcttagagtggatagatgatctttgctggcaggggaccttccaatactttcaccctgatgaagttctattctttacatttatagtcactcttattctcattcccattcttatgccaccctctacctctcccccgccatctccaccacaccatcaaccttactcattctctcctagccatttctaatccttccttagtgaacaaccactagctttgcatttccctttcttccagagcttacacagctgtccccgccttacatgcagactagacaacatctcctgtctccctacacctctgaacttcctttaatagccctcacctttaccctcctgaagaactcatttactttctagacaggtccagcaagacctccccagacatttcacatcagcaagcagccgccctcctccgcacttaattaaaaaacctttctccttatatccactctactccccccatatttagacctctcacaacacaaactattattcctgtggctgctcctttatgtatctttcatcaaagacccactgcaatccccctaggtaacctttcaccttctcgatgttcctttactcttcatctccatagctctcttcttgtttacttgtacccagccctgaaaataacagtgaaaggttgcacctatgttttctcatacaccatgaaaatcgatccttcccttctaagcagtaacctcatcggtccccattacaccctctgatggctgccgccctagctggatccctaggaactctaggtacaagacacccctttcagcactccttctcatctttttactttgcatctccaggtttgcctcgcacaaggtctcttcttcctctgtggatcctctacctacatgtgtctacctgctaattaggcaggtacatgcacactagttttacttactcccaaaattcaatttgcaaataggactgaagagctccctcttcccctcatgacaccgatacgccaaaaaagagttattccactaattcccttgcttgtcagtttaagactttctgcctccactattgctctcggtactggaatagcaggcatttcaacctctgtcaggaccttccatagcctctctaatgatttctctgctagcatcacagacatatcacaaactttatcagtcctccaggcccaaggtgactctttagctgcagttgtcctccaaaaccgccaaggccttgacttactgctgaaaatggaggactctgtatattcttaaatgaagagtgttgtttttacctaaatcaatctggcctggtgtataacaacataaaaaactcaaggatagagtctaaaaacttgccaaccaagcaagtaattacactgacgccccttggacactctctaattagatgtcttagatcctcccaattcttagtcctttaatacctgtttttctcctcttattccatttagtttattgattcatacaaaaccatatccaggccatcaccaataattctacacgacaagtgttccttctaacaaccccgcaatatcaccccttaccacaaaatcttccttcagcttaatctctcccactctaggttcccacgccacccctaatcccactagaagcaaccctgagaaacatcgcccattatctctccataccacccccaaaattttcaccgccccaacacttcaacactattttgttttatttttcttattaatataagaccggaatgtcaggcctctgagcccaagctaagccatcatatcccctgtgacctgctcctactcatccagatggactgttccttgccttaacttatgacattccaccacaaaagaagtgaaaatggccggtccttgccttaagtgatgacgttatcttgtgaaattccttctcctggctcatcctggctcaaaagctcccctactgagcaccttgtcagccccactcctgcctgccagagaacaacccccctttgactgtaattttcctttacctacccaaatcttataaaagcgccctacccttatctcccttcactgactctctttttggactcagcctgcctgcacccaggtgattaaaaagctttattgcgcacacaaaccctgtttggtggtctcttcacagggacgcaagtgaaagcaataaaagcaacaaatctttgcttcaaattgtgtttttccttaatgttgtttctttgcaacttcataccacatcttttctaaaatggacatacataatgtgtactcaaaaaaaatttctacctagtattatcgcatgtggggctttgcaagcaaaatttcattaaacgtttattttcagttctaagttatttattatactatcttacaattgtgtatatatatacacacattatatatatatgcatacatatatagtatatatacatttgtgttatatataaagataattctgtgcttatatatacatatactatatacacatatttgtaggttggtagatagattattgatgttttatatatatactaccaatattactcaaggaaaaataaatgtataaaagctttttatgtgagactaacttttaaaattactgatatatacagttctgcaagtttgagaataaaatgcatggcagttatctttgaaatcaacagaagtgaaacccagaaatacgttttttgattaaaaaaaatttttgtctgaaaatatcaaggaaatagagaataaaatgaatagcagggagaacaataaatttacttggcacagccaaatgttggcagatacaaggaactgtaaggcaagaccaacaaaaatgtgatggcaagaaaagaaagatgttaacttgaaaataaaggaaagaaaaatcaacttctgctggtgtctttgtagcatgaacaacccataaaagaatctcacatggtggtttcttattacctgcactgtcttcagcgtggcacatcagttgctgagctgcagactgtgctcatccaggcaaagtgggaaggacatgattgattagccaataaatgagattcatgcaaatggcctcttggaaatatctcgaggcaaaataaa

SEQ ID NO: 570 - DNA, 7403 bp, Homo sapiens; identical to SEQ ID NO: 569

SEQ ID NO: 571 - DNA, 27140 bp, Homo sapiens
attaaatcctctttaaggtggaatataattgacaagccgacatcagtctccagagtgaatccaaggagtggacccaagacatttgtgttctgtgatgtggtggcatgttacctgtcatctccgatgcataactcctaaagtgcgtctggggcagttgtacagattgcagaggataatactcaagatgttctccaaggccaactagtcatcagtttattcatgtttctgggattggattcatgaactcatcctttgaactatttcaacaagctttttcatgtaactaatctgcggaaggtagaaaggggaaaactgttgggtgctaaaatgacaactggttcaaggtacaatggcgaatatttttatttctgcaacttttcttagaggttggaaactggactgggcaggaagattcctttttgtaagattagtctccagttttcatcaagcagtttagtggggtattttaggcccagttccctctccacagtccccaaaggtcttctgttaactttaaatccgcaaagagagagatctctgccaagcagcaactgcaagagcatgtgggtcaatgttaccagcagacactcaaagcccattccctttacttcaacaccgctttataaattatcttagagacgttgtcaggttggtattagaggtgagtggtcatgacttcacgatttctcatctttctgaatgcatagtggctgggagtggtggctcatgcctgtaatcccagcagtttgggaggccgaggtgggcagattgtttgaccacaggagttcgagaccagccggggtaacatggcaagaccccaatctctaccaaaaaaaaaaaaaaaaaatacaaaaattgtctgggtgtggtgtgcatgcctgtagtcccaagtcccagctactctacttgggaggctgaggcagaaggatcacctgagcccaggaaggccaaggctgcagtgagccctgatggtgccactgcacttgaccttgggcaacagaatgagaatgagaccctgtcaaaaaaaaaaaaaaaaaaaaaaagaaaaaaaaaaagaaagaaaaagagagaaagagagagaaagaaagaaagaaaagaatgcatagtgagattttacagtaaaactctttcttagaggctaaaaactctggggatctcacgatgtgggtacatttctagagataatattttagatctctatagatattattttaatacatctttttctttttggtttgactgtgtatcatatggcttttcttcttggaagttatcaaacttctccctaactaaggtccttgcatatgctgacctgtttgacatactcccactctggtctactcattcttcaggtatcattttcattcctgtcactaccccttaacccaacccagacaaggttattgtgcactgaatcatttcaaaatgccactttaaaaatgagtaaatatttatgtaattatgtgttgaatatacctcctctttacaagcatataagtctatgatacaagtctatgcttgtctcttctaattctggtacatcatgtgatatgagaaccatggtaggcaatcaataatgcagagacgaaatgtttttatcttagagagactctcacagaagtttctagtttagagatgcttcactgaagtttatggcctcaacttccttgggtcttgattactatcagtggatgcagtgatggagggtaggtaaaatccaatgttatctacaagttctagactacagccaacaaactttttccaaaataggccagataataaatatattaggttttttgggccatgaagtctctgctgcaactactcagctccacatttgtagtggaaaagcagttatagatgaaacataaaatgaattagtgtggctgtgttcaaaaaaagctattttcaaaaacagccagtgggaaagctttggtccttgagccatagtttgcaaaattttgttctaaacagtaattccttcactggagattttaaaaacagaaagagaatacagacagctatacatgttctggtctattcctgttctctagtatagcagcaccttaaaattgtattactaacagagtacaggagattgtatggaaggcctatagtgatgactctttcatcagctttgttcgtaataaattaactgtatgtgtttcagagagtcatatgactccaaaatgatttaacacatgctgctacaagccagccttcttaagtttttattaaatcttgattgttttggtcacataatttttatattaaatcctgtgatactcattgtttttctataaaaatcatcacatttcaagtgttaggtagtgtgtatagaactgacaggtaataattttgacaggtatgggattaaatagaatccatccaaaaccatttactttccttatacattatagcagaagtggctaaattagagggttgttcctgtctccatcatgcacttctgtcttctactccatcccttgtatatattggggatattttgagccaagtgctaacgttacttacacagctgatatttcagattaatatgaatgctgaccgtttgccctcacaacatgcccacaacacatggattatacaggggaattaatcgttagcaatgaattcaacatttagcttttaacatttttattctgccagtaaggccagagaataaatctattctttctagcaggcaattattaatctctggctttcacaaacagcaaacggccactgaatccagctgacagcatatatttatttaaagattaataaggagaattatttatattagttaaaacgtattcttcattatgtttaaatctttccagagctatggcaggagttggattggagtatacagaatggattaacttattctaattgttatctaaagtagaggcattgagcactgatatggtttggctgtgtcctcaaccaaatctcatcttgaatcagttcccataatccccacgtgtcaagggcgggaccaggtggaggtaactgaatcatgggaacggtttccctcatgctgttctcatgatagtgagtgagttctcacaacatatgatggttttataagcgtctgtcatttccgctgctgttactcattgtctctcctgatggcctctggagagatgcctttgccatgattgtgagtttcctgaggcttcctagccatgtggaactgtgagtcaattaaacgtcttttctgtataaattacccagtcttggatatttcttcatagcagtgtgagaacggactagcacaagcatatttccaaaatacattctgacagtcatttaagattcatttcagaaagactataatcttgcaatagacattacctaactttttgctaagaaaatacattttcaaactcttcatcctttggtgtgaccaggttcagagatgtcccttcatgtatcttgtgtttatattgcaattttgagtataatgggatcaactacatgaattaaagacagaaataggaagcaggtttcaaaaaacataatttaagaacatataatggaggaataattgtaggagcttattctttatattccagttttattagccaagtaaaacgatttccttactctgtcactttttagtcataccaagaatgttgtcagtatttctcaaattattgtgcagatttagaagaatccacgttatagtgcaattttgagtctcttaaaagaaaaacaaggatcttaaaccaaaggcactctatcccaaattttgtaagtaactactgaatatctccaaagtcttcttaggaatcctaacaattttcatgctttttttttgagatggagtcttgctctgtcgcccaggctggagtgcagtggcacgatctcggctcactacaagctccacctcccaggttcacgccattctcctgcctcagcctcccaagtaactgggactacaggtgcataccatgcccggcatatttttttttttttttttttttagtagagacggggtttcaccgtgttagccaggatggtctcgatctcctgacctcgtaatctgcccgcctcagcctcccaaagtgctgggattacaggcgtgagccactgcgcctggccaattttcaggctttttattggtagatactttataatgtttctttagttggtttgcaaaaatggtcatagcttcatggttgtggcgtctgattttcctcatgtcaagtgtagcatcttccttgagttctaaccttctgttcacattattatgggaaagttattgaagagttgatgcttcagggacaattttgacattggctttacccttgtcatgtctgtaaagtgcaagctacaattgaaatgcacctgcagtttgccaccaggaggcatatttgtccatttctaaaatggaaatagttaaaaatgcattcacaagtagtaatatttgagtggacttcaattatttatgaaattctgtacctatcagatacagaaactgcaaaatgctacaaaaaattcatctaatgtataatatggagtgtaacattggaagagcagaggggctgtgaagtgagagtctctgttgactttgtctttcacagactcaaacaaaataccttcgatgtgactttactggcccctattttagtcccctgagcctcaactttctgtatttcattgggctttgatcactaatttacgtaaatttcactaatacttactggagttttcttacatttgtttgcttaaatgtcagcaaaaggaaaatgcaatactccagaataaaatcatgaactaaattaagaaacaaagtaaaaagactgtgctttaaaatattctattattattcagtttcaaccttgtttttattgtttgtatttccacttgtggattgtgagagaaaaacacagttaaaaagttgagtatgtcagacagtggattgtccttggatagtgtgtggtttggactcttccacacatttccagtgttatcgctctttaagaagtcccaattctcctctgttcattcaaactaagcttctcaaagtttcccccaggcacttcattttatctcatgactccttgaatgtaggactgctttttgacaataatgcatttttctgcttttttccttttcttgtttatccttaaagatttggcttctgtgttacttcttattagcagtgatccctgcctgccctcaccgagctcagggagttaggggactattctttgtacacattgtgtcctgtgctatccttttcacatcacctacatttgttatacttaagaacttgatttttttttttctcaacattttctacacttgcttgcgacttctttgagaagagaaactgcattcttacttcccagtagccaataagtagacacatagtaaacatttattgtatggatggcttatggggtttactacaagtctgttttgtttcagagaaagaattgcccacttgtgagtgggtcaaacggtggaaattttcttgcatggtttcaatttaacattcccttttcctaacgtccagtggaattttctggaccttgatgataacttttaggttatgtggtgatttttaatgtactttgagtcaaactaaaaatccgttgtcgtctttgggacatactagaccaaattagtttcggagagttcattacattccccatggcttcggaggtcaaaacctctcctgaagttcactttactataaataagtacttatttagattttatttagggatgggtttataatgtatacagatataatttgtattgtaataataacacatggaaggaagaaagttatagagttaatgaggaaaaaattgtatactgttgaaactaagttgatgttatatgaagtagattgttttaagttaagttgcaaatgtaattcccagggcaatcactatgaaataatccaaaaataggaagtaaagaaaacaacatggaaataaaaatgatatactagaatatgtctatttaaaacaaaagaaagaagtaatggaagaaaacagaaaaaaagaaataaaatatacacgtaccaatttggcataaataaatcctacctaaccagtaatgagacttaaaatgaatgaactaaacatttcaatcaaaaggcagagattggaagattagtttaaaaaacatatgatccaactagatgttggataaatgaaacaaaatttactttcaaagacacaaataagtaaggattaaaaaagatgtaccattcataaaatgcccaaaagagagttggaatggttatactatatgatgtgttttgtttttgttttcaatgaaattataaatgaaaatgaaaacaaattatacaaaaatttatagaatgcagctgaagcagtgctcagaaggagattttacaggcctatttttaaaaagaagaaagatggcaaatcaataatgcagccttcaatcttatgaatttttttaaataaaaaaacatactaaacctggagcatgtatgagtaataatacatactaatacatattaatacacaaggaacaagcattagggttcttcagaaagatagaaacagtaggatatatacagagagatggatagatatttgagagaagatgaattagggaaactggcttataccagttctggaggctaagaagtcccacagtggtctgcctgcaagctggagaccctgggcgatctactacacccaatagagtactaagaatggtgtttggagaatgagtatgccaacaaatgttgttacaatttaacctacaaaaactggagcctgaatatagacagaagtattgtcaaatggatttttgagcagacaaagaatgaattccttccattaacattgtatcatttgactcctggaaaattttttaaaacatatttatgaatatttcttaaatactggccttagaacatgattgagggtctttcttccctccagttcccacacagagtcctttgcttatcactgactagcagactcttcatttataaattgttgacaatctactttctagaagataaactgatcatttgttgttgtcaaacgataagcctcaaactataagaaagaaaaaggaaaaggagaaaaagacaaaaagaacgtaatatttttccaattgttcatataaaaccttggagtcatcattgacccctttctgcctctcacactcccagtccaatcactcagatcatcttgcccactttgtcttcaagttatatacaaaatttaaccacttcttctcatctgtactgccaccactgcagatcaagctaccttcatctcttacctggattagtaaaaagcttataagttgatatatcagcttcactacttatctccgctccaagtattctcaaaacaacagccagagtaatcttaccaggttagtcagatcttgtcactcttctgctcaatacacttcaggcatgtcttctccatcagaataaaaatcaccattgaggaagacctacagggtcatatatgatatttctgacattcattttacactaattttaccttccctcactgtgcatgagctagtgcttcctcattgttccagggatgagccatttgcgtctgccttagtttttatgcatttgctttttcttatctttagaatgcttgtcctcaagagtctacctggctcactcattcactttactggaatgtcaccttttcatgaaattgtgctgattcttcgagccatcctatctattattctacatatgatccttcctgtccctcttccttgcattttttatccccttcccactctcatcatctaatatactatacattttaattgtcttttgaattgatctcaatttctcccactagaatgaatgtcctatagggcagggatttttgcctgtgtctagagcagtgcttggcacataagaagtttctataaatgttagtccttctgggagacagatgcagaattgaactgtttacacatattttttcactttatcttcctaatagctctattatgctgatatttgtatcccccccctttttaaggtgaagatactgaaactgacagagggtaaaatatgtgaatctaggtctttctgacttcaaagctattattctttattatatcttagttacttttactcagaaaataagtgttatgtgacaggtccttaggtctttattttccttttatctgggactctattcaatcttcctttcactctctgacttttcatgttaacactgcaaagacgacccattgtgaagcctggcttagccacgctgtcacaagctcctttaaaatctcactagttggagtggagctgtcagccttttgtgaacaaggcaagcttctcactgaaagaaaaggccaatgacatggtgtaccttgtaaaagctatcatagtggaaaagaacatgcagcaatgttcacatcatgaagagaaatgtcaccagatgcatataatttttaaattcttacctatatttttatacacactacttgggttaacagttctgagacaataaaagaaagacacaatcactgtgttcagttcagttgcttcaaatgtaaaaaaaaaaaggctgtataaaagtgaatatcaggttagtagtctgaaatattgcctattgatctaatcaaaagagaacattcaaaatgaatgtagtccaggtttatgtaatatttagaacaagtcaaatgcttagtacttttgtggtaaaagttttatgattcttgaatactaatggcagaaaagtcaaggactgcaatgataaagtcgaaataaaacgtgaaaccaagtggaattgctagaatttgagtcattaggaatgaaggaaaatcagagcagaaagaacagtgtaatgatttaataggaatctttgcttcctatgtcagtccaagatttatgtgaacaagagtttttgagaactcatgatggaaaggagaaaaaggtgaaaaaggattttaagccttagctcgttgattttagatttgagatttgttaaacttctcacagtgagtaataaaaaattccataaaaagaatatctgttggccaggcgcggtggctcacgcctataatcccagcactttgggaggccgaggcaggcggatcacaagatcaggagatcgagaccatcctggctaacagggtgaaacccgcctctactaaaaatacaaaaaaaattagccgggcgtggtggcaggcgcctgtagtcccagctactgggaggctgaggcaggagaatggcgtgaacgtgggaggcagagcttgcagtgagccgagattgtgccactgcaatccagcctgggcgacggagtgagagtctgtctcaaacaaaaaaaaaaaagggagaatatctgttgaagaaagttatcaaaacatatgtgtatgcttatgagtgtgtttcattatatgtgcatgtatatatatgtatgtgtgagcatacacacatatatttcccaaaaagcttattttcatgatttctctgtattgtcagaatgtgctaggataatactggctgcttttacagataaaagcagaaaagctctcactcttcatgacttgcactctaacaagttcattcctcactcaatgtattagacccaagtaggtgttcacagtcagtcctgcaggaagagattagaggatctagttacccagggatcatctccattccttccaactgaaagggaaacaaacaaggaggagcacgcctggggaggttttcacaggccaggactggaaatgcacatttctcttttcctcacattccagtaagtagatctccattatatggctacgtgtaatacagccatgtgcccaggaagaagacaagtctgattttgagaacagatagcaatttgcctcattagaatagaacatgctcattgaacttttactatgggcaaggcagtgatccagaaagtagaacatacacatttgagtatcatttttttttttttgagaaaccaaatatagaatactaattgtatagttttttgataacaattaagttgttccatttggattataaaaatatataatagtacctatttgggctcatgtcatatgttttattaacatgtacttcctggtttatatcaaattacagaattttagagtttcagaataatttgaatttagaaagctattactgtaattatgtgggggcattaatggaggcttgtaattgtaatgctgaaaatataaattaattggcttgtaaatgagacaggtatagcaagtaaatgaggtcctgagggtatatttttattcagctactgagttgcaggataaagtcaaaatatttaccgaggttaatggaataattatataggatttatctatactattaaaattacatttaaaatatagagctatattgcttaccttaaattataaaatgagctttctccaaattcaaaatgcttgtaattcacagtcatttttggattactgtaaaaaggtaactaactgcctttttacaattaggaatttatttacaactttctcttccaatccattttctagtcttttatacaaaagactcatctgctttcaaggttagttcatttaagtcataaggtagagagaagcaagtacagaatacaacacagaaccacagccataaggtagatttctcaagtactgtccctaatgttaccgggggtccttgcttccagagctcccaagatggtggtgggccacttccaagatggtggcaagagtcgtattctctgacctggggttcttggtctcatggattccaaggaatggaatcttgcgccatgtggtgagtgttataactctattagaagtcgtgggtcgcggaagggaaccatggaccccagtgactagtgttcaactcgattaggacgaacccaggcacttaggcctgcaggaacaatggcaagcctttaacttgatgtggagcagcaatgggcgcctcgctggattaggagcacagtgggcaccctgctggatccagagggatggaagtcagcagagtgtctgccacggcgtcaaaacagcagtggtgcactgccagcgaaagctcagttcgagctgtaacaaacacgtaccagtagagtattaaatcttgcagttgcaagatttaatagagtgaaacagggtgaaaacagagctcccatacaaggaggggacccaaatggggttgccgttgctggctcgaatgcctgggtttatatcctgatcattgtccctaccgctgtgctctcaggcaatagatgattggctatttctttacctcctgtttttgcctaattagcatttggtgagctctctgattggtcaggtgtgagctcagttgcaagccccgtgtttaaaggttgatgcgatcaccttcccagctaggcttagggattcttagtcgacctaggaaatccagctagtcctgtctctcactaacagagacttaacattaacggttgggacttccttgtttctctcacttttttcctttcctttcctttttttaaaaaaaattttctttctcttctttccctccctccctccctccttccctccctcccttccttccttcctttcgttccccttctgttttttctttgtttttttttcttttaattctatcaagtctttagattgtttttccagtagatccttaatttatttgttgaaatgaagaaagtggaagtcaagcatttgctttcacctaagctacactctctgcttctagggaatagtgctggagatcatcacctttatatctccttacatgggggcagcttttccaagaggagttaagaaactatttcacaaagcatatcaaattaatcttctcaatatccttccagttagcttatgcctggtcgcttttccaagaaagcttcggatataaatatcactcatttctatttgcctaaaccttgtgttttttaattgcctttttgaacttaagtggtttaataaatattctccattttaagaaacaattttattcaagctcattaaatattctgcatttgcttaaataaaatatgtcacctaaaagttgaaagcataggagcaaatatataaattattacttgtatgtttataatccaaataaaacatcttcaacaagaggtatataacagggttttttaaaccttggcattattgccttttgaactagataattctttgttgtgggggactgtccttatactgtaggatatttagcaagattcctggcttctatccactagatgctaaccagttgcaacaacctaaaatgtctccagatattgtcaaatgtccatgagtgagagcactggaggtgtaaagttgtatcagttgagaaccactgggcatatattgcaaatagtcttttgtatgctcttaacttttgataaaatatcacagtcctccttagagtaactcactatccacagggcaaaactgtttacatgtaatgtagctgttaatcaatatgggctttaggcaagtctatgctgaataagactctgtgggctaattcaatggttttaggtttcataatgacagagaaactaacatgtttttggtatggttgagccaatttagttactaaagagtcaacaaattatcttgataggacaaattgggtcaataattctacaataatttttttagtgttttgacattaaattcggggagaatacactaaataagaaagaagagtcatatagcttagttagagtttaattttaagattattctttagctgtttcatctgttttattcattgttgaaaaagaaacaattatctggtgaatttcaatcctgtaaaaattctttgggatgaattttgcctaaaaaggcattacatattttctatagttctcaggtttcggtttgtgatgtttttgagaaatacttaaattctgaaactcttacagccctcttctgactagccttggggcaacttcagtagtaggaacattctagatgtaaattaaaacattttagcaaggtaaagctattcaaaataatgactcagtttggcagtcagaaagtaattctcctggaagcattcacactggggtattcaccagcaaatgagaaacacttaactagaagattgaaagggaagaatgaaatcattgtttccaattctcagcagctttcacttctattcttccttaactagtcagttcacaaattgttgtgagagaatatagtttaggttaaatcttcaagtcttacctgtagtgttatttaagtgatcttggtatatgtaataaacacacaattgagcagctaattgttgcagcataactccaatccaattgcacattcactttcaggtgccacagggtcttctaagccctggtgaatgctgtaaagcaaatacatctcatttatctctttgcatattccacaaattttaccatataacctatatgtaggaactctcattccatacttatctttagtctgtgtatagagacagaatattgaccgagaatagaaaaataaggctggttagattacctttgtcaagcttatgctacaccctaatggggttcaggacacactatcccaaaatgtagctagacaatgagttctctgagagcaggatccacctatttggttgtaatagttttgtttctataaatgttgaatgagtggatcgatttatcaaaatagagtttatgaacataaaaaattgccttatgcaaccaagtttgataataacaacatgaccttgatattaaactgaaaaaaggcatcttccagtctctactattaccacctctccccaactattatagccattcaaatctctaaccaggctgaatattaaataaaatggtttaccatctgatgttaaggtataaagataagatttttttttttctgaattaaaaaaaatagtccaaagaagaaggaagaagaaaggggatataatgagaatgtaagtatccaagaaatattgactgttttgatttatgtaatgaaattaaaaagtcgaaagccagttttaaagcatttcaaagtaatatcacagaaattaatttgaaggatacatttaatgttttgaatcataacctgtcaagcctggcatgcattttaactgagttttaaaaaaaagcattctgacgctattgtatggacattagagttttaaatacaacagaactacctaagaaataatgatacaatagaaatcagtttcctggctgtaataaagtatttcagttgaaatcatgataaatgttaaaggaaatattttgattatttaaataacaaaattggctgtttgtaaaacctggttaaacctgataacttctagaacaatatttctgattttaactccattctgctttccttaattttgtacagacacacacatgcacataagtttattaaattttcacaaactgaacacccctgtgcaaccaatacctggatctaaaaagagaacattttcaacccaccaaaagccctcattatgcctttttatctgtacctgccctccaaagtaattactaattattatgcacttaaatgataagggctgtagagatatggatggggcaccaagagcttctgctacagtttactccttgccctaaccagatccccgcttgtctggtattaagtttaatctatcactgtttcttcatgtggcagttggtcagtgtttcactgaaaaaaacacaatagaagaggtgggactatagtcagcactgcttcattgattctgaagctgaaatttatatttagtatttctccacctctttctccaattttacattcccttcattctcaaccagccctctcactgttatgggttgcctatccagtagataaatatagaatttaatcattcagaagtctgtgccactggatagcatatccttataaggccatccttgctataattacccattaacagatatcactcaacatggtaacttaagaaagaaagaatagcatgcccttgtaaggccatgctttctataattacccattaacagatatcactcaacatggtaactgtcaggcctctgagtctaagctaagccatcgtatcccctgtgacatgcacgtatacatccagatggcctgaagcaactgaagatccacaaaagaagtgaaaatagccttaactgatgacattccaccattgtgatttgttcctgccccaccctaactgatacgatatattctcccctgcccttaagaaggtactttgtaatattttccccacccttgagaatgtactttgtacgcctatcccaaatctataagaactaatgataatcccaccaccctttgctgactccttttttggactcagcccacctgcgcccaggtgaaataaacagccttgttgctcacacaaagcctgtttggtggactctcttcacatggacgcgcatgacagtaacaccaggagattccccaaggactatcttaaagtttagacataattcttcttaaccccatcaggtagtagcattcctagctcttgatgataatcaagttctattattcttgctaatatagtaactttgtttgttttgcttgctggtcttttggcaggagaagcgtcagataattaggcagcagtccaacaattaggttttgtggaacttttactatgtcatctatttattggaattccccctggataccaggaccccctccagcagagcttaaagttatagttacaggaagtacaaattccttatgtggatccctggaagtgtgatgagaagaaccactgtttccaagatctatttattctatttatcaggcctataaaatcatgtaatggccatggcttcaactagactccacatcttgaatcacagaactcaacgaatggcatcaactacaagctggtattctgctatacatttaagaggccattttaatattctattagtctagcagcttctaagtgatgagggatatggggggactggaggatcccgtgctcacttccttttctgtaaaaggagctctttgatccaaggtgacatggtatgggatccaatgacaataaatcagttattctgtgaaccctgatcaaaacttgactaaacttttgacagttaggttttttcctgaccacagactcctcacctttcttttcttagaaaatttacattggaaaacagatgtaaattttctccagcctcttgcaaggtttacagtccaggactttgaggtcctgggagtcatccttttgaaatacaatcatcaaagaagatagtgctccaatctcctagtctctgtgggagggttggaacctaacttcagtaaactaatcaccaattagcaaacacagaggggctgatcatactgacccactttcccactaaaatgtctagtactttccaccagctcaccacagtgcttaaaaactctcctgtcttttgttttactagagttgagtccaatctctttcatctattgcaatagtgttgaataaagtcttccttgcctaacttgtcatgtgtattttttctctgactgccttcagagagtgttattgtccaagacactgaaaaatagaaacacaaccttcatctagaaaatgcaagaatctcagtaaagatgaatcattgttctgccaccatggaaggcagctagttgtagtcaattagccaaaaagtacctggttggtttccttgaggggatggcatgcgtattaatctggatccagtcaggacatagaaatcatagcaacaatttaaacaagaaaaattaatgtaaggtattattaactactaacaggagtgaaagagtgttgtacatgtaagactgagagagcaagaacaaggaaggaataagaacttagaagagacaccatcccccagcctgagaatcagatcttattagaaagagtgttgctaccccaaaaatatgcaaaagatcagtggggaagaagtttgctggaacatgtgggcttggattgttgggtagaaaagtcgtgtggggtggtcaaaaaattactacagagtgtttgccactaggtctctggcacactaatttcctagtagctacatcacaggaaaacaaaagtacaccagtaccaaggagagaagccccttcctcttactataacctttcaatgtccttccattgccccctgttgacaaagcttaacattgcaccagctggcaaaggagaaatgttcacgggattaagggccagtatcacagatcaggtcaaagaaaggtgaactaggagtttacagacaataaattaataaccagtgtcatatcaaggggtcagtgttggtctaaatttctgactggtcacacattcagtagcagcactggccgcttagtgagaaggagcccatagtgaaggtcccacttgtggcctgactttctccaatgctggcaactacaattgtgggattatatgcaagcactggagtggctgaagtcaaagggtggctagccactgttagatgagtctttctaacctagttgtctgtgctttctctgtgatgaatgttggtgggcaccgccatgagacacaaaaatcctcacattttatttactttctcatagtaaaatctgcatacttttcttcaaatgtctgctcttccagtcttactctgtactgtttttttttttctttttgactgagtctcattctctcataaggctggagtgcagtggtgcaatctcagttcacagcaacctctgcctcctgggttcaagtgattctcctacctcagcctcccaagtagctgggactacgggcatgtgccaccacgcccagctaatttttttgtatttttagtagagacggggtttcaccatgttggccaggatggtcccgatctcctgaccttgtgatctgtccacctcggcctcccaaagtgctgggattacaggcatgagccaccgcacccagctggttcttgacgaagaaactaggtctttcatctctgccccaaaatttattaataccctcagtgcaagcgtcttcttctacgtcaaagtgataacctaaagctttgttcaaaattctgtccattagtaagattttccctcaatgctgttttctgaagccatttctatttttggctggtatcaatacattggtttatagtaactagcctcttcataaatctgggccagatttacgtccacaggctggacataaggaattccatatgaagtcatagctgtgagctgaggatgagatactggaacaacagaatttggtacttggagtcttggtcacctctttttgtaacttacttgtcatctctgaattcatgtctctgaattctgattaggctgtaggcctaatttttgtcattgctatcatatggtggatttatattgtgcctatacaacttcattatttgataggttgataattcccaatttataattagtagcaccaataatatccttaatagtcacttgatatactggcactggacacttagtccctttgaggttaagctataagttaataaccaaatacttatcagtcaacttttttttaaactgtgattatgaagataagctccataaagagaaaagctaagtctgtctcatatactaagcctagtcatcatgaatattaaagttaggcacatagtaggtgttcagtaaatatttgttgagtaaatacatcctagagtaacttcatggaattatttgatgatgagagatttaaatcagtgccataagtcagccgataacaggtaatactttttcaattagacaatataagcatagctcagaattcaggttgtcctattttgcagcagcatcaggagaagaggaggaacaaggaaatgaggaagaagaggaaaaggaggaagaggaaaaggagaagatagtatttttcgtatctaaaactaagatttcaacatgccgtattcacagtgttcaaagggtgataccagtcagtgtgggagaaggaggagtgtgcttattattttatctagatgtcactgctattttttatgaatcaacttgctactttattagaatatgaaatatttcttttgtcttaaatttatatatgctggtgcaaaacttcttgagaattataaaatggctatgaccaactgtagagtcattttcagaatctatagcttgcgattccagaaatgaaatgctattaaacattagcaattaaagatgcagttgtcgttactgacctaaattcaccagttgtagtgatactaacataaagatttacaacatttttatgaaacattaataatctgtgactatgtcaaggtggggctgggagataaaaggcaaataccctttccatttcacttatgaagctgctttacaaggtttcaattagatctttctttttacccctgagagaaactaacaaatctattgcattaattatggtttcaagacaggatcatgacagccaaaattataaaattacagtcattgcagttgtgtaggctctacttctctcattctgtgtgcctgtagagttggaatgtaactttacaactgatatcttaagaggcagtgcaaatgcagaacaaatatgctgtgcagagcgagagaaagagaagtgataaagccaaagaacattgtctgattaatcaaacaaatcattgaatgtggcttataatatttaaaatgcaagactttaatccatcgattaccatttgaagtatattcatgtttttaaagaacagaacacgattatatttcaatatataatttctgtacagccaaaaaataaaacaccacagtaaaataatgggagaaacataatatttaaaatgcttgacaaaatgttaacatccttaatcataaatgagctcttagtaacaaagagattaactttacaagggaaatgaaaaagaaaaagaggaaaatgaaatagcacaaatgacttataaggttatgtaaagatgatatagcctaatgttaatagataaaaggcaatttcattataaattatattatcaatgcttacaaatattgatacctaatgtttgtatggctgtaggaaatgaggaattctcaaatactgggaaaatttactcctgtcatgagaaatttagtcaaaatatagattttgcatattctttgccctggcagtttcaatccataggaatcattccaacaaagtagttggatgaatttatatatatatatatatatatataatatatatatttttatataatataatatatattatataaaaatatttttatataatataaaattatattttatataatataaaattatatatatatatacacatgaatgtttactacatagaaaatgtgtaagtgatatatcatctgccgagtaaccacttaagtatcaactggtttataaaataagagattgggaggtggaattagaaagaaaaaaggcacttaagtaaaaatactagatttcacaacattctatgtcctttgaattcttaaaaaagatcatgttttaatgaatcagttttatgtttaccctgcgataagtaaaaattataaatatatgcattttatacttaggaaagcactgagatgaaacccttttaattccaccatcctgtctcctttgttcaataatgtatattcatgcttctatcaaattcagttttagtttttcatgtgtatgcatatatgcttgtatacacacatgcatacatagagtgggaaagagctatctctgaatatatattgttgtatttgtgtgtgtttatatgtgtgtttgcatatgaatgtttgtatgtgtgtgtgcatgtaggtgtagctagaaagaaagaaatgggaacttttaactatgagtccacagaactgtcccaaatcacaatacagctatttgaaaatagaaaggattggcatggtcatttattatttcccttaacatttttttaatctaaaaactaattgaatgcctcttctgaaaaatatattatgccaataatataccttatgactaaggcagtcagcagggtaaatttccagattattatttaaaaagctattgtctgtagaaaagaaaagccatgcataaaaatcttatctcttttgatatgggtagtatgttaaagaacactgtcacagcatttcctaaatctagaaaataaaatttgttggaaatatccgtattttaggatattgtctaaaaacatgattaaagttttaaaatggaatgtatcaagtgatccagagccacttaggtaactagctaatgccatagatgaaaagcacttgcaggcagagataactagttgtgagctgattttatatattcaaaaggaatgattttatttttgatgaaataaaatttaaaaaataatgtgcaatcaattaaaaatcataatatgcaggagacagacttagtagtattacatttaataatcaaggcaatgctttctgaaatacctaacttgtagaataaatcatatttatagcatgaataaattaggaaataggtgactgaaagagtaggttaattaaaattagtgcattttctgaactggaaaaggaaataccgtggtgagctagtctatcagagtctggcagtgatttcagccaaagtaatcaaagcagatgggcattcagaaatgaccccaaaagactttatttttatggtcatatactgagtcacagagcttaccatattatctttattcaaaacattattatcacatgaatatttgtgcagactaaatataattgcataacttcttgagaattaggcaagttatctattatacctttctttcaactcatttgcctcacttatgaaataaagataataataatactcatctcctatgatttttttaaagattgaatcaaataatatataagatagaacattggcacagactaaagctttcaataaatgaaaactagtacgttttaaaatattagctgtgctttgacgtttttggtatagcccccattaaagacgtttacaatttacaattatgtaaatttttgtttcattttatggtgtttgggtttataacagctttgcaagcagttaaatagattacaactaagtagactatgctaatctaatcaaagaggcgaccgaattaggcttctgtttttgtttttctttagcagttttatctatatgaaaattatcctcttcaagatctttcaggaaagcttttccactgttggagcacttttaataaatagggttttggttaagggaagaaaattaacaagagacctcaaagaaaattcacttcataaaggatatagacttttagatgacatagcaccttacagcgagtttggagatggagaagagtcagctgggaaataaaaagtcagctggggaaaaaaaaaaaagagtcagctgggaaaaaaaataaaataagattcaggggctaaaaatgaaatctgtaattggaaaaggtctacaagatcattatgtcttttgaattgcaaacaccaggtattataacttatgagaaagatgttttggagtatgcagacaacaggtgatctaatgcttctatttgttcctatacgatcagaggtcctagttcacattgcttattaatcagaaagaaggttttcaatttattggccttactcctgacctttcattccgttgaaactaaagaatcccacatgttggtattgcaaaatgagacaacttcatttacagttagatctgattttatatagcatattatatatagcatattgtgttttaattttgtttttagtagggggagtgggagaaggatgctgtaacattcacaaagatcaagaatacatgttatagacaaacaggtttaattcctacaagtgacatatgctatgtgactctgggcacacattctttaatgttaaggcctgttccttatttgttatttaatcaatagcacccaccacagagtgtgtatgaaacaatcacacaagaaatgcatattgaaaaagcaaatggtattttttaacttcatgttctctttcctatttaaaatgggaataaaaattctttataaattcgtgggaattaaataacgtccactaaacactggatagagaaagtacctgatgtatagtaagtcctcaatcaatagtagcttttattatttgtattaaaaatattcaactgcatgacaagattttttttggacagagagaactattactgctttaaacatcaggcctgtcaggaatttatatcatttactattattttatttatatacaaatttgtcaattattttgatacacattagaaaataaatttttttatcactggataattatgacagagttttaggttagcatttttatagttcggttggatttggaacagatttgatacagataaatcttgaaaacctaaattaagtgagaaagaagtttaatcccaggaaacatttttgtccctttttttacttttccttccttaaatacagtgggaatttagatggaagtgccaaatgcagttccctatatggggataaaattgcctggtaagaagttgtttttcttcctaccaatcgtttgtttcctggattttaatctatgaaagtcatcccaactgtcccttcttattattatcatacttttttaatcaaagtactcactagatttgatacactttaatttcaaaccttaatcaagcattgggttcatttctatgccatccttttgattgtcaacatggcttctaagtgtcattgagaactgtattgggaaaagccagccatttctgaagtctccttataagaattttctttatctgtttattatataaagtgcaatttgtaactaagctgtcctgtatttcttttgctgacagcacttgcagccagcgaaacagttcaggtccatgacttcatccgatacccactgattacccagtacaggatgatgatttttaactccaaatcagcactagctccctgatgactctaattccagtaatagcaatattgcttcaacaaaaagagaaggaccatctgagaccttctacatttattcttatacattagcttatcctgaagtgttcaaaaacctttggtggaggagatagtggaggaaagggataatattttatttttattaaactaaaggtatattcagaggcactcctgttggcttaatggaaaaggatatgactcattagtagctttttttattggtaattttgggtactagcagaggaacagtatcacttctattctctaagagccgaagttgatctatgctccttttgccaagagaactgctcccagggaggaaagtcttttctaccatgcctgttggcattattgctctgtcaatacagacctactttctccacatagcctctaatagccccgaacttacagatctgatagccaggttctatcacctgagacaactttggatcttttgaacttctgagtccacaatcctaaagaaaaaactattattctagggaaaaattaggtctagtcccttgggtctatcaattttagctaaagtaatatgattatataaaatcataatatctccaataggaaccagatgaatataagggggagaggagaagtcttttggcagtttgtcatgttttctacagtgtctcacttccacaccctcttcccaattagaattatccatttctgcacagaatggtaaaataatctattttgggctaccagaaaactatcaccaaacctcagcttgaccttgtttgttaatgtctcgttattgagtctagaaagtggtggtatctgagtccttaatcattcaaatttctctgctgtgtattaaattgcagaacttacaaaacatgtcaactagttttcaaatcctgatccaatgaatttctggtattgattctaggtttaaaattgcaccgtttctctagatcccattttacagttgatctttaagtgacaatttgatatatagtagcttttcatataatctatgttcatattacttcctagtcttttgtaacggtggtaggagaaatcattgtcaaccatttcaatgaactacaaagaaatagatgtacagaaaaagttaaggaaaaaatataccagaaatcttccattaaaaaacaggcagatgaatctgtacaagattgtagtacaaaactagcatgaacattgggaatcctaaatcaaaagctcttcacttagtttaagttcttgggacttaccactaatgagacttgaaattccttcaaaatttagtatagaataaaaatcagatttccaggaagacttgtcaaaaatatctaagcaattgaatcagaaacctattggattattttctcttaagtagaatacatcattttctttccataaatagacaacataaacaccacctgttaacaatgattcaattaattcaatcaatagagtcagtcttgctttgaggatcaaaactaagccaaaaccaaacaaagctcaaaacaatgttttccccacaataatagaatatttgtaccttagcttgttataaacatactaaaagtaatatgccatattaattagtctatgatgtcacaattgttgatgactcattactttttaattttttttttactttggcctcatctttattcttacaagtctaaaactcaaaattaataagatagtggtaaatcaatgataaaaagaccaaaattataattgtttcttacatcatatacaaaaatcaactcaagatggatttaagacctaaatgtaaagcctaaactataaaaaccctggatgataacctaggacattctggacataagacctggcaaacatttcatgatgaaaatgccaaaagcaactgcaacaaaaacaaaaaaaattgacaaatgggacctaattaaagagcttctgcaccataaaagtaactattaagagagtaaacagacaacctacagaatgggaaaaaatattttcaagctatgcatctaacaaacgtctaatatacaggatctataaggaacttaaatctacaagcgaaaacaacccccttaaaaagtgaccaagcacatgaacagacacttttcaaaagaagacatagaagtggccaacaagcatatgaaaagctcaacatcaccaatcgttagagaaatgcaaatcaaaaccacaaggagataccatctcacactagtcacaatggctattactaaaatgtaaaaaattaacagatgctggagaggttgtgcaaaaaagggaatgcttatacactgctgattgaaatgtaaattagttcagtcactttggaaagcagtttaaggatttctcaaaaaactaaaacagaattaccatatgacccagcaatcccattatagagaaatataaattattctaccgtaaagtcacatatatgtgtacattcatcacagcactgttcacaataacaaaatcacggaattaacctaaatgcctatcaatagtacaatggacaaataaaataatgtggtacatatataccatggaatactatgcagccataaaaaatgagatcatgtcctttgtgggaacatggatgaagctggaggctgttattgtacaccaactaatacagggacagaaacacaaatactgtatgttcttacttgtaagtgggagctaaacaatgagtacatatgaacacaagggaacaacacacatcaaggcctacttgagggtgaagggtgggatgagggtgatgatcaaaaactatgtatcaggtactgattaccggggtgacaaatgatccctacacaaaactgctgcaacatgcaatttacctatataaggacatgcacatgtacccctgaacctaaaataatagtaaagaaaaagaaaatagttacaataagttccataatattaatgagttagttaagtggatgctttacctattggttccatcatgtgtgcttgtttaattatttttttgtatgacagtttattagaagcatgattaatttttgaataaaaaactccctgaagctttctagagaaaagaataatattttactgttttaagcagtatttaatctaaacaaactttttatttatttagacacagggtcttgctgtcatccaggctggaatgcagtggtgtgatcattgctcactgcagcctcaaattcctaggctcaagcaatcttcccacttcagcttcccaagtagctgggaccaaaggagtgcaccaccacatctggctaatttattattattattactattatttgtag

SEQ ID NO: 572 - DNA, 27140 bp, Homo sapiens; identical to SEQ ID NO: 571

SEQ ID NO: 573 - DNA, 2216 bp, Homo sapiens
gttattactgaatactaaatttcgatttattctcaacagcttgtaagcatgactttaagtgctttcttttaaaagtaggggtggtaggtatacttttggagtatgtatatatctggaattgcttacttttgtttttatatatgataaataatgtgtaatactatcaattattggcccacaatattgttttcatattgttatctactatcacttaataatgcagacattcttaatgcagcctaagttttactcccttgggttgattatggtttaattttgccttaattttcatctgttaaaaactcacaaatttatatctctatcccaaagtgcttctttgaacaccaaagacatagatgtgatagtcagttttccctttccactttgatatataacaggcatctcaatattatcatgagtcttaacaaagctcacgaaagaaccagtcattttccccactacacagaaacacacacatgcacacacaaacctgctacagtctggtatacataccatgcatctagcagtttaaggcaaaagcttgagtctttctgatgtttcttcacatgtcacatacaatatctcaatatgtttataaattatgccttcaaagcatagcttaaatgtgtttatttctcttcatctccactgctaacacattggtctttttatatcttacctagaattgtacagtaacttgttaagaggtcacctagacgttctcttaggttcctttctcctacagaagctaaggggaccgtctgttaaaaactccatggagccataaaatggcagaacattttgtccaggattcctctgcagtgagatgattccctccacctgatctgtatgccacctgaccctcaccttgtatcattctgtgagaaaaaaggaacaccaaagatgatttgttggttttccagtgcaagagtgatccctccttcgtttttaccaaaaagagggctatttaactggataccaggagaagcaaattgctgatccagtcatggatgttttaccccattatttagttccactctacatggaatttatttggaagattctcaatgcacttgcattcaaacataaagacctaatgactctcattgcagcagtattcctcttgtattgttattttcttaacttcggatttcctccatttctgcactttttgccatctggaatttcatttgcaagggcagataaggggaaaagaatgtaataagagacgaggaaaaatataagcccttgctgaatgattgatatgaatgaaggaactgatggaataaataacaaaaataaaaagatccaggactactctcagtctctgaagcaggtgggagccctggcggtagctatgggtccagttcaaaggattatgaaatgcactgctttcacatcaaaaaggaagaagaaaggcaatacttgcaaccaatgataaagaggtattctgactttcatctgcctttgtgttaagcgtgagagagccagacagaattgcagcaggaaccagaaggagcaaagaaaaagattactgtttcttttataaaatggtttttatcctactggtgtctctttaaaaataaaaatcaacaaataaatgtccatttaaattgatcttctgttggactatgttattagtctgacatacaaattagtgcttctaagatttaactatgcgactgagaaccaatattttatggagagtgtcaaatggcttgcctttacagcaattcttttcactgtatctattttttttaatgtggatgatggaaactactttaatcaaaaagttaataatacttatttggaggtatgataaagcaaatgtctttggccacattgctgttattggaatttaagggctattatcttttgtaggacaatttttaaaatacagtttattctactcagtgccctaagtctgtttcttactagccatgaccttcagaagctgactttacctctctaagccattctcctcctctgtgaaatgggaatgttaatacccactcttgttactctcagagtgcaatgaggatcaatgagaagataaaaataaatgtgtttggttaactatgaaataccacgtaaatgttattagtatgaattatttatagaccatacacttgatggaggcaaaaagtagacctttgttgttcccatgaaaccacagtaccttccacagtgcctgacaagaagtaagaaagcaataa

SEQ ID NO: 574 - DNA, 2216 bp, Homo sapiens; identical to SEQ ID NO: 573

SEQ ID NO: 575 - DNA, 8010 bp, Homo sapiens
gtaattctctttatccaactccttggtcaaatataaatatcattcttaaaataccttttgatttctgaacggagaaatgttcaaagggtcctccagggctcattcccttaatcaaatgtttagtgaaaagaatttattttttctacttggaaattatggctcttcctagagcagtcgaagaactttcatggcttaaaatgtgattacaagtactgtactaaggacatactgattgattgctagtgttttaataaaaattattctttcttaacacctgtgattaatcaccttctaaatataatactataaagtatgaaatgttcttcacagttgatgaggtcaagttttttttttctttctatagtgaatagatgaacctggttaactataggcttgtgagaaccattttgaaatgaaaggcatttcaaaagataatttatgtgatacaccaaaatccaaaatgataaatacatgcaagcatgtcccaacatcgaattttattcacacttaagtcctagggtccgtatttacctattttgggaatgtataagagcaggaacaattgaacacatttccaatatatcatataaacagctttctcataggaataacaaaaataattttgttcctttgtaaatccaacttagtaataaattacactttattacagccaaaattaatgtagagatctctgttgtatttatttccaaaaggtaatgacatgtttctctcacctgaatattggtagtaaattaatggtggaagtcactatttaggcattacaatcatataaaattttaattacgtgtgaataataatttggctataaaagtttgaaaatatgtgattattgctgtgtatataatacagatagatgctgcgtattgtgagaaggatctgcctaaagcagatagataggtaaaatcaaggtactggatatggcctttgaagagagatcacagacagaaaaagagagaatccctttgctctgaaacttttgatggctatcttagatcaagatgctataacgaattgccatagactgggtggattgtaaacagcaaactgtgagatttattgttcacagttctggggtctgggtgcccatgatcagagtgccagcatagtcccgttttggtgaggaccccttcagggttgatgagttttgtcctcacattgcagagagcagagcaggagagctctttgaagtcttttatgtgagggcactacacccatccgtgagggttctactctcatgacctaattacatcccaaacgccccacttcctaaactatcacattggaggttaggattcgaacatatgaatttggggaaacataaacattgaatctttaacaatggctcttcagattctcctagattaaattccaaactacttatccctccaagtcctgtaacatctaatataagtccaacttttctttccatcctttgtttccattagtttcattctcaaatatttaagtctaatcaaactggtctgttctttgttccgtaatcaattcatatatttttgttttagtttgagatgccttcccacatatttctgattttctgttttatcccttctttacccattgtcaagaactataaagtatctgagaattttccctacttgaaagccaagttagcatatgacagttttatggatgttggcagaagacacaagactcttgtatcagagacaaaagactttcttactgattgtatgcaaacattatgagcttcaggtgtgtactgcttctccttgtcccaaagtcctatggaagcagcaagaagcaatccagttggatattatatatgcagagggtttgtgtcacagccaaagaacgccattttaggagacttgtatcttttataatggatgcaagcaagcctgcccaaacattaccttagagagaagcactatccttatcatattggacagacttgttctgcagggaaggatacattatttccatcttccatgactgttgaatatgtaaacatccttgtacagtcctaaacaaaacttgtttgtataaacagtgtttctgctcatagaatatgagaaatgaatgaagcccatggagaattatcttccagcatgcgttgttctcatcaatcctgccattactgcccaagttctgtgctcactatcttttctgcactatcaccaaatacttagtgcgtacttctcacatgtgtaacttaccatcagagtgtgcttaatataatgcctaacacatattgagcatgcaatacatttcagctgtcagcattacattccttttattctaagtatatgattatctcacaaaagggtgaataaatactttaatagcaaggacagtatcattttagagtaaataacgtaggcagactgagtgcacatctatgtgcatcagatgctctctctgtaagaggataagtagaaattgctccaagattctcaagatgtctttctaaatgtgcataagtataaaggatgaatactacctcatcaagaattaggctcccataatggctggtgtcaacattttctaccttttcagcttctgaatgactgaatgccttcagtttacctaaccatcttggacagtgaacagatatcagttatagcctttgctatctgccacatcctttcagactgtctagatttcctggatttctgacctttgacacctcagtatttcacaagtggctctgaatttgtttaaaaatcctaccttcccagtgcctttctagattatgttaacatttttctggttgcactttgacctcattagatttatctaaactctggttcaaactcaccatttagtaaactgagtcaaattttccaggtcctataaacagctgatgattttcttcgtcctatactctccagctcttccttcccagcagcaacagaaaatggtgcctaagagttcaagccctgggtattatgctttgaatcatatcctatttcttctttatgtagctcttggaaaagtaatcatcctatactgtttcctcatgtgtaaaatatagatattttccacttcatgaagcagttgtgagataatatatgtaaaacctttaaaagaatatcaacataaggtaattgcccaataaatgttaaatattgttgttaagcttaatattgttatcactattattattattccctgaagaacttggattatatctcaaagaagtggttgggttactgttcgtatgattaatcaaataaaacaagtcataattctgccataatatcaaagtccagaaactctattcaagccagaaagattgatacacgtaggtaaaattctgttgcaaagatggtggaatcatcttttcctgattggattctattcttcaacctggcccagcagaacatttgggacacatgtgttctcctgcttcactatctaccttgcagtcactgataataaatgctgaatctgtcagtattcatgtatttatctgtaaaaatgttctttaattgatgagaaatacttttgacacctaaaatgttagatttgatctacaaagacattttaaaaaatctgttgatgcaatgggattttggtataaatggtaatattaccattgaagcttttctaaatattatgaaaatatatttttacatgatgagttcttcaaattctcaactggcattaggaagaaattcctgacttttgaagaaagtggtgaatttagctcattatctttactcccttctttatactggaccaactgggagcagatgaaaaatattagccaagtatcatctttgttaaccacaaaatacagggcttttgatacttgagttgaagggttcaacatcgatttttaaccaactaaatcttagggccttcctggaagacaaactgggatgacacaacaaatgctgggtgcacttacatagccaagtggagagggtagcacagtctgtttcgtatctactcaagtttgggagagaaagagtaagagaaagagaagatcctcaaaaagacagattctatgccctgagacagatggacttaccacagaggagcagcagaagagcaggaaaagtgcttctcttgaaagcaagcagggccaaaagagttagatcaagagtccggccaaatgcaagcacagaacttttctggaactgtatcaatcagacaacattcagtattccatggagtgagactgaaatacaaaagaatcttccagtggggttctctccagaaactggagcaaaagtcttctttgctcaataaaatcatgaggctttatgcaataagttcaatgaacaagacttgtgaaatagactctcaccatattaattagtgaagacttacaggtctaagtccaccccccacctttttttttttttttcaggaacacatactttgagaaatgactgctgagaagaattggaaagggactggaagcaatgatggctaaagaatctcgagaaggaagacagactatacatattttttctaggaaattaaaagggaagataatttcataattattgccaatgttgtaaatagtaatctccatctctccatcagatagagaagaaaatgggattaaaatgtagtaagagaaatttagatggtttataacagtttgaaaggaatcatgagttaaatttcatagtgtagaggcaggaggctaagagaggataaagatataccgctaatgtttataaattctgtacattatccactccttacctctcaaaagcctctttgctaaaagtaggtgtcattatgtatgcaaataagggaagctatgccatgaaatgtaatccttaggctgctcatagtcttaagtacttttaataattgactcacttgaagtatttatgtagacctacttacaagaaaaaatatgaaaataatgtaaataaaaatgttacacactttataattaaattcttactttttatattgcccttgattgaaatcaaataattattcaagaataagaaagcattattatgagttaaatttttgagatgcaaaattatatgttctgcccattttctctacctgttttgtgtgaaagataatatgattgaatgtatgctttgtttgtgcccaagtacacgtctgaaccacagcctattctttatatcctattgagagaattgtggctccttttttcttttacgttacttaatatttggctgtagctgttctttggcagtaggtagggtatttgataattctgctgtgctgcataaacatttttacttcaaagtgattgcttgtccatgtctcactggaattatttcaagtcagacgtctaattctgtccaacatctttaatgttttcaaaatcatcttgggtgttgttaatggagtatcattaggtacaatttgaaacatttcagtgggcagtacatggattcagaatatttgtgcaatatgtgctcttgcttctgaagtctttgggggatttttcttttatatacccttctcctaacactttattttctttactagttgacttagttgtatagttatagtaaacataatttttccatttggccaatatttatgaaaactatagtaggatccaaacattccaaaagagcactgggataagaaagaggtggtgcctgtactatacctacagctaggagaaaacaggacacatagaaataaactcaagtacaagtgtgggcagtcataatagccaagaaagcccagatctaggagttcttaatatcattgggtgaagaaaggaacattttgatgttcctcagaagcacaaagaaaataaccccaagaaagaggattggcttaagaaaaagtatataaggatatgatctgctccaaaagcagaaagcactacatcaactgaaagaagttttggagagagaaatgtgaattatgctgagatagctggctttattcttcagatcaagggaagtattaaaaatttaaaacagggtatagcatggtcagatttgtatttaataaaaatatatctgaaggtcacatatttgacacactgtatggaagatacatttaagtagtcctattggtgaagaactgcttgagtcgctacacatgtggcatcgaactaaattagaaatgaagagaaattattcaaggctagaatattcagaaactatcagtgcatctaacacatacaataaaggctcaataaatgcctaatgatgaaaaacaaaaattaatgcacaaattgggtttcaaatgttacattgctagaatgtttaaaattatggagtcattttatgtttgtgtgtgtgtgtgtgtgtatatatatatatatatatatatctttttatccttattgaaggcagagatttcaaactacgtatgaagtattcatatctgtagatttatagcagattggtgtgttttctgttttagattgcctgttttgtagtagagagatgcttctcaggacgtcgtgggatcacactgttcagactgatttccaacaggcacagcgtgaattgtacagtaacttgttaagaggtcacctagacgttctcttaggttcctttctcctacagaagctaaggggaccgtctgttaaaaactccatggagccataaaatggcagaacattttgtccaggattcctctgcagtgagatgattccctccacctgatctgtatgccacctgaccctcaccttgtatcattctgtgagaaaaaaggaacaccaaagatgatttgttggttttccagtgcaagagtgatccctccttcgtttttaccaaaaagagggctatttaactggataccaggagaagcaaattgctgatccagtcatggatgttttaccccattatttagttccactctacatggaatttatttggaagattctcaatgcacttgcattcaaacataaagacctaatgactctcattgcagcagtattcctcttgtattgttattttcttaacttcggatttcctccatttctgcactttttgccatctggaatttcatttgcaagggcagataaggggaaaagaatgtaataagagacgaggaaaaatataagcccttgctgaatgattgatatgaatgaaggaactgatggaataaataacaaaaataaaaagatccaggactactctcagtctctgaagcaggtgggagccctggcggtagctatgggtccagttcaaaggattatgaaatgcactgctttcacatcaaaaaggaagaagaaaggcaatacttgcaaccaatgataaagaggtattctgactttcatctgcctttgtgttaagcgtgagagagccagacagaattgcagcaggaaccagaaggagcaaagaaaaagattactgtttcttttataaaatggtttttatcctactggtgtctctttaaaaataaaaatcaacaaataaatgtccatttaaattgatcttctgttggactatgttattagtctgacatacaaattagtgcttctaagatttaactatgcgactgagaaccaatattttatggagagtgtcaaatggcttgcctttacagcaattcttttcactgtatctattttttttaatgtggatgatggaaactactttaatcaaaaagttaataatacttatttggaggtatgataaagcaaatgtctttggccacattgctgttattggaatttaagggctattatcttttgtaggacaatttttaaaatacagtttattctactcagtgccctaagtctgtttcttactagccatgaccttcagaagctgactttacctctctaagccattctcctcctctgtgaaatgggaatgttaatacccactcttgttactctcagagtgcaatgaggatcaatgagaagataaaaataaatgtgtttggttaactatgaaataccacgtaaatgttattagtatgaattatttatagaccatacacttgatggaggcaaaaagtagacctttgttgttcccatgaaaccacagtaccttccacagtgcctgacaagaagtaagaaagcaataa

SEQ ID NO: 576 - DNA, 8010 bp, Homo sapiens; identical to SEQ ID NO: 575

SEQ ID NO: 577 - DNA, 21694 bp, Homo sapiens
agaacaaaccagcaaccccaagaggagccacagaccctctgaaggaagcggattgctcctgcacgaccctggagaccccccaaaagatgcgagtgccccaactgcagaagtgggaaaggagaccctcctctcccaaacacacacacccactggagaagctgaaagtctgtttgcaggcaaagtttctgactttacctggagctgaatcaatttggagagcccagcgaaacacagggatacaggaagcagcagaaaggccctgggagctcgctgggtcccctcgcaggacattcctgcctagcaccacagggatccaatgggagaggagcagggggtaaaactacaagggagaaagaaatctgtagcagaactttgtaacaatttgaatgctgttagaagcctactggacagaacttgcgggagggcacaaatccagtgtgcagactccacagatgagagaagaaccaagcccttttctttcgcagctgggaggtggagagcctgggacagggtttcaagtccatatcgctctctacctggaaacagtctgggggccattaagggtggggggcatggtggaagtgagaccggtccttcagtttgcgtgggagctgggtgaggcctgtgactgccagctttcccctacttccctgacaacctgcatgactcagcagaggcagccataatcctaggtacaaactctagtgatctgggaatcttacccccacccccgacagcagctgcatcaagacctgcccaaggagagtctgagctcagacatgcctagacccacccccacctgatggaccttccctactcaccctggtagcagaagacaaaatgcatataatcttgggagttttagggccccacccaccaccggttcctccccatactaccatggctgatgctctctggaaagcaccacctcctggcacgaggccaaccagcacaaaaatagagcattaaaccaccaaagctatgaacccccacggagtccattgcacacaccccgccccctgccggccgcaccacctccaccaaaacagatagctagtatcaacggctaagagacccatagactgttcaaatcacaggactctgtgcagacaacccccagtaccagactgaagccaggtagactcactgagtgggtagatctggaagagagacaataatcactgcagtttggctcacaggaagccacatccataggaaaagggggagaatactacatcaagggaacacctgtgggacaaaagaatctgaacaacagccttcagccctagaccttccctgtgacagagcctgcccaaatgagaaggaaccataaaaccaaccctggtaatataacaaaatgaggctcttcaacaccccaaaacatcacactagttcaccagcaatggatccaaaccaagaagaaatccctgatttacccaaaaaagaattcaggagtttagttattaaactaatcagggagggagcagagaaaggcaaaacccaatgcatggaaatgcaaaatatgttacaagaactgaagggggaaataagaaactagatggcttaaaaacaaataaaaaattcaggaaacttcacacacacttttacaaatgcaaaatgctctggaaagtctcagcaatagaactgaagaaagaatttcagggttcgaagacaaggtctttgaattaacccaatccaactaagacaaagaaaaaaagaacaagaaagtatgaacaaagcctccaagaagtctgggattatgttaaacaaccaaaacaaagaataatcagtgttcctgaggaagaagagacttctaaaagcttggaaaacatatttgggggaacaatcaaggaaaacttccccagccttgctagagacctagacatccaaatacaagaagcacaaagaacaccttggaaattcatcacaaaaagatgaattgggacattgttatcaggttagggacaatagggacattatcatcaggaaagaatcttaagagctgtgagacagaagcagcaggtaacctataaaggaaaacctttcagattaacagtagatttctcagcagaaaccctacaagctgtaagggaatggggccctagcttcagcctcctcaaacaaaacaattatcagccaagaattttgtatctagtgaacctaagcatcatatatgaaggaaagatacagtctttttcaaacaaacaaatgctaacaaaatttgccattaccaagccaccactatgagaactgctaaaaggagctctaaatcttgaaacaaatcctggaaacacatcaaaatagaacctctttaaagcataaattacacaggatctgtaagacaaaaatacaagttaaaaagcaaaaacaaaaaacaaaaaaaccaaagtacacaggcagcaaagagcacaatgatttcaaaggtacctcatacttcaatataacgttgaatgtaaatggcctaagtggtctacttaaaagatacagaacagcagaatgggtaagaactcaccaaccaaatatctgctgcctgcaggagacccatgtagcacatcaggactcacataaacttaaagaggtggaaagaggcatttcatgcaaatggacaccaaatgggggcagaggtagctattcttatatcagtcaaaacaagctttaaagcaacagaatttaaaagagacaaagagggacattatataatggtaaaagaccttttccaagaggaaaatatcacaatcctaaacatatattcacctaacactggaggtcccaaatttataaaacaattactaatagacctaagaaatgacatagcaacacaataatagtgggggacttcaatactgcactcacagccctagacaggtcatcaagacagaaagtcaacaaagaaacaatggatttaaactataccttggaatgaatggacttaacagataaatatagaacattttatccaacaactgcagaatacacaatctattcaacagcatatgaaactttctccaagatagatcatataacaggccatacaacgaggctcaataaatttaagataattgaaattatatcaagcactctctcagaccgcagtggaataaaactggaaagcaactgcaaaaggaaatttcaaaaccatgcaaaatatggaaattaaacaacctgctcctaaatgaacattgggtcaaaaataaaatcaagatgaaaattaaaacattcttccagctgaatgacaataatgacacaacctatcaaaacctctgggatgcagcaaaggcggtgctaacaggaaagttcatggccctaaatgcctacatcaaaaagactgtaagagcacaaacggacattctgaggtcacacctcaaggaactagagaaacaaaaacaaaccaatccaaacctagcagaagaaaggaagtaaccaagatcagaggaaaactaaatgaaattgaaacgaaaacaaatgcaaaagataaatgaaacaaaatgctggttctttgaaacgataaataaaattgatagaccattggcaagattaaccaagaaaagaagagagaaaatccaaataacctcactaagaaacaaaacaggagatattaccactgaaacaactgaaatacaaaagatcattcaaggctaatatgaacacctttacacacataaaatggaaaacctagaagagatggataaattattggaaaaatacaaccaacctagcttatatcaggaagaactagataacctgaacagaccattaacaagcagcaagattgaaacagtaattaaaaaattaccaacaaaaaaggccaggactagactgaatcacagcacaattctaccatacattcaaagaaaaactgctaccaatccttttgacactattccacaagatagggaaaaaaggaattaactctatgaggccagcatcaccctaataccaaaagcaggaatggacataatcaaaaaagaaaactacagaccgatatctttgatgaacatagatgctaaaatccttaacaaaatactagctaacagaatccaacaacataccaaaaagataatccaccatgatcaagtgggtttcataccagggatgcatggatggtttaacatatgcaagtcaataaatgtgatatactacataaagaaaactaaaaacaaaaatcacatgatcattttagtagatgcagaaaaagcattcaacaaattccagcatctctttatgattaaaactctcagcaaaatcaaaatacaagggacgtacgttaatgtaattaaaaggcacctatgacatacccacagccaacataatactgaatggggaaaagttgaaagcatcccctttgggaactgggacaagacaaggatgcctactttcaccactcctcttcaacatagaactggaagtcctaaccagagcaatcagacaagagaaagaaatcaagggcatccaaattggtaaagacgaagtcaaactgtcactatttgatgatatgattttttaccttgaaaaccctaaggactcctccagaaagctcctagaactgataaaagaattcagcagagttcccatatacaagattaatgtacacaaatcagtagcttttctgtacaccaacagcgaccaagcagagaatcaagaactccaccacttttacaatagctgcaaaaaaataaaattaaaaaattaaaaaatttaggaatatacctaaccaatgagttgaaagacctctgtaaggaaaactatacaacactgctgaaagaaatcgtagatgacatgaacaaacagaaacacatctcatgctcatggatgggtagaatcaatattgtgaaaatatacaaatggccaacaaacatatgaaaaaatgctcaacatcactaatgatcaggcaaatgcaaatcaaaaccacagtgcaataccacttcactcctgcaagaatggccataatcaaaaaatcaataaaacagtagatgttggcatggatgtggtgaacagggaacactactacactgctggtgggaatgtaaactagtacagccgctatggaaaacagtgtggatttctaaaagaactaaaagtataactacaatttgatccagcaatcccactactgggtatctaaaccaaaggaaaaaatgtcattattcaaaaaagatatttacacacacatgtttatagtagcacaatccacaattgcaaaatcatggatccaacccaaatgcccatcaatcaatgagtggataaactgtggcatatatatgatggaatactatgcagccataaaaaggaatgaattaacagcatttgcaatgacctggatgagattggagactattattctaagtgaagtaactcaggaatggaaaaccaaatatcgtatgttctcattgatatgtgggagctaagctatgaggatgcaaaggcataagaatgatgcaatggactttggggacttggggggaagaatggaaggaaggcaaaggatagaagactacaaatatggtgcagtgtatactgctcgggtgatgggtgcaccaaaatctcacaaatcaccactgaagaacttactcatgtaaccaagtactgcctgtaccccaataacttatggaaaaataaaaaaaaacatatatatacacacacacatatatttgtgacattcattaaaaatggtaaggaagactattcaatggggggctactacagtggagttttttagctgtgaggagagattgggcttaactttgcatataaagaggaaaagtagaagtgtatagccaaggagaaatgttggagagggtgagggtcagtagatggaaaattactagcaggaaacatcaaagctaggggaatacttgctagacctactcaaaatgaatcttgctgaagcaaggccaatgttaagagatattgaaggtggggaatgaggaattttattagatagcgaggctaggggatttacactaaagtgatccagcaagagtcttgctaaaactggactaaacaggccaaggacagagctcgaagcaggccctcctcaaaaagggatctcagaggagcttgtctcaagtttggtcatagaaaagaagtttttttcagcagttttcatgaaatattttctagaggcatgaaggaaccaagcattacagatatggagggacctgaagggcatatcttcttgtgtctttcttactggttcctgaaactggtttcctggcttgaacaaaaggagaagggtaatacagtaattagcgaagtctgcttcagcagacactgaatacatgaaactgcacacatgctcacatatggcggcctacacatgtgcatacctacacacaatgtttaacatctactgtactgaatggagagagcagcatatgaaaagggactcagctctggttgtctatatacaaactgatgaggtcacacagcaaaagtatacacaatcaagtacattttctgtgattcttaatcctctgctctaaggctatttgtgaaggcaacccttttacaagcaatagccacaaatctcatatttgctttgttcaaattcaggccacttgttttttcttcttctttaattgctagaacctggagaagcaattgtattattaatacttgcatgaataaactgatgactagttggccttggagaacatcttgagtattatcctctgcaatctgtacaactgccccagacgcactttaggagttatgcatcggagatgacaggtaacatgccaccacatcacagaacacaaatgtcttgggtccactccttggattcactctggagactgatgtcggcttgtcaattctgcagcaaaatcaacaagaggaatatggactgaaattctccttaggccatcacatgatgaaatcaattttttttcagaatcataaaatgtattctcattgaaacaagtgatttaaattaaacatcttaaagaaatgactgaaattagtcttgttactttaatctgtggcaagaccatagggggaattgcaaattcccatggttttgaacaaatgcctaaaaggcaagacttttccaattgtagatctttttgttagttaaatcaaaacttaccaggggggaaattgtactaatatagtggagatgaatcaaagttatacaaactgtataagcaggagaacacaatgaaagacagtgagcaagagacttattttgatggattcttagagatgacaggtctaaacaataaacaatgaagctcggttttagactttggagaatatagtatgatttatgaattcacaggtaaaagcgggaacactatcaccaccctagaagaaaatctataatagtatttgaggagtctcttctaaaggctgtggaagtagatagacacacacaggtgtgacatagccactgaaattatttctagaacaagataaactataaatcaatgattaggcccaacttatcaaataagtaagtgtgctatcttcttagaagaatgagtcaaccttttctttctttttggtttttgtttttgttttttttttgagatggagtctcgccctgtggcccaggctggagtgcagtggcactgtctcggctcactgcaagctccgcctcccgggttcacgccattctcttgcctcagcctcccgagtagctgggactacaggcgcccaccaccatgcccggttaattttttgtatttttagtagagacggggtttcaccatgttagccaggatggtctggatctcctgacctcatgatccaccagcctcggccttccaaagtgctgggattacaggcgtgagccaacgcacctggcctgagtcaaccttttctaatctgtcaaaatatattctaactactaattttcttaacaagaagcacaagaataattaacaaagttaattaatgttaaaaatccaaactgatttactgagtgcctacacaatactagataattgtttggatttctaagtcataaacaaaagttactgcatttattcccaggaaacttacaatatagaaaagagacctgcattcagtaaagcaaaacaattgaacatgtcttctattgtaatggaataagaacaggcacggcatagtggatggaacttctggatcttgctgaggggctatcagggagggcttcccagaggagtgagtgcaaacatcatggggggcttgggaaaagaagtaaatagagattcacaagtgatattatcgtgcaagtatatttccaactgcgttatgcgaataaaggacccagatgatgattttctagaacaagttgaaaactaattttgaggtcataatatccttctatttgaagtcaaatattgtggaaaaatgaaatattcattatattcagaaatgaatgaaatcgataaaattcaagcaacactgctcaaagacagatctccctctttctctctctgtctctctatatatgcacacacacatatgtatacacacatacatatatataatagtagacattaaagatacaaaatataaagaaagtagtgactaattttgaagttttaaccaaatatgagacctctttaatgtcaataaaatataaaatgtgtatgtgattaaaattttctaaaaataagtatatgatcaaattatctcaagaaaaaaatagaaaccctgaattgattaataggcattaaactaaataggtagtacaagtttttcctttttcctagtcttcaatgacaccatgtacagatactactacaagcaagttttagcaaacttccctagtttacctttgactttcacaaatttttccagagaatagaaacggagcggaagttatcccacttgttttagatttatataattaaaatgacagactagccaaggacagttcaaaacaaatagattatttcacttaataaacatagtaccaaatccttagatagattaaattgtatttgtaaattgacttcaacattgtataataatttatgtattaggaatgaaaaagttatctacattattcattaagagtgaaaaatacatatgatcatctttaaagagacagaaaaatcttcaaatagattctgctcacaatcattaaaaataaaaaaaggaaactttggaaattagtaatagaaaaaaattcttaaagttatttgccaaaatcctacagcagacaacatacttaatggtgagtatttcgaagattttccatcaataacaggaatagaggaaatatatctgctgttattgctgttcttgtgccttcaaattttgcttttccaatatttattcatctcttctgaaactcctactacacataggctgccacttagcattatatcgtcatttactttaatcctcatttttcactctttccttctctttaattatgtttatactatagaaaagtttagatctatcttcaggcacaattattcttttttatggtttattagtctcttttttaaggtctctattgaatgattcccctatatattatttattgtcttatttgtagaatatttatttgttttcaaaattattcctattttttaatccataatatgctgtttctgtcttttagagtctattcacccttataatcagttagccatttcacttgtaattcagatcattctattgtctcaaggacaagtcttcaaatattctcatgtgtttcatgtactgactttccattggggtggtttctttccctcattctttccctgatttctttcccatgtctatatgttaggagtggcttttgaatcagctcagacctccatattgagcagataatatatgctagattgtttgaaaccactttcaaaatgaccagccaaaattcagttacagctctttggctagactctgaaaggacatagccagaagtgtactcaccctcaccctcataaatgtcaagcttccgaaaaccctctttttcacgggctgcattcacagtcctgtaaaattttttaaaaaatgaggtgttttatgtggttttcttaaaaaaaaaaaaaaaaaagaccccttctctccaattgtataagtttcaggtcctagaaaatctgggacttccctctgggtatgacttttgagaaattagagattcaaaaaaattctaaatatgcaatcagtgattagcaactacagaactattaaactgcccactataactgaaaatctcaaattcacaaaacatttttaagatggaaagaaatatataatcacaaatgaatattaaaagatggcatgattaagagagaattaggaaaagtatcaaataatgagttgaagtctcaagaacgtgccaacagagtatatatgtatatatgcattacatatatatgtacacacatacatatatatatacacacacatatatatatatgttgtagtccatttcacattgctgataagatatacctgagactgggtgatttataaagaaaaagaggtttgatggactcacagttccacgtggctggagaggcctcaaaatcatggtggaagccaaaagccacctcttacatggcaacaagcaagagagaatgaagaccaagtgaaaggagtttccccttatataaccatcagatcttgtgagactttttcactaccatgagaacagtatgggggaaactgcccttatgattcaattatcccccactaggtcccccccacaacacatggaaattatgggaggtataattcaagatgagatttgggtggggacacagccaaaccatatctatatctgtatctgtctaatcatctatctgtctatacatatatatacacatatatatttgttaaaattatgtccatgatacaaaaaagaaatagaaagtcaacaacctaaagggaaaatactccaactgaaatcctattttagttcattcttctagagtcagaaaaataatctttattatagaaatgtatttgagacctcaaacaataaaattaagatttccagtgagcgtgtcaggaagaagcacataaaaagatactgaagagactgcaaatgtagtatcatagtctgaacaattttaaaaatgggggagaaagaatgagctcagaaatggaagattaagcaaatgttctgatttttcaaaatgagtagagaaaagatgtcatttgagaaaattacagtcaggggaggagagactattctagcaaaactctaaataatcaaagaacatgaatggattttcttaagtatatggaaatttttataatatagttgaactcaactacagtagataatgacaaacttgactcattcatctattggatgaaatggctaagaggctcttaggtagcagtagatacactgtattaacaccaagacacaggatatcatgcgaatttctatacaagataaaaaacaagatgctttgaagcagttttcttattcagttctgttgaaacctgggtaagctgctgctggaatgccatgtagctctgtttaaggtttttaactgatatctggggtatttgggtgtattttttttcccaaatttaaaagcattaaagcagatttttcaaacttgtaagtgaagcagctggaggaaaagctaatttagtaggcaacaaaatcaacattcatttatttaggtcaaaacaagagaccaaattagaaacgatcataaaagccttctctttgatgtccaagaatttagtgtagaacattggttatatacagcatttgtcaaaatacaggtttcacataagtcaagaaaagaatgttgccactggccccaaactaatatttgagaaaatgccctaaccacagggaatgaagtctctttgttgttgcaatgggcagaccacacctgtgaagtggatttaaatttttgtggtccacattaataaggacagtgaagaattgaggaagagtcatacaaagggtgtattagtccattttcacactgctatgaagaactgctcaagtctgggtaatttacaaaggaaagaggtttaactgactcacagttaagcatggctgaggaggcctcaggaaacttacaatcatggcagaaggcaaaggggaagaaaggcacattcttcacaaggtggcaggaatgagaagtgccaagcaaagtgggaaaagcctcttataaaaccatcagatgtcatgagaactcactcactatcacgagaatagcatgggggaaactgcccccatgatcctattacctctccctggtctctcccttgacacatagggattatggggattataatccaagatgagatttgggtggggacacaaagcctaacaatatcctggggcaaagaaaagaatgaatattcttttttcttttcttttggtcagatgcggatgctacacacaatatctaaaaattatttgagtgagttatttcatccaaaaagaagcagcagcaatgtaatagaatattaaaacatttttaaaaatcaggttgatcagcaatcagaaaacttccatgctgcttcctttctgtctgaataacttgccattcttcacagaccatggcaaaaagcaagcactgtgtagaactctccagcaatcccaagaatgtgctctgccaactcttattttctaaacagtttgtgtggacttctgtattatagtttttattgcatgtgtattggcattatgcgtttatggctgtattcctctttagagttgagagcagagactgtattttattcaaatttacatggaatcaaattttggcttaactgagccagaccttttaagcaattagagctcttcaacaatggaatggcatgtggtattttgacaggaaggactcaggtgtaaatgttaaggtaaaaattcatccttccagtggctattaagaggactttttcagcaggttggattgggaaagaggtgtatatgaacaaaatgaaagaacataaagggttttcttttaattctaaaattcagtggtttcctttccacatctctcccttctgcccttctcttctacagcatttttggcaccctattccctttccccaccaacaaaatagtccatctaggctgctataataaaatgccataaacaaggtagcttataaacaatagaaatttttttcttatgcttctagaggatgagaagtccaagatgaaggtggtggctgattctttgtctgctaagggcctacttgcttgttcataaatggtgccttcttgctgtgttctcacatggctaaagggactagaagtctattgtagcctcttatataaggacactaatttcattcatgagggctctgccaagaacctaatcacctaatcacctccaaaacaccatacctcctaataccatcatcttggggattaggatttaaatatctgaactatttaaacatatttaaatatgttttaggatttcaacataattttaaacatttaaacatataataaagatggtcctgatataggattctttagtattaagatcctcactggtaaccaaaggttacttcatctacttcaataaaaccacattatggggacacctcttctaagaggctcaactacttccaacaaatggaacatagaggtaaaaagggctctgaatattgatttaaaagacacttgtctgaagtttatcctaacttactcattacatgagctttgataactcacttagtttctctgaatctaatggagttattgaaaacctcaaatagtatcattattgtgagaaaatctgtatggttttttataaatataagtagtactatcagtattatcttcatagtaattctgccttcaatgtcctcagtgtatggtgggtcattgtttggacaggaatatgttcaggatatagtggctacatgtaatactggcttctttccctttatttgcctataagatcattgcactctcccagcagaacgtaatatcatttagctcacagactctaaagatacttaacttttggtatcataggaaattacacatttctattaaagatcactttaatcactctacctttcattcagtgaattgtgacacaccactctgaagaagcctggctgtatatataatccctgtttgtcttgtcaaaatgggcacatgtactcaaacactagagattttgtacttgtgtctctggggatcatccagacccttgaagtcttactgtactttttaaaaggtgcctctactcattgcatcatttgtaggacccagtgcaaaataaaggcatggagtctttcgtttaaaaatataaaaatttcaagatggtgacattacagcattaaactaagcacgaggcctttctgggcatggggccctgtgtaactgcataggttaaaacccatgaagccaccctgccaagtgtccaggcaacagtgaaggtaaaattgctgtaaaccactataacaggagaatgagccttactaccaactgtgtaaacatttgaattaatgcacagagaaatttctgaatagccacaagccttaaaggagcttcaaatacaatacaaactacatttggaactaagaaaaattctgctttaactctttcagagcaaaattgaaaatctacggttctgtctttcagctgcagaactaaacaccaaaaaagcttgagtttctactaaatcgctcttgtgtttcactagaggtggtttcagttcagcaacaaggtgacctcacagcaggatattgaaccactgctgctgttttatgaacttctcaagagatgagaattctgaaagaaggccttgattttctcatattttataataatattcactaattcaatcattcatctgttttattcttcaataataataaatacggtttaattcaaagataaatttaaagaagagaagaaaaatgttggttcctgaaatgcagacatttaggcaatcttcaaaacatttgcttgaataaacattcagactttaatttagtggctttgttgctgcccagtcttttgaaagatatttgaaaattcaggatacatgtttacagaagagacaaacttgacttcattatctagagccagaacacatagtatctgtatatccacggtgattgggactaatgccaagatttgaaataatacctcagacagttcagcttcagagagagaatagcttttgaaaaatctaaaatctaccttaggaacgtacatttctctaagcaaagtgagtatgtaaacaaaatgttttattatcagggatttctccctttccccttcaatgttccctttctctttcaccaggctcccaggctcttgacactcctggttcctcccagtccccttgtgattcctttaatatctatgcctatttctgagatatcccttcctcactctgccccctgcatacccgtcagttgccttgtaatgtccctttccctgaaagcctcgttatttacctacatttaaaatatagattatattaggcttataccctaaccattccacatgagatctacactgtaattgaggcttctaaaaagtgatgtggtatggaggaccatgatcagatcagtggaggcctttgggagacgggggagctttggaaatcacatcagtgaaaggtgtggacaaaaacggccttttgttgttccacatcattttttaatcgtattttttaaagaaaaaaatgaaaagattccctcaagtaagtatattattctggtttcctcagaccatctcactaacatgtttcattcactattccagtatttcactcgcgttggtgagaagagaccaccaaacaggctttgtgtgagcaataaagctttttaatcacctgggtgcaggcgagctgagtctgaaaagtgagtcagcgaagggagataggggtggggccgatttataggatttgggtaggtaaaggaaaattacagtcaaagggggatgttctctggtggggaggggtggggtcacaaggttctcagtgggggagcttttgagccaggatgagccaggaaaaggaatttcacagtttgccagtcctgggcgggggcaaatcctcgagcttgatgtgtaggaaagggagggggcctgagcaatccttgaggggtagtagaatagcagatggaacattgagaagtgatttctttgaggatagatttccacgatggaaaggaaatgagaggttctaagaggcaggctagtggcttgtactatagcatagcctgcctttgctagtgtgtggtgattaggcctggtggaactgccatcagtaaaccaagtgtgatcagggtgaggaacaggaaagaaggaaatatggggaaatggggtgaatgtcaggtggatcagagagatacagtcatgaggttcaggtgtggtatcaggaataatgtgggaggccggattgaagtctgggccaggaacaatggtaattgtgggagactcaacaaagagtgagtacagctgaaggagccggggagcagaaagtatatgcgtcaggtgtgaggaagaaaatagattttggaagttaggagaactgtagagagtaagttgagcatagtttgtgatttttggggcttctaaaagtattaaagcagtggcagccgctgcatgcagacatgagggctaggctaaaatagtaaggtcaagttgtttggacagaaaggctacagggcgtggtcctggctcttgtgtaagaattctgactgcattaaccatgcctaggaaggaaaggagttgctgttttgtagaagggattgaggtttgggagattagcgggacacaatcagcagggagagcacgtgtgtttttatgagaattatgccgagataggtaacagatgaggatgaaatttgggcttgactgaagtaatgggagctgtctgtgaagccttgcggcagtacagcccaggtaatttgctgagcctgatgggtgtcagggtcagtccaagtgaaagtgaagagaggctgggatgaagggtgcaaaggaatagtaaagaaagcatgtttgagatctagagcagaataatgggttgtggagggaggtattgaggataggagagtacatgggtttggcaccaccatggggtggataggcaaaacaattcggttgataaggcgcagatcctgaactaacctgtaaggcttgtctggctttaggacaggtaaaaagggggaattgtaaggagagtttatatgctttaaaagaccatgctgtagcaggagagtgataacagtgtcaggcctctgagcccaagctaagccatcatatcccctgtgacctgcacgtacacatccagatggtcggttcctgccttaaatgatgacattccaccacaaaagaagtgaaaatggactgttcctgccttaagcgatgacattatcttgtgaaattccttctcctggctcatcgtggctcagaagctcccctactgagcaccttgtgacccccactcctgcctggcagagaacaaccctcctttcactataattttcctttacctacccaaatcttataaaaacggccccacccctatctcccttcactgactctctttttggactcatcctgcctgcacccaggtgaaattaacagccttgttgatcacagaaagcctgtttggtggtctcttcacatggccacgagtgaaatttggtgccgtgactcggatcggggaacctcccttaggagatcaatcccctgtcctcctgctctttgttccatgagaaagatccacgtacgacctctggtcctcagaccaaacagcccaaggaacatctcaccaattttaaatccggtaagcagcctctttttactctcttctccaacctctcttgctatccctcaacctctttctcctttcaatcttggcgccacacttcaatctctcctttctcttaatttcagttcctttccttttctggtagagatgaaggagatgcgtttcatccgtggacccaaaactctgatgccagtcacagactcaggaagacattcttcccttggtgtttaatcacgcggggacgcctgcctgattactcacccacgtttcagaggtgtctgaccacatggggatgcctgccttggtccttcaaccttagcagcaagtaccacttttctgggggtgtgtgggaccccatggaaaatcagactgttcaactcacctggcagccactgacagagcccctggaaatctggcccaagactctctaactgactccttcccagatcttctcagtttagagtctgaagactgacactgcccgatcaccttggaagccccctaaaccatcttggatgctgagcttcgggtaactctcacagtggtgggtaagtccatccccttcttaatctctatggaggctaaccactccacattacattcttttcaagggcctgtttcccttgccttcataactgttgtgggtattgatggccaggcttctaaacctcttaaaactccccaactctggtgccaacttagccaatactcttttaagcactcctttttagttatccccacctgcccagttcccttattaggccaagacactttaactaagttatctgcttccctgactattcctgagccacaaccacacctcgttgccaccttttcccccagttcaaagcctccttcacatcctcaccttgtatctccccaccttaacccacaagtataagacacctctactccctccttggtgaccgatcatgcaccccttaccatcccattaaaacctaatcactcttatcccgctcaatgccaatatcccatcccacagcatgccttaaaaggattaaagcctgttatcactcgcctgctacagcatggccttttaaagcctataaactccccttacaattcccccattttacctgtcctaaaaccagacaaggcttacaggttagttcaggatctgcgccttatcaaccaaattgttttgcctacccaccccatggtgccaaacccatatactctcctagcctcaatacctccctccacaacccattattctgttctggatctcaaacatgctttctttactattcctttgcacccttcatcccagcctctctttgctttcacttggactgtccctgacacccatcaggctcagcaaattagctgcaagtcttcacagacagctcctattacttcagtcaagcccaaatttcctcttcatctgttatctatcttggcataattctcataaaaacacgtgctctccctgctgatcatgtcggactaatctcccaaaatccaatcccttctacaaaacaactcctttccttcctaggcatggttagtgcggtcagaattgttacacaagagctgggaccgcaccctgtagcccttctgtccaaacaactggaccttactgttttagcctagccctcatgtctgcatagagtggctgccgctgctttaatacttttagaggcccaaaaaatcacgaactatgctcaactcactctctacagttctcctaacttccaaaatctattttcttcttcacacctgacacatatactttctgctccccggctccttcagctgtactcactctttgttgagtctcccacaattaccattgttcctggcccggacttcaatccagcctcccacaatattccgggtaccacacctgactcccatgacggtatctctctgatccacctgacattcaccccatttccccatatttccttctttcctgttcctcaccctgaacacgcttggtttattgatcgcagttccaccaggcctaatcgccacacaccagcaaaggcaggctatgctatagtacaagccaccagcccacctctcagaacctctcatttcctttccatcatggaaatctatcctcaaggaaataacttctcagtgttccatctgctattctactactcctcagggattattcggacctgctccctttcctacacattaagcttgaggatttgcccatgcccaggactggcaactcttaattccctcttagagtggatagatgatctttgctggcaggggaccctccaataatttcatcctgatgaagttctattctttacttttagagtcactcttattctcattcccattctttagccaccctctacttctccccagccatctccaccacactatcaaccttactcattctctcctagccatttctaatctctccttagcgaacaactgctggctttgcatttccctttcttccagtgcctacacagctgtctccaccttaaacacagactgggcaatatctcctgtctccttacacctctgaacttcctttaacagccctcacctttaccctcctgaagaacttatttactttctagacaggtccagcaagacctccccagacatttcacatcagcaagctgccaccctattccacacttacttcaaaaacctttctccttatatcaactctactccccccatatttggacctctcacaacacaaattactattcctgtggccgctcctttatgtatctctaggcaaagacccactgcaatccccctaggtaactttcacctgctcgacgttcctttactgttcatctccaaagccctcttcttgtttacttatacccagccctgaaaataacagtgaaaggttgctcgtaggtactcaacgttttttcacacaccatgaaaattgaatctccccctcttcgcagttacctcatcagtccccattacaacctctgacggctgccgccctagctggatccctaggagtctaggtacaggacactcctttgcagcactccttctcatctttttactttgcatctccagttttgcctcgcacaaggtctcttcttcctctgtggatcctctacatacttctgtatacctgctaattggacaggcacatgcacactagttttccttactcccaaaattcaatttgcaaataggactgaagagctccttcttcccctcatgacaccaacacgacaaaaaagttattccactaattcccttgcttgtcagtttaagactttctgcctccactattgctcttggtactggaatagcaggcatttcaacctctttcacgaccttccgtagcctctctaatgacttctctcctagcatcacagacatatcacaaactttttcagtcctccaggcccaagttgactctttagctgcagttgtcctccaaaaccgctgaggccttgacttactcactgctggaaatggaggactctgtgtattcttaaatgaagagtgttgtttttacctaaatcaatctggcctggtgtgtgacaacataaaaaactcaaggatagagtctaaaaacttgccagccaagcaagtaattacactgaagccccttggacactctctaattagatgtcctaggtcctcccaattcttagtcctttaatacctgtttttctccttctcttactccgtttagcttttcgattcatacaaaactgtatccaggccatcatcaataattctacacaacaaatgtttcttctaacaaccccacaatatccccccttaccacaaaatcttccttctgcttaatccctcccactctaggttcccgtgccacccctaatccctcttgaagcagccctgagaaacatcgcccattatttctccataccaccccaaaaaatttttgccatcccaacactttaccactatgtcattttatttttcttcttattataagaagacaaacaggctttaatctttttaaggcatgctgcgggatgggatattgacattgagtgggg

SEQ ID NO: 578 - DNA, 21694 bp, Homo sapiens; identical to SEQ ID NO: 577

SEQ ID NO: 579 - DNA, 21694 bp, Homo sapiens; identical to SEQ ID NO: 577

SEQ ID NO: 580 - DNA, 1428 bp, Homo sapiens
caacctcgccttcaaggcgtacaataatagagagaaggcagccaagcggcaatgcatttctgagttacaattacttgcctctgctgtgagacaaaacccagctgcacctccagcacacaagaacttcaaaacgcctaaaccgcagtggtcaggcattcctacaggacctcctccctcaggatcttgcttcaagtgtcagaaatatggccactggaccaaggaatgcccacagcctgggattcctcccaagccatgtcccatctgtgcagggacccactggaaatcagactgcccagctcgcctggcagccactcctatagcccctaaaactctggcccaaggctctctgaatgactccttcccagatctgctcggcttagcggctcaaggctgatgctgcccaatcgctttagaagccccctggaccatcatggatgccgagcttccagtaactctcacagtggaggcaagaatgccctcctaagatgccagaaccttgatattgaactttccagcctccagaactgggtgacaatacattcctattcattataaattacccagtcttggatactctgctatagcagcacgaaacagactaaaggagtatacacaataaaagtctcacaaaacttcaaataacacaaagaggcaagacaactgagtcaacccaaaacatgcatcaaggtcatgaaaagcaggaaagactgagaaaccgtcacaaatcagaggcgtttaagaagatatgtcaattaagtgtagtatcctggcttgtagcctgaaaaataaagaggacataagtgaaaacactggtgaaatcagaacaaaatctgcagttcactttttacaacttgtatatccttctagatattttcaactgattcataatagtttatagcatgctttttgttaatattatatgaacatatttctatgtcattatcatctccataattttaatacttgagtagatttgcattttctgtatatgcattatatatataagaattaatttagacaatcattactatgagaaatgttgtatttttcagtaatataaataatactgtaatgaagtattatcacacgttttagtccaagaatgaaatatgatagcaaaatattattgcatattgtaaacatttctttgggatacatttctttaaggaggatttttgagcctaagattaggcacatttctaaagctttggtcaaattgccattcagaacattttgaaggtgtccattttccttcccccacaaaaaataggtagcattttgatttatgtctttatgaaagcagtatttccaaaatatttttctgtgattattgagataataaatactttttcgtgatgcccatgacttctctaaaacttcgtttttattgtctatatttaaggtgtaccgtatggtgttttgatatac

SEQ ID NO: 581 - DNA, 1566 bp, Homo sapiens
ctccaagcagctgcgactagcggaaagcgcgcgccagctgcacgcagggaaacagttctcattttgtgtgctcggctgactgcacgtccagcctcgggccagctcgagacggccacattgcctggttgaagatggctgagcgtaaaacagaatgcaagtcagctggagcacgtactactggaggcagagccccatgagaaggggccaagaacccgcacccatcaaaatcaagaagaaaggctgaacccggagagaaaagggagcaactgatgttgccatgcagatcccttggttgctatgagatggtaacatcactctgccccaccattggccagtgcctcctcagctgcggtgcctcccaggctgtgtggttctcacgcgggccactgacacagagctgttactatggtgaactttacaatttcctttgattggtggatttcagaaataggccatcagcggaattcattatattcagctaagtaaaaatgaaaaataaatactataactttcccctcatcactaacatgaaggaaacgtgacccttcatgacataataaatcgctgttcggtaacttaggatccttcaggggactgaagcgggatgatcctcctatgccaaatttgggtgggaaagatattccctgtagctttgagtcgactcttcagagttaagggcagtgggccaaccagagttggaacttcagagttgggaggaggtgtgggatggggcatgcattgaaatgtaaactctattgtctctgaagtgatgggtgatgctgggggcctgagtgtggagggcagttttacatctcaggacaatgttttctcagatgctcttccagaaagaaaagccaggagtactcctggctggaggcggcatgcctgaggtcagagtcaaagtagggtttgtgctgtctgaatcctttctcccactctccccagcctggctcagcttctcagcttctcaggtggattggtgagtcctggccaattacgcttcagctcatctctactctcagcaaataggaaaagggagtgaaggactgagttttaactcttctaatttcgtaacctgactctctataagaaaaagtaggagaaagactgaagaacccgagagaacaggcctctgagcccaagccaagccatcgcatcccctgtgacttgcccgtatatatgcccagatggcctgaagtaactgaagaatcacaaaagaagtgaatatgccttgccccaccttgactgatgacattccaccacaaaagaagtgtaaatggccggtccttgccttaactgatgacattaccttgtgaaagtccttttcctggctcatcctggctcaaaaagcacccccactgagcatcttgcgactcccactcctgcccactgagcaccttgtgacccccactcctgcctgccagagaacaaaccccctttgactgtaattttcctttacctacccaaatcctataaaacggctccacccttatctccttttgctgactctcttttctgactcagcccgcctgcacccaggagattaaaagctttattgctcacaca

SEQ ID NO: 582 - DNA, 1566 bp, Homo sapiens; identical to SEQ ID NO: 581

SEQ ID NO: 583 - DNA, 1566 bp, Homo sapiens; identical to SEQ ID NO: 581

SEQ ID NO: 584 - DNA, 660 bp, Homo sapiens
cgcttttggagctccgacctcagcttcgcctgcgagctgggttgtgtaaaggctggtcattttggggcgcttaggggtgggtgccggggggcgcgctttccctcgtgaaggtcgctccaggagtcatgcgtacattcgttcattttgctctggacgcactgatgttcccggctcgccgccgtgccgcagtcacgaggctctccgaacgcctttcactgtgtttctgtttacattcgcgtctgcaagacccggcggcgcgaccgaggcccgaacaggtgctgcgaggcggggcggggagccagtgctgaggggagctccccaggccgggtggttgaagacagcttctggggggaggtggagctctggctcgtggagaatgggaagggtgtggaaaatgaactggtagctacttagccactctgagcagcctgctctgatgggaaatcggtgatggagtcggagggaagtgggaggcagcttgtgggaggccagggtgctcactctctcccctgccagcatgggacctagtaactttcatacatctctatctatctatctattttgcaaagatggggtcttgctgtgttgcccaggctgggcttgaactcctggactcagacgatcctcccgcctcggcctcccaaagtgctggaattacag

SEQ ID NO: 585 - DNA, 2682 bp, Homo sapiens
attcctactatattttaaacctgttcatttcctaccttctcaccctatttgtcaaaaatacatataataatcagtaagttaagaattcaccattgatgtcaattcacagaaatgtttgctggatttttttttttcttttttgagatgaagtctcactctgtcacccaggctggagtgaagtggcatgatctcagctcactgcaacctccgtctcccgggttcaagtgattctcctgcctcagcctccctagtagctgggattaaaggcacgcatcaccacacccagctaattttttttttttttgtattttttttagtagaaaccaggtttcaccgtgttagccagagtggtctcgatcttctgacctcgtgatccaccagccttgccctcccaaagtgctgggaggagtatttttaaagttgttttacctttgtacatactgaaaagcatcacaattaatgagaaaaataaatgcagaaaatccttctatattagaaggctctcctgggtcatgcaaacttgttaacagatatttcttcgggataacttgagaaccttcacagtagacgatgctagtgctgtgctgactatagtgtttacaatgaatcattgaataaattgttaccatccacggaggctgcctctctggataattagcaatttcaatttaaggaagatactataaagtacacttcagcttcgacatcagtagaccaaacactgggtgtttcaagaagcaaggacatttaaatgaaaaaagaagaggaagaaagccctctgttaatttgaagctgagcatctgatccactaaaattgacaaaacataatcgtatacctggggattcatgccgaaacttctgaatcagacaccctggggctgggaactagtcagccagggtgtcttctggatcacacaccctggagaatgtggactttaacatttcttctgagtaattttggcctccagcctgagtaaggatagttctagacctatagttcttaaacctagatgagtaattataagaattacctaggggaggagccaagatggccgaataggaacagctccggtctacagctcccagcgtgagcgacgcagaagacgggtgatttctgcatttccatctgaggtaccgggttcatctcactagggagtgccagacagtgagcgcaggtcattgggtgcatgcaccgtgcacgagccgaagcagggcgaggcattgcctcacttgggaagtgcaaggggtcagggagttccctttccgagtcaaagaaaggggtgacggacacacctggaaaatcgggtcactcccactcgaatattgcgcttttcggaccggcttaaaaaacggtgcaccacaagattatatcccacacctggctcggaggatcctacgcccgcggagtctcgctgattgctagcacagcagtctgagatcaaactgcaaggcggcagccaggctgggggaggggcgcccgccattgcccaggcttgcttaggtaaacaaagcagcctggaagctcgaactgggtggagcccaccacagctcaaggaggcctgcctgcctctgtaggctccacctctgggggcagggcacagacaaacaaaaagacagcagtagtaacctctgcacacttaaatgtccctgtctgacagctttgaagagagcagtggttctcccagcacgcagctggatatctgagaatgggcagactgcctcctcaagtgggtccctgacccctgacccccgagcagcctaactgggaggcaccccccagcaggggcacactgacacctcacacggcagggtattccaacagacctgcagctgagggttctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaactttagaagaatgtataactagaataaccaatacagagaagtgcttaaaggagctgatggagctgaaaaccaaggctcgagaactacgtgaagaatgcagaagcctcaagagccgatgcaatcaactggaagaaagggtatcagcgatggaagatgaaatgaatgaaatgaagcgagaagggaagtttagagaaaaaagaataaaaagaaatgagcaaaacctccaagaaatatgggactatgtgaaaagaccaaatctacgtctgaaagtgatggagagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccgaagttgaaatgaaggaaaaaatgttaagggcagccagagagaaaggtcaggttaccctcaaagggaagcccatcagactaacagcg

SEQ ID NO: 586 - DNA, 2682 bp, Homo sapiens; identical to SEQ ID NO: 585

SEQ ID NO: 587 - DNA, 2682 bp, Homo sapiens; identical to SEQ ID NO: 585

SEQ ID NO: 588 - DNA, 2682 bp, Homo sapiens; identical to SEQ ID NO: 585

SEQ ID NO: 589 - DNA, 10836 bp, Homo sapiens
gtgctgtgggaaactggctaactttctgtaccttcccacaaacacatcaagatagccaactagagagatggcagagaatgtttcctatacacaccagctcctaagacttacacaccttcttacaactaggtctggacagaactgtgcatacacactgcaaacaccagcagtctccctgcagtgtcatactcagaccagtgcctttttcccaacaaaagttgtaggaactacatagctcatccagcgcaactttccagcatccctttccatcccgtgtgtggggcaaatcaaatcaagaggaatacatatcaggggtttctcgataagcaatcattaaatgaatgtgccagaatccttagtggtgttaaatttgtacaaaaagataatgttccttaagacattggcccttcttctcctcttctcccagcaaactcatcctatgcatcaatatccatctgtaaatccactagctttaaaacttccctgaccagctcagcttaaagtaagctcctcctctaacccagtcattcatgcttactctgttaaactggcaagagactgcccggtgacatcccacctcttgctttcttcagctatttaaatctttgcttattgtttaactttatgtttgtctaattttccagacagagtaggaaccttgtgttaaactgctctatatacagccttgccataatgaaacatctaataaatactttcaaattcaaaaaaccacagacaagaaagccagaagggcatgaattctttttactttgttgattgatgtatttgtgcttccttctctccttccagagtttaatgttcactattcgtgagaataaattcaacacctaaaattaataacgaatttcagacatatttgatgttaatgtataagcccaagaagactgaaaaactccacagtagccaagaagtgcaagttagcaaagaagaaagagaaaaactgatttcaactatagaatgatattcatgtttcacatcgaataaaatatcatgaaaaaatgatatgaaaacttaaaaagataactagtcttgtcaaatagaaatgggtggtgtgtgtgtgtgtgtgtgtgtgtgttttaaatttaaaaatgaaattcaaggctcctttgcttaatgaagctagttctttcatcttttaaaatgacaggtaaagtaaaagctgaagtttggggggaaagggagatttaagggcctcccttcagacattaataaacactattccacattctaaaactattagacataatttggcataattgccaatctttcctgagcaaatgcatacaactcagttgttttacctactaacctctttccacaaagagaatgatcaccccaattggggatccaaggtttatgctttcagagaggcattttgaagaaatatattcttgatcctgtatattaaaacagaaattttattttctcaaactcaccataaggagtggaacagagacacatatttgttgacaccaaaagatattttctaagatgcttgtatagaagaaaatttatgtaaggagaatgaagccatttatttttatttcctttcagccaaattccactttaagtttgtcgaattcagaaattgtatagaccttaaaaatattttactctgttaacatatgctttcttatggtgatttcctgtccagcttgtctcatctgtccaatttaaatcttaacccctcaaggcagatactgtgtattttacagtgttttcttcagagcagtattatgctgacaagttcagtaaatcttaaacagcaatagatcttcctttgtcattcttctgctaacttttagtttgtctggctccctaatttcaatgcttgtagatcagtgtcctttaactgaactattgtagtagtaggaattttctaaattttgattattcacttgggatctattccttagaatatagcaagaggaaagaagaaagaaaaagatccaggaaccggggagggagggaaagggtcatattgattacagtgaaacgaaagatagtctttctttcttatttgggtaggatatagcttttcaaagaccaccaatgcttcttaacaacggataggatattttactattcctactatattttaaacctgttcatttcctaccttctcaccctatttgtcaaaaatacatataataatcagtaagttaagaattcaccattgatgtcaattcacagaaatgtttgctggatttttttttttcttttttgagatgaagtctcactctgtcacccaggctggagtgaagtggcatgatctcagctcactgcaacctccgtctcccgggttcaagtgattctcctgcctcagcctccctagtagctgggattaaaggcacgcatcaccacacccagctaattttttttttttttgtattttttttagtagaaaccaggtttcaccgtgttagccagagtggtctcgatcttctgacctcgtgatccaccagccttgccctcccaaagtgctgggaggagtatttttaaagttgttttacctttgtacatactgaaaagcatcacaattaatgagaaaaataaatgcagaaaatccttctatattagaaggctctcctgggtcatgcaaacttgttaacagatatttcttcgggataacttgagaaccttcacagtagacgatgctagtgctgtgctgactatagtgtttacaatgaatcattgaataaattgttaccatccacggaggctgcctctctggataattagcaatttcaatttaaggaagatactataaagtacacttcagcttcgacatcagtagaccaaacactggggtaagtagttacattagactgctttaaatactacctagaacttttatttttaatcatatactcttataaatttctatctaaaacattatatataatcctttagagcatgtagtaaaaatttgagatcttataacacagcaatgaaattacactataattttagtgatttgtcaaaagacttcaagatagaatttattttctgtacataagtaacagaatgtagaaactgtgcctactattttcatagcttttctttttttccagttttgtatgcgcacttataacaataagagatgtagaacattccatacggtcactaatttgattatatctctgtctacgaattaagttgatgggtgcatttcactcaggaaattcagtgctctgaagttgaaatacaggttttatgacctatgtaccgatctctattttgttactaaaaagacctttagacattcaacactaggaaaagattctctgaggcttgatgctgctttgtgactaagatttttaagcaagaagaatttactcaaacgtttttgcaagttcatagttcaaaaaagttcttattacaatcaataaataaatttaacataaattatctcagttgttatttcataacttaaaaaatagaaaaaaggtgcatatatattatttgtcccagattttgaactaatagagggaaaaaaatccttttctcaggcaagatcaaaaatagaccttaataaaatttgacccaatgacttctcttacttcattagcccttcacacaatacccaggaagatcacgaaatacagatacaaaagaaaaatatacgatcagatcattataatgtatagtctctgagatgattttcataaatacatagctgtttagaaaagatattattatgaaagacaaagcagagataacatatgtaattagaaccataatactttaataacatggtattctccaaaaagctcaaaacacatttttaaaaattagcacctcataataatcattatagaaaggtaggtatcctatatgtgaccaccagactttaacaaagaggtaggtttttatttattttttttaacagctttgtgttacactctcagaaatgtattttaaaattaagtgatcagaagacattactactagcagcattagcagagaagagccctctataaaatcaccagtgagacactgaatcatttcttctgttagtgaaagtcataggcaaaagttctaaaattctacaattacaaaaataaatcaagccagtgtgtcatttctgcttttctacattaataaattaaccatgtaacattgttcaaaattatgtcagttacgcatataataatcttttaaattaatgaagtgatgaagcagtttgatgacacccatgatttacagggctgcttttagctaatgttaaaagcctttcgcttaataaattgcccccttgagaaattaccaaaaatgaatattttcaatgctaaatgtttcaaggtttacactttttaaatatattaacaaatggcaagggagacacatttttcaaaatatatcttcttttacatatatttaattgaaattaattagtatattactttaaaaggaaatgattatacaggatcatttatgagaatttttgtgatgcaataaacctgaatttaaacaactaaattaatcctatctttacaaaatttgtagaatgaattgagaatcatttcaagctttttgattaaagagaaacaattctacaaaatctacattcttaaaatatagctagtgctcttcatcgatattattgctttaattctttgtttgcattatttatcaagattgaaatggtattactaataagcttcataatttttataataatttgtgttttgttcacctttatctaaacatttctttatgaattgttatatgtgatattaactcctgtgtatttctcagttttaataatgagcaacaacaatcagaccttacagtcaaagtacatcatttccattgtcttgtggttttatgtggcctctgagacatgtctgaatacaggagaaataatatcttatggagagatgttatgtaagttcattaggaaagcaaaatagatttcagacaatccaggatatgcttgtgtgtcataacagcaaaaaagaaatggagctaaatataactagcaaagaaagcctgaaattgatgttccctgtgcttatggatttgtttttcataatgtggagcctgatttttattacacttctgaattagtaatgtgcctagtacattgggccaatttctttcaaagcatttgcagctccagccctgaaaacagaataattaatttgtgcttcttgagcccaacagatgtaattttaggcaggcagatgtcaagaaaataacttttagaattcttataattgatggcaatgtaatggagaattgcctgttggcatttcaaatgattttaaggaattttaaactttcatcaatgaatttttaatgcatactaataatggactctcatgggtttgtagcctatgcatagtgaaacagaactttaagcataatattattttcctttaaaaatggcttggagaaagtaataaagtgttggaaatgaaagacttcccttttttataatatataactgcatcaaactactcatgaatacaattatttgagtcagtcatatttttgagagttaataaagaaaatttgaaagaatcaatggtctttcaaatacacatatccagtatatgaacatttgcagaaggatccctgtttactactagagctatatttacattcgcatcacttctcccaccacccccccgcaaaggagcctgtatactccctagaggtctccgtgcattttgaagaaatatcacatgagctttaggatggcaaattgcaaaatattacacatctcaaagtttcaaatatctgatattgctagcactgatattgaagtctttagtgtcattgggactatttccaaaaagtccttcaaagagtacaaaattatataggtgtagaaattgacaaaattcttgtctggctgaactaaaatctacgaaaatcacaagagaggtgggagggatatcaagagctctcagagaacctgtgattatcaacagaaaagcagctggccctatttagggatggataattttaaaacatagaagtttaatttctgatggatcaaaccacatgttctaatccacactaactatgggaaatatgattttatgtctctgaatcttagttttatctgtgcttaaagtggactagagctacctatttttagcgagaattacagcatctttttccaccctcctctgttgaactgtagaaacacaatgagataacatacgaaagcatttttaactctttgaaacaattgtatcatatagacctgagattcaagtaacttgatttttccaatttgtgaaagtagataaggaagtaagtacagactaaatacatattgatagtgtatgcacatgtttttacatatctgaaattcttatatggtttttatggcaaatttccttttttaagtatgttcaattgtgataataaatttatattccctgtgcatgcttcaacaaactactgagaagaggaggacaagaaactttctccagcagtggaggaaagcttgattttttccctatcatgttctaaatggaaacctcattggaaactttacgtcttaagtttatagaaacagacacacagtggctgcgaggcttacagaagtatccgcgctctgtccatttttaaggctgcactttggaagttgggcaaatcttttactttttacaacacagagaacagcaaagctgctgctgtttttcaaaatagagtgcagtctgcctcacagagatccaataaaatgctctatttattggctaagcattaacagtgtctcttattttcctcctgtgaccctccttggcagttagtcacacattccgagtaagcagacgccacaaaaatatcccttatgtatatggaaaaagaaaaatcctaattggccatcgacctcttccttccagcttccctggtgtcataacccagtggcttccaatttgtcacccctagggctgggcaatctggactaagaagatgacaaggcaggcaaggctaagcaccagattcagggccagttccttgccctacccagaattgtcacttcgatgagcaaagccccactgatggccatcactgtcagctgaatcagcatttgtgaaaatgtagtgcacaccacaacaccgtgttattcagagcagtggttattactttgtttttattttatttatttttgctgttaccttctattcatagctgtaatattgcaattctatttacaataatgacataaaattcccttttaaaatagatttatttatactttaaagaagatttagagaagtcttctatgcaactaaagttatgcaactaatagcataaggaagcaaagacatggcaataatcatgaaaatgatttgtgaatagctgaagatgagaccacactgaatcaaagaacgctaaagcgattgtggggagaaagtgaccactctccctttcagctagatttttataattacagaattttatagtaaatttttaatttgatctctttatggcaatatcaaagtagatatgatgtattattatcaccactttacagatggggaaactgaggatcagaaggctcaggcagttcactaaaagtcacacagttacaaattctgagagaaatattaagccctcaaaatgaggctttctgccccaaatagtacacaatcttccgtttcccaggctattcaatgaagaagatcacatgaaagctgaagagttaagtattacctttgtattaaaagcaacatttcagtacattttccagccatagatacaaaaggaaaattccttctgagtaatatgagatatgaacctaactgaactaattaattcatgatgatgttagaaggttaactacccgatggtgataaaacattttacggatggaaaaatgccatattaaatactaaaaattaccattacttgtatcacttttcagtgcttatattcaataaaattataggtaaagaaaaaatattaatatcatgcagttttgactcttctgatcagtccttggagagatgttatttaatcctgtttgtcactattgtggggatatcagcatttgtcactgaggactgatggatcaggtagttgataaacatttagagacgtgtatatccaggagatgccaacactttgttgttttataggaaagaatgaaaagtattaaactttggtttagccgctatgtttgtttaaaaagaaaaataaaacagaagtcataatttgtgaaagcagaatttgtagtttcaatagcatatttagacatgaagctgtactttgggactacaattcgtgacatcctaaaattaaaatggttcctcagaaatgtaaacactttgacgtgaaaaggtatatgctcagccccaagccaaagttacatatagtgccggcaaagtctttgatacctctagtcagtcaaatacactcaagatctcagcatggaaagccatgttttctgatccgaaacaaaaacaaaacaaaacaaaacaaaaaaccacataaacaaagatgtcttttatccctgcaattttccaatttaatagccaatttgaagactctaataggaaatttgatttggcttttcataagaatactgtttcacagtataatttatatttttttcaaaagaataaaaaccctgctggttttaactgtgtacttttgcattttccaagaaaatatttcctttagcaatatggacaatatcaacttgatacaaagtaggcatgtaatctgaaataacactctgaagtgtaaagaaatgtaacctaaactcaaagtgaaaggctagaaaccacttacacaggcataattatttgaacccccgacctttcatactgaaattagtgagcattttcattttccatatgcaatcacttactgtcctttttcttctattagtgtttcaagaagcaaggacatttaaatgaaaaaagaagaggaagaaagccctctgttaatttgaagctgagcatctgatccactaaaattgacaaaacataatcgtatacctggggattcatgccgaaacttctgaatcagacaccctggggctgggaactagtcagccagggtgtcttctggatcacacaccctggagaatgtggactttaacatttcttctgagtaattttggcctccagcctgagtaaggatagttctagacctatagttcttaaacctagatgagtaattataagaattacctaggggaggagccaagatggccgaataggaacagctccggtctacagctcccagcgtgagcgacgcagaagacgggtgatttctgcatttccatctgaggtaccgggttcatctcactagggagtgccagacagtgagcgcaggtcattgggtgcatgcaccgtgcacgagccgaagcagggcgaggcattgcctcacttgggaagtgcaaggggtcagggagttccctttccgagtcaaagaaaggggtgacggacacacctggaaaatcgggtcactcccactcgaatattgcgcttttcggaccggcttaaaaaacggtgcaccacaagattatatcccacacctggctcggaggatcctacgcccgcggagtctcgctgattgctagcacagcagtctgagatcaaactgcaaggcggcagccaggctgggggaggggcgcccgccattgcccaggcttgcttaggtaaacaaagcagcctggaagctcgaactgggtggagcccaccacagctcaaggaggcctgcctgcctctgtaggctccacctctgggggcagggcacagacaaacaaaaagacagcagtagtaacctctgcacacttaaatgtccctgtctgacagctttgaagagagcagtggttctcccagcacgcagctggatatctgagaatgggcagactgcctcctcaagtgggtccctgacccctgacccccgagcagcctaactgggaggcaccccccagcaggggcacactgacacctcacacggcagggtattccaacagacctgcagctgagggttctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaactttagaagaatgtataactagaataaccaatacagagaagtgcttaaaggagctgatggagctgaaaaccaaggctcgagaactacgtgaagaatgcagaagcctcaagagccgatgcaatcaactggaagaaagggtatcagcgatggaagatgaaatgaatgaaatgaagcgagaagggaagtttagagaaaaaagaataaaaagaaatgagcaaaacctccaagaaatatgggactatgtgaaaagaccaaatctacgtctgaaagtgatggagagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccgaagttgaaatgaaggaaaaaatgttaagggcagccagagagaaaggtcaggttaccctcaaagggaagcccatcagactaacagcg

SEQ ID NO: 590 - DNA, 17432 bp, Homo sapiens
aatattcttgaagtctgaaagatggatagaaaagagttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttgacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcactgctaaagaaaacaaaatatgctgccactaatttgccaccaccctgtgagcatgattggatgatgtttattttgattaggagattgctccatttataaatcttcaatacatcctgtccccctaaaacggcatctggatcttttgagggttaaaaaaaaaaaaagtgaaattggatgagggatgagagctggacttctgtgtgtcccggggtctctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaaatacccggctctgcagaagcacgctgggcccagggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctccagcgcccgagaagcccagcctcgccggcggccaagttcaccgcgaggccacgcgctgcctgcgctgcgctcccggacccgcaccgaccgcagcgcgcgccgccggtgcttctcccaccccagcctggaagctgcctccctccgcctatccctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtatctctccctcctaagccccggaggggagaacttccaaagacagaaaaccacagggttcctggcacagagctttccctttatcagctaaagcagaatcttttctggccttaacctggccccttcctctaactgtaggcagagaggcagacagaaaagcacttgctgaaacacaaagttttgttctgtcctcaacgaactgtctagagttgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgttatttctaaaacccattatcactgtatgagagattcctttgcgctgcatcctcgacagtgcttcctaaggtccgtcttttctattgtattcattttaatgggtgcatagccgtatctcgttgtgattttaatgtgcatctccctagtgactaataatgatgggacgcttttcatatacttgtttgtcattcataactcttccttggtgaaatgtctgtttagatattttgtccattttttttatttggattgtttgatttcttattattgagttttgggagttctttatgtattgtggatacaagttccttattaggtgtatgatttgcaaatattttcttcaagcctgtagcttgttctttcattttcttaacaatgtcttttgtttttaatttcaaagaaatccaatttgtcaatattttcttttacagattatgcttttgatgtaagaaatctttgcctaacctaagtcacaacaatattctcctagaagctgtagaaatttcaatctgtaatgatcaattttgaactcgtttttatatttatttatttatttattctttgagatggagtctcactctgtcgcccaggctggagtgcaatggcactatcttggctcactgcaacttccacttcccaggttcaagcgattctcctgtctcagcttcctgagtagctgggattacaggtgtgtgccatcacgcccggctaattttttgtattttagtagagacagagttccaccatgttgcccaggctggtttcgaattcctgagctcaggccatccacccgcctcggcctcccaaggtgctaggattgcaggcgtgagccaccatgcccgacccagaacttatttttaaatatggtgtgaggcatggagcaaagtttacttttttacatgtgtttacccaattgttccctcaacatttgttgaaaagacatttctccactgcattgttttatgtctttgtcgaaaatcagtgtatttttggactcttgattctaacgttccattgatgtttgtcttgatttatttttttggccttgaaacaacaatttattttcatctctcatgatattggaggttggccaggttcagctgggcaattcttacttgggttctctcatgcatttgcagttggatgatggctggagcagcaatctggaggctcaaggaggctgaaggccacatatgactccttcatttccatatctagcacctcagtggagtaggctggaacagctggggaatgattgagcttctaattctctccctacctcctatctatgtgtctagttttcacttcttcacagtacggcattctcaggaaagtcagacttcttagtagtggcttaccctagaatgacttttccaaaagcacatgtttcaagagacccaggcagaagctgcaaagtttcctgtgacctagcttacacatcctatagtttcttttgccatattctgtaaggaaagcaagttgctatggccagaccaggttgaaggagaagggtatgagactctacctctcgatttcaggagcattattacggagagggaaggattgttggttgcttctgtataagcaatgccaataatagaaggctccactgtcctgattaatgtagctttataacaagtctcaaaatcaagcaatgttagtccttcaactttgttcttcctttacaaagttgttttgactgtgctaggtcccttccatttacattcgaattttagaatcagtttgtcaatttctaccaaaaagaaagcccttatgaaattttgatcaagattgcattgaatttatggatcaatttaatgagaacttacaattcaaattattttaagatcaatttggtgaaaatttacaccttaaaaatattgagtcttttgacctatgaacctacttaggttttctttaatttattttagcaattacattataattctcaatgtatagatctttctatcttttatcacatttgccctattttatacgttttgacccattataaatggtatttttaaaatttcaatttccggttgttctttgcaagtatatagaaacataattgatttctgtacattagccttatattctatatttttgctaaagtcacatttttagttctagtagtctttttttcataggattttctgcatacacactcatgtcatctacaaataaagatggcttttcttctttatttccaatctcaatctcttttgtttccatttcttgctgttgcactggatagcaccttcagtacaatgttgaatttgtgagagtttctgatcttaagaggaaaacactcagtctttcaccattaagaatgatgttacctataggcttttcatagatgttcccttagcaggttgaagaagtttccatctattcttagtttgctagactttttatcaggaacgtttgctgagttttatcaaatttttttctgcatctattgagacatgcaatcttctagtgccatcattttacaagctcaagtgaagtgtagggcacttacctttctttacgtcctactatcctctctgtttataatataattgcttaaatattttctctgcatatatttaggatcacattagatagttataatttttacttcaactgtcaacataatttagaaaagtccagtgaagaaggaaagtctattatacataccaatatttttgcttactattatgttaatatgttctttcttccttactgatgctccaatattccttcctttactgtttgctttttgtttagaaaacttttttttagctgttcatttatagtatgtctgctggtgacagatacttttagttttccctctcctgagaatgcctttatttccattttattcctgaaggacctgtgattggggtggggctgtggtattttaagtggtgtttggctagagtggagcggttattgcccaaagcttttctgtcttgctgggctgccactgtccagctccttaggctggagagagcaggcttttgttggggccttcttggtctcatttggaatttctgagttcagtttcttcaactatatatctgggatatacaagacagaaagaaaccagggcactctccaccatgttgttcctccagtctcaagatctctagacagtctgtcttctctccatctttcagagtcttcttgtgcatgttttttatataacatctacactttttagtggcgcttagcagaagcaatgggacaagtatgtctactgcagctttctggaagagaagctcctcatttctttttttggatacatttcaaaagaagttgcaaatatatgaccctacacatttcagtatgcatatcattaactacagctcaacattagtttatatttttctttttcttgtgtgagatgaaaactatacatacattgccatcaggctttgcccaggcatcagaactcactagacagcagaatatacatctttgagaggaaccacagaaatgtaatgtgcatgctaaggcttttacctgaacatcaaaatggaaacatcagagtattcatattagagagcaaccttacaattataatggatgtggtaaggctttttaaaaaatcaatgttcaaagacatagaatcaaccaaaatggccatcagtgatagactggataaagaaaacgtggtacatatacaccatgggatactatgcagccgtagaaaggaacgagatcatgtccgttgcagggacatggatggagctggaagccattatcctcagaaaactaacccaggaacagaaaagcaaacaccacatgttctcactcataagtgggagctgaacactgagaacacatggaaccagggagaggaacaacacacactgaggcctgccactgcaggtgggggttcaggggagggagagcatcaggaaaatagctaatgcatgtcaggcttaataagtaggtgattggctgataggtgcagcaaactgccatggcacacgtttacctatgtaacaaacctacaaatactacacatgtaccccagaactaaaagtaaaataaaagaaaacaaatttcaaaaaataaaaagaaaattctaggtacattgaaatatgcaattcttacgtgcaccatttgatgagtaccacccacccctctgtcaagatacagaactcatccatcaccccacaagttccttcttcctccttcacagtctaatcccttccccagccacctcgcggggacaaacattgttttgttttgtttttttacacctcctagattagtttcatcttttctagaatgcagtatgaatagaagggatatcatgcactcttttctgtctggcttctttgtttcagcctaatgtttttcatatttagcaagttttataagtcatttgtttctgttgctgagtagtattccgttgtgtgcatataccacagcttgttgatccattcttctattgatggatatctgagctgtttccaggttttggctagtatgaataaagccaaagagagccattttaatttggggcatttaaaaaatggtgtgaataaactttcatctgaacacagggttccgtggtaataatgtttgaaaatatcacctccagctctgacgtgccgagtttgtaattttcgtaaatgatataaaaagtcatttcttcatccattcatttgttcactcaacccttatttagtgggcctattccctgtgccaggaatcattcaaggctcagtggggaagagaacaaatgtaagtaagtcggcctggtgcagttgacatgctagtgagggaaaagacaaaaacatcagttagtgaatacctgttatgacggaaaagaagccaggtaagtgggtagggcattacagttggtccagaggtagtcagggtgtcattttagctctggaagtagggagaggaacttagggagatggtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagtgtgtagcatgtccctctgtctctcttcctcctgctctggtcatgtgaagatgcctgctctggctttgcattctgccatgagaaaaagtttcctgaggactccccagccatgcttcctgtacagcctgtaaaactgtgagccaattaaacctattttctttataaattacccagtctcaggcatttccttatagcaatgtgagaataaactaatacagaaaattggtaccaagagtggggtattaccataatgatactgaaaatgtggaagcagctttagaactgggtaatgggcagaggttggaggagtttggaggactcagaagaagaagggaagatgaaggaaaatttggaactttctagagacttgttaaattgttatgaccaaaatgctggtagtgatatgaagagtaaagtctaggctgatgaagtctcagatggaaatgagggacttattggaaactggagcaaggtcacttttgttatgcattagcaagaggttggctgcattgtgcccctgctttagggatctgtggaactttgaacttgagagtcatgatttagggtatctggcagaagaaatttctaagcagcaaagcattcaagatgtagcctggctgtttctaataacctatgcttatttgcatgaacaaagaaatgatctgaaattggaacttacatttaaaagggaagcagagcatagaagtttggaaacttgcagcctggccatgtggtagaaaagaaaaacccattttcagggggaggaattcatgcaggttgcagaaatttacataactaaaaagaaggcaagtactaatagccaagacaatgggaaaaaggccctgaagtcatttcagagagcttcatggcagcccgtcccatcataggcccagaggcccaggagggaagaatagtttcaggggccagaaccagggtctctactcccctgcacagctttgggacactgtttcctgcatcccagctgctacagctccagctgtggccaagagagcccaaggtacagctctggatgctgttccagtgggtgcaagccataagccttgatgactttcatgaggtgttaagcctgtgggtgcacatagtttaaaagttgaggcttagaagcctccacctagatttcagagaatgtatggaaaaacctggatgtccaggcagaagcatgctacagggttggagccctcatggagatcctctactagagcagtgcagaggggaaatgtagggttggaccccccacacagagtcttctttagggcactacgtagtagtgctgtgagaagagggccaccattctccagaccccagaatggtagagccacaagcagcttgcaccctgtgcctggaagagccataggcactcaatgccagtccatgagagcagctgtgggggttgaaccttgcaaagtcacagtggccaagctgcccatggctttgggagcccaccccttgcaccagcatattctggatgtgggacatggagccaaaggataatattttggagctttaaggtttaatgactaccctgctgggttttggacttgcatggggcctgtagcctctttcttttggctgatttctcccttttggaaagggtatatttacccaatgcttataccgccattgtatcttggaagtaactaacttcttttttattttacaggctcataggtagaaaggacttgctttgtctcagatgagactttggactttaaacttttgagttaatgctgaaatgagttaaaagactttgagggactgttgggaaggcatgattgtattttgcaatgtgagaaggacatgagatttggggaggagccagggtcagaatgatatggtttggatatgtgtccccacccaaatcttatgttgaactgtaatccctagtgttggaggtgggacctggtgggaggtgattggatcatgggggtggtttcttatggcttaacaccagcccccttggtattgccatagtaagagtaagttatcacaagatctggttgtttaaaagtgtgtagcaccttccccctctctctcttcctcctgctctggctatgtgaagatacctgctctggctttgtcttctgtcatgagtaagtttcctgaggcctccctagccatgcttcttgtatagcctgtagaactgtgagccaattaaatctcttttctttacaaattactcagtctcaggcatttctttacagcaatgtgagagtggactaatacagggaccttttaagaggaagtcataggagagtttttggagaaggtaaggttggaagaaggtacaaagaaaaaagcttatgtctttaaatcatcttcattcctgataattcagcacactttagaggcaacttccaagtcagctgttgatggtagtgaagacccaaggcccagagagggagcaactggccctagagttgcatgatgagtcttcagtggcaaggccgagattagaggtctgtactcagcattcagctattggtggacagaactcgtcctttgcttcctaagtgcggcttcagtcctgtcatggccctgcacttccccgattccctgcccactccgtccccacttcttcaggtgcttccccatgggaactggtagaatagtgttagaaagccacatccatagtatggcctcttgaggatttctggtttgtgtgactttgagcaagtcctcccctgatgttggaggattcttacccctgaagttggggaaggagtgaaatcttgatggtaggacatccgctcacatgtcctttgagacttaccacgtttgtcaccatgtatttagcacagctgcctttcatctgcgaatacagcctgggagctctttatgttttatctaatttaattcttataacaatcccatggagttgttaggtagtaaagtgctctctctgtttttacagatggaaatctggagactgagtgaggttgagtaatttgcccgaggttggcaagaggctaaagtagaattctaaaccagatctgtttgattctgatgctcttgcttttagccacaatgttttagcatctgttcaattctgaacagacggacagaatttgcagaggtcagagggaggttctagaataaagctgttctctagtttacaggacagaaatggtggtagtgatatgcctgtgccagttctgggatgtgcagctgggagggaagccttctgtggaccaccatgtaggagggagagcatagcagggtatgatgggaggagcatgggttctggaattgaaaaatcctgtgttcaaatccacactctaccacaaatcccacgaatggaggacatttggacaaattgttgaagccctctaagcttccattttcatgtctgtaaaacgggataataatggtatctccctagagggttgctgggtaggtacaatgagatgatgcaaataaagtacttagacaataccaggctcacagtaaatgcctaataaatgctggctgttgtttttattcgctattgttttgaaaaatggcaggcactacagacatacaaagtgcagagagtggaaagacaacaatgtgttttagggccaggcagcccagagctgcccaggctggcaccctgcccagaagtgggagtgatctagcagaggccagggccttgcaggaggatttttgcagacacccaacttcctgcatcagtggggtcgagtgatctctggagtgccttccgacctggagaggtcatttcaagtctctgcaacggtagcgatggtagctccagcaagggagggagaaggggcttccactggctcttggacactccagctgtcatttttgggaatgtgcttatctgccccagagggaaatagatgattgagaaaggaggcaaccaggggacttaggctttaccagcagtgacctactagctccggtgtgtctgcctcagacagcaggccaaggctagtgtcacggcagtttagggggtcctgcacattcactgtgccaacgagcggtattttgcaaacttattataaacagattatatttcttatcctaatgtggctgttggctacctgcccatgaattttagcctccaggagaaaaacaattgcttgagctgagtgttctgtgcttttactttccatacattactcagggctccttccagttcccccaacccttaatctctctctttctctctctctctcgctttcattctctctctctctccatctttttccttcttttcagaaagtcctctttcatcttgggcataactagaaaatctgtaagctgtgctttctgccatgcattagccaacagggtcctttcctcccaagccagggaagaaagcacaaaaaccaatgtccaggctgggcctctcagggtccacagcatcacaggcaaaggaagtaactgtctccatgcctaccaacggatccacacacatctcgctgggcagcatctctgccccaggaagcagcgcgcttactacactgggcacccagatgtctggtcttgcgtggcaggcagccactttctcctggccttttcttgtcccaaaagtcagaggggcaggccagttccagaatgggattccaggcagaccaggagactaggagtgcatgtgaacaactgcaaggggatgcgtctgtctgcctggtgtccgtgtgttcatgtgcacacctgtgcacgcgctcccccagacttacacactcgtgaacacatgctcacacaagttcatgcacgggagtagctccaagcctctcactcagcactttgctattaatagctcacttttctaaaaaagtctgcttagccgtttgtaagaataaccaccactgcctgtgtgacagcccaggcccccgcagggaggacagggccggccctctgctaggactgcctgactgcctgcctcatgttagaatccagagggagggccaagaggggagatgaaaacccctcctgagtggccagggcagcctccagtgcctgtgcccagggacaaggcaactcactggtaatgtctgcgggcaattggccaggcccctgagagccaagatgccaccttcttcatggtgacagcagggagcatgctccatgaaaccagaatgagcctgttctccactctggggtcctgctgtaaaagccaagaagcagagagccaagctgagcccaccaagagcttggcacgaggctgtcacccacaacttctcgctgatccaaaagacaggctctgaggctggaaattcaagtgtggtggtgctgtgacacagcacacagccaccgtgcacttgtgtccctggcagccgcaatccgggcctgagagggcccagtgtctgtgggtgtttgtatttaattgcagtggggtgagaaaggccaatggttgggttttatttcaaacctgctttgaggagaagtaacattaggtggcccagagctgtgaaatgtgtcctggtcataaatgcctcaccatcaattaacacctccagaatacctaagagttgccagcaacttcccattcaaataacctcttaaaccttcctccacaccacactgcccattccctcgcaggcagacctgcatggtttgatgacgactggtcacactgctggccctatctgtataaaagtccagacagttgggctgtgaggggaaatgcctacctcagagtagcttaagaaagaaagatattggtttacttctgaaaagctcaagaccagctgagtttaatggcatcattaaactcattagacatggggctgggaagtggctgccagcagtttggtgcacagcctgtcctctcagcagcccaggtggcaggtgtcttgggagtggcaatgatgagaccagctgctcatcctgggctggtcattgtgactcagatgtggagtgggctggttagtggttctgggccacttgtccatctctggatctggcagctccatctacacagtgtcgggctaggcatgggagcattctgggccaggagaaaggggattggatcctggatggtgggaaccgcaggtgtccccctccacgtgcctgggtccaagactgctctgctctggaccttctacgccttcagaggtacaagttgcagtgctacccttgctgaacctacaaccctgttcaagtgacaacttctctgagtctcatacgaggatattgaaagaaccttctgcacagggctgttgtgaggattaaccgtaataatacaagaatatctggcacttgcattcagcaactcaccgcttacttgttcaaccaggtaaaaaggttctgatcccagtgttgcaggacagaaagacctccccctctgtagctgcagatgtgacccagcacagaaaaaatggcaggtgaaagacaggcaggaagagcaactaagaaggtgggaggcacctccataagatgcctgaggccatggggatgaccgttcacagagctagtccctcgagcaatgtgttaaatctactgaactgtgataaagcaacttctgggtgaattttgtcctgctacaagttgtcatggaatggcaaggtggcagatctcagaagtggatccaatggtttttttttagttaaagcagaacattcctggggatggtgtcaaactcccttccatactgttgagtctgctgatgattacactggcttctcctctttgccccatcatttcacaggttcccatcttaaagaggaagagaaaggaaggagggaacgaaggaagggagggagggagggagggaggaaggaaggaaggaaggaaggaaggaaggaaggatggaaggaaggaaggaaggaaagggagagagggagggaagaagagagggaaggaagttatcaaacccaagctctgtgcagagcaggagacgtttccatgggacccctagaatagataggttcttgctgctctcctggtggatggagatgcccaccagtagctgtgagagtctccccgaaggcctgattgtggctccaagttccgtaggactcactagtctttttttccctagagggtcttgccattgagaggcaggtgatgtgctgtttcagaaaacaaaattgggacatgtcctgatatgacatccatcaaatatatacagataggtgtcacagcccccgaaaaagcttatctcttctaggccacacatagctatttcctccaactgtgtcagacattacaaagtttctagcaatcaaaacaagtcaaatgccattctcaggacccgttggaggattttttgctttgttttggctttgtacggtatccataccattttccaaattcttttgtccttacatattttgtttttcttaaaaaaaaaaaaatcacctataatcccatcaccagacaaaaccactagaaagaaaccaacattttagccatgtttttctgtatataaaaaaagtgtgtgtggaatttttcataacaatattgggaccatgacatctatcacattttttattaggaaatggccttcaacaatatgcatttaacaatatgcttgatgtctgtgtaatatttcatctaacaaatatatcatgatttatttaagtattccctgattgcttgcttctaactagaaaaaacaatttttctaagtgtcaccactgggttagagtaatctcagccaatcctcctaatagcactgtgagaccagagttatgataatcttcagttaatggacaagggacatgatggtgtggaaggataaataaactacccaaagacaactagctagtgagaccagcatggacagtcaagcccagtgcatgtaatctgtgctcccctgcactgttgctcatatacttggacccttgcatacatgattttcttattcatcttgaaagagaaatgttagcttactgtttttatttgcatttatttcgttgcttttgagtttgagcatctttccatttcttatagaccatttgcatttgttttcctacaaaatgcctgttcatggcttttgcccatttttctgttagccttgtcctatgtatacacacatgtatattattagttcactatctgtcaggtaaattccccagttttcttcttgccttttaatgttgttatggtcatttaggactagaaagttttaaatcttgtatgcctatcagtattttactgtgtgactattcccattatttttatgcttagaaagttttcattcctatcaagtatagataaatgttcagttctactattttattttaactgtgcagtgggttcatttttggcattgaattaattaatctatctggatgttatcattagtttccttctgaaaaagtcagtccaggctgggtgtggtgactcacacctgtaatcccagcactttggaaggcctgagtccaggagttcaagaaccagcctgagcaacatggcaaaactgtgtctctatcaaaaatacaaaaattagctgggagtggtggcacatgcctgtgttcttagctactcaggaggataaagtgggaggattgctggggcctaggaagttgaggctgcagtgagccatgattgcacccctgcactccagcctcggtgacagagcaagaccctgtctcaaaaaaaaaaaaaaatgcagtccagatgtactggaacaagcttgtgtgggatggctacactcctttcctgttccaacacacctgttacctggatgagctcctatatccttatccaggtaccagatctgccacacctggtaccggcatgagccctgtggggaacataccagcagagacattatacttccaccgagacaaaataaagccacattgacttttagtactcatattattgactgacattaaacccatggcaactaaaatctcgttgttgttttttttttattctgggggtgagggtacaacttttagagaaagtatctctccctaagactgccaatcactctaaatttgcatctaacacttctacataactttatctaccgagtaggcagtatttaccgtctgctgtttcatcttgtagcataattttcttttatatttccaggtgtgaaaatattcaaactgacccctaattctcagctttcagagctatctgctacttcccaggtcactttggtttttaagcgctttcacatgctgttgttggacatctgggttattcccaaatcttgttttcacgtaggcagctgtcaagtcaagatagccatggccctgcctgacatgttctttaagattgcattttatttttattattttattttatttttcttggagacaagagtttcactctgttgcccaggctggagtacagtggcatgatcttggcttactgcaacagatcttgacttactgtaacctccgagtcccaagttcaaatgattctcctgcctcagcctcctgagtagctgggattacaggcaccagccactatgcctggctaatttttgtatttttagtagagatggggtttcaccatgttggccaggctggtcttgaactgctgacctcaggggatccacccagcttggcctcccaaagtgctgggattacagatgtaagccactgtgccaggctgcatttttaatactgtgtttttcttgacatatattccaactaaattcttctgggtgttgttggtttgacctcatattcggtcctattgaaatgaatttgaatcattcatgatttggttatttattgcattcattgtccttctcagcttctggttacccacacattagacacaagtgcctttggcatcttttttcaaatctacagatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatg

SEQ ID NO: 591 - DNA, 17432 bp, Homo sapiens; identical to SEQ ID NO: 590

SEQ ID NO: 592 - DNA, 3471 bp, Homo sapiens
aatattcttgaagtctgaaagatggatagaaaagagttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgcctttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttgactcatgcccaaagttacggaggacccagcaaccatctcctgcagcccctggaaacctcttgactcttctgtgatgtccccagtgatccagcagccctggccttcttttgatggcttgaacatttggtcttcattgaacagtttgtatattggaaacttgccagcctccatccacattccaacctccgtctgcatccctcgaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaattgtttgcttattagctatctttaaacgctgtttgaaaggatatcgaatagtgtttgagggaaccctggcacgtccacacagctcatctgacatgtttaaatgtgtgttgggcttgactctctcataactcagccacgcttgccttgctgcttctcatacctctccagattgctgtagagtcagtgtgggcagactgacatttgagagaaacgtcgggcttcatctggaagcctctttccacacccaccctgatcgtggcctgtaaactgtggccccaagatctccattaaccttgggctttccactagagacatctgccatctctgctgcctccctcccctcacacatcctttactgcttcacttattcatcccataaggatttcttaggggcctgctgtgtgctggttctggagacaaaacagtggatgggaccaactcagccccggtccccacccagcacctctagccaagtctgagtgggctctgctgaagaagtgttgggtgcagtgcacagttcatcatggtcgatggctccatcccatttcacttagatgccccgatttcctaaatgctttcttgaactctgacactctgggactggcacctgaacagtctataaaacggtgaaatgtcgaagcattcctgctgtgtaatcccactctcttccccaacctcaagcaggacaatttgaccccctcctgaggacatggccagacaggccattagtagaagccttccagaactttctggcaatcttcacttttaagcttagcaaacatctaagaataattttaaatggccatgtttactcttttgtacttgttggaattagtttaccaataggccatgatggtgatcacaaaaccccctatgtacatgcacagtgttcattgcaatgcatatccaggtctcaacccaatgtccctttctcaaggagaattccctgagcaccatgtcgtgagagaaccctccttcctccccaccatttctctctatcttgtgattttattttattttattcatagacttatcattatcagcacttatcctgaatgttcaattatcatctgtctgtctctcactccactcccaaaaggcagactgtggtctgtcttatttcccggtctgtccccagcgtttgagatccgagcctcatcaacaactatgtgctgactgggttcatcctcttattacttctcaggcacaccgagatgctgagcagcccagtgctctgaccatgtttggtggataaggaaactgatctgagtctggtgaatggcctcactagggtgaggacccaggctttcctctgggacatcacccagcagaaaagggtgattgtgaactctctactgtctggacagtcaggttctcatcagaaaccaagctttgccctgctgatgaacttcctaaagtttatgtaatttgcccccatcctggaagataaagaccactgtgttgtggagggaaatagcctcagctgggcgtctctggatgctactttctccagcagaacactaagaagatcagatgagatgaacacaaagattccaccctgccctgagtttctgctggttctacctggctaggttctagcagaagagaaggaagtatacaagggtaacatgtgcaagggccgtgtacaagggtaacatgggcatcagggacagtcctcctgaggatgtgaggagccaggcccaactgtgggctggcaacctgccccaggggttgctcacactcacctaactccggcccctctggacacaccccttgcccaggtgcaaggggctccactgggaagaacatctccacccaagtgatcactcttcctctgcgtttttgagcaggatgaaaccacattctctacccatttcgcagtcttacccccaggattatttatgacctcaaaaagatggaagtcacaggtgcagggaggaccagacgtaacccatatgatgcctgcaggatagttagttcacaaggatattaggagaaagagcaaaagagaagtgaccacacaattctagatggttaaggcaatagttctgaccctggccagacattagaattacccagaggttataaaaaatccagacacccaggatccacttggaccaatcacatcagaatctggggattgagggggtgtagacatcagtattttttacaactctgcaggtaatttcaatgcatagccaagactgagaaacattggtctctcaacgtaccatccaatgtggtagctgttagccacagatatctatggaacctttaaaatgtggcttgtacaaccaagggactgaatttttaaattcctttttattttaaatttaaatatccacatgtgacttgtggctgccatattggactgtgcaggtacagaacatgtctacggtcacaggaagttctactggctagtgtggtccaggggaacctggagtcctataactgccgagtgaaatcctgctgatcctgaagggactttaag

SEQ ID NO: 593 - DNA, 736 bp, Homo sapiens
gcaaccagcagccctcagggctgctttggctagaagtagccattctttattcctttacttttctagtaaacttgctttcactttattccatggactagcctcgaattctttcttgtgtgagatccaaaaaccctctcttggggtctggatcaggacctctttctggtaatatctttctggagaccatgaagggacgatactgaggagaccctcaactccaaggaaatagactgcagcaccaattggaagactttgaaatcctacagaatagcccaatttctttctgcaagaaaaagcctattcctgccactctcctacctaagaagagtttgggtgtctgagctgggcttggtggcagaatcccagatgcttcacctgggccaaacacagcacaaggagatctcggtgatgaagggaagacagctcttaaataaccaatggcataccaggaatatgcttgttgcttcctatgttaatgaaaattgcaaaatgttaatgtgcaaaattgagaggatatgttccgtacattacagatgtaataaaatatgaataggtaacagctactgtgtacgatgaacctatgaatgtagcctgttcctcaaacttacttgatcacacttaaaaaaataaactataatgatataaggcaattgttcacttatttttatactttctcttggaatgacacttcatgaaacaattccacacccactcatttattttatgcttatagaag

SEQ ID NO: 594 - DNA, 7049 bp, Homo sapiens
agagagcgccgactctgaaactacccggctctgcagaagcacgctgggcccaggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctcccgcgcccgagaagcccagcctcgccggcggccaagttcaccgcgaggccccgcgctgcctgcgctgcgctcccggacccgcaccgaccgcagcgcgcgccgccggtgcttctcccaccccagcctggaagctgcctccctccgcctatgcctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtgtctctccctcctaagccccggaggggagaacttccaaagacagaaaaccacaggcttcctggcacagagctttccctttatcagctaaagcagaatcttttctggccttaacctggccccttcctctaactgcaggcagagaggcagacagaaaagcacttgctgaaacacaaagttttgttctgtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggcaggccagaaagcagacccagggaggatagcacatgtcttcggctacactggtgaaggcatcgtgcctgctccacagcacatttttattcaagaacaatccatttcacagatgaagaaacagactcagtgagcacgtgatcacttctcacaactaatggagccaagattctgtccttatggctccagagacctcttttttttcccactgtaccacaacactcaccaggactggagtgccacctatgacctcattgcataatggatggcttgtcctcaaatgggcccggctggaggtaccatgcacctttgagggaccaaggacccaagacttgaggtagacactattcccagctggatactctcaatgttgaggatatagatgcacaaaccaatgcagggaggcctccaggagccactggagaagaaatcttcagatcctaccaggcccatagctgttgcctttgtgggctcctgggttaatttccacacatcagtggcccaccttatgatatcctccctgcatgccacactcccggccatgctctgtggacagccattatttccagtaattgctaatgggagccagtctccaaagagtaatgaatcagaggtgttccttggaatgtgttacactaggacttcgccgatctcacaggctcctttccagatgagctgactgtaatctctgggaagctggatctggaggaacaatgggatgggatttgcggtgacccttcctgcccttcttgagcagcttgtgaaccagaagatgtgcctggagagaaagcctcatttggggaagtgcagtagtcgaagttctttattttgaaaatggagaacaacccttctcacaatcctgtctccccttccccctttccaactagaatatcagctcccctgaacatgagtcagtcacatttcagggaaaactggctgatgttgaagaaatcacttgagggcaaactttgtccttcaagctgtgggtctctgaagtgtagagccagcagatcccccagtgtagggactgggccttccttgcccattgaatgctttctatacatgaagacttggagctctttacagatgacagtagccagtgaggaagataaaagaagagaaaagacccaaaatgcgggtttgccactcttttttgccagcaccgtggggacagtcactctgccttctttccaccacctccaacttcacactcacacgcacactctggtcccacagagcctgtttggtacttgcctgacagcccaccttgaaaccagatggtcatgaacctgtcaccaagtcatctgaagatcttccactgcaacctgtatggcatctgccacagggaccatgggacatgattgaagaaccactccagtgcagttgatgaaggggtgggtctgcactggagttaggtgcaccagggcctgggccaagggtgggctgggtccatcttgtgtgtggtggtcttcttcagagtagcagctgattcagagggattccatagaactgcacaggctaggtctagtcagatatcttggacattttctatttctagattagagaatatagcatacgctgattttaatataactgtgtatgtgactttttcagtgagaaaaattttaagtgatgttctaaacaatttttggcatgtagacagaatagtcaaatatctgtttaactagcaacatagttactcgtgcatatttaaaatactacatgagtatggcctggcacagtggctcatgcctgtaatcctagcactctgggaggccgaggtgagcatattgcctgagttcagtttgagaccactttggacaacatggtgaaaccctgactctataaaaatacaaaaatgtagccaggtgtggtggtgcgtgcctgtagtcccggctacttgggaagctgaggtgcaagaattgcctgaacctgagaggcagaggttgcagtgacctgagattgtgtcactgcactccagcctaggtgacagagcaagactacatctcaaaaaataaaacaaaataaaataggccctgtgccgtggctcacgcctgtaattccagcattttgggcagctgaggcgggcagaccacctgaggtcaggagttcaagaccagcctgaccgacatggtgaaaccccatctatactaaatacaaaaaattagccaggtatggtgatgcatgcctgtagtccaagctacttgggaggctgaggcaggagagaatggcttcaacctgggaggcagaggttgcagtgagccgagattgcgccactgcactccagcctgggtgatagagcaagacttcgtctcaaacaataaaataataaaataaaataaaataaaataaaataaaataaagtaaaatgctacatgagtttggaaacattgctttttcccacattactcacctcctttacagcaccagcatcttggtcgacacaagatctctctttaattatgtcacagtttgttgatgaatacattgcctttgcttcagttaaatcaagtaggatgcagtgactccaagtctgaggggtgcttcccaggaagagccaccccccacagccatttgcagagcattggagtaagttttaccttcatcccttagatgtgaatttgttatcctcactgtgacaatcccttatcacatggcttttagaaggattctcaaaaagctagactctcacattcaactttgcaattgcctggctgggtgttacgtttctttgcctcctattagagaccctatcagcatctaaaactagcgttgtttgaggatgttggagccaacggttctttgccagatagaactttgtgtgtccaaataaatggttcaaaatcatcaagcaaataaataccctggaataagagaagcctcatgaggatttgactccaaattgacttcctctgttctgcagtaagaagttaggaattaaaccaaaccttgcctgaggttcaggtatactcaaaagcaatgaggtgtggctcaggtgtgcgctggcaaggtcactgtgaagttcagccagaggctttgcaagcctgggcctgagaagccagacctcttagatccagaagggccaatggagctgggctggcctgctgccactcacaggcagagactctgccagcagaagggactctgctgtcagagctggagggcagcggaccacatggctgaggcccaaccacaggtctcctgactcaaaacctcttcccagggcttgtcctcctccctaaatatatgtgccccaaattgtcaccagatctcgggaaagcactggctttgtctgggataaacaccaactccacagcacacccagtcattaccagattggcagttgttgtctaggtcttgtggcttcttggggttttctcgggtgtctctctcccaaatctttcccctttcctttgattatattcacataaacattgagctttgtagccctcaagctctctcaagcataactcactttgtccctctctgtttccctatgcagtcgcctctccctctgctgtcagaggcccatccaactgctccagccctgtggctccagcgtctcctcctctctctttcccctgctctgtttctgggaagatctatctgagggtcctgaaggaggagactcgaggttgttctcttggacaaagaggtctgggtggatgacataattcactttacgtcttagaaaaataaccttgtggctcttggctctcctgggctgtcattttggttgcctaagggctctaggcagaaggccagggagcccagccccagcctagaacttgcagggctcagagagctgcagtgacggggtgtccgctgtgcctgccgccccccttgccatggactctacttgcagaacttcacagctgagaggctggccctgagattcccctttatgcctcccaaagcttgcgattgcttaattatacgctgctgtgtaccaatttccactttctctcccggtgtgttttgactgataactttgacttaacctcctgatgccagaaactatgttggctactgctctggcggcaggaaaaggccggttccagggaaggctgaatgcctattgttctggatcattttgagaaaaaaaaagagataccttgaagaaagatgaagacaaaatatggaagggtgctgaatttacaaaaagcctaaggggaaaaaactcaaatgtccctcaggagtggaatgagtaaacaaatcatggcgtgttcacacaatggaatgctacctaccaataaaaaggaatgaactgcggatgcacacagaaacatgggtgaatccactaggcatcatgttgtgtaaaagaaagccaacttggccaggcgtggtggctcacgcctgtaatctcagcacgctggggaggctgaggcaggtggatcacttgaggtcaggagttcaagactagcctggccaagatgatgaaaccccatctctactaaaaatacacaaattagctgggcgtggtggcgcgtgcctgtaatcccagctgcttgggaggctgaggaagagaattgcttgaacccaggaggtggaggttgcagtgagccaagattgcaccactgcactccagcctgggtgacagagtgagactctgtctcaaaaaaaaaaaaaaaaaaaaaaaaaaaaagcagacgcaaaagacatactacatggttccatttatatgaagttttagaacaggcagaaataatccatgtggataggatagtggttattgaagagcaagagcaagggagaatgtggattgcctgggagggaaagagaggcacttctgggagtggcctgtatctcattcacagtggtagtcacacctatgtatgtgtgcaaaaattcacccagctcttaatatttatgcactttactgtatgcatgtgatgtagtttggatgttgccccctccaaatctcattctgaaatgtgacccccagtgttggaggtggggcctagtgggaggtgtttgggtcatggaggcggacccctcaggaatggcttggtgccctctcctcagtaatgagtgagtcctcactctattagttcatgctagagctggttgtttaagagagtggcactcctcccaccgctcttcttcctcctcctcctctctcacctcgtgacatgcctgctctccctttaccttctgccataagtggaagcttcctgaggctttaccagatgcagatgctggtgccatgctttttgtacagcctgcagaaccatgagccaaatatacatatttcctttataaattgcccactctcaggtattcctgtgtagaaaacaaaacagactaatatggcatgttacacctcaataaaaaccttataaaaatagataaaggcaatgaggagtcagtggaggaggatccaaggctcagaaagagaaggaggtatatgagaagctgagggaagcaggggagagcatttcagtaacagagagacacggtggaccaatgtggagagactcttggattgggtgactgagaaattctgtcctgacagaaaaatttcaacaagatagctccaacttgaagaaagagcaaggttaaggaagattctggaggctgatgttcttgttcttgttgtttaag

SEQ ID NO: 595 - DNA, 7670 bp, Homo sapiens
cagaagcacgctgggcccaggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctcccgcgcccgagaagcccagcctcgccggcggccaagttcaccgcgaggccccgcgctgcctgcgctgcgctcccggacccgcaccgaccgcagcgcgcgccgccggtgcttctcccaccccagcctggaagctgcctccctccgcctatgcctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtgtctctccctcctaagccccggaggggagaacttccaaagacagaaaaccacaggcttcctggcacagagctttccctttatcagctaaagcagaatcttttctggccttaacctggccccttcctctaactgcaggcagagaggcagacagaaaagcacttgctgaaacacaaagttttgttctgtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatgaacaatccatttcacagatgaagaaacagactcagtgagcacgtgatcacttctcacaactaatggagccaagattctgtccttatggctccagagacctcttttttttcccactgtaccacaacactcaccaggactggagtgccacctatgacctcattgcataatggatggcttgtcctcaaatgggcccgggtatgtgtacatgtatacttatgtctataggggagaggggaaattgacccactttcctccactctaactccagatctcagctgccgagtggaaaccccattctcacaccatagctatgggactgggggaaaggggaggaaataactaaagagtaaggaattgggggaggctttgaggtttggatgtgacaggtagtttgcatgtagttggaatgcagtaacattggtccacaaggtttgtcagaaaccctggttattttggaaggttccaaagttttgtcctcttcagatatcatgaaaacaggaaattctgtaaacatggccactgaagggctagctcatttcttggaaaaggagtttctggagagttctcagagcatataaatagcagggccataaagacaaaggtaaccattcaaggaatagagaagtatattctcaaaaattacacgccaagccagagctgtggttcagaaagggggttttatgttgtttctgttgttgtttcagttttggcctcagaaaggatgcgcggccctgctgtaaacagcctctcagcactgggaaggggtgtgcttacgaggctggtgtagacatccagagcctagcctagataggaaggcccaggcacccacagggaggcctgctttgacagagaagcatttctgtttagaagagggcacctgggagatatttccagagagcttcttatgacttgtcatgtagctcttcccccatgttttctgcagctggaggtaccatgcacctttgagggaccaaggacccaagacttgaggtagacactattcccagctggatactctcaatgttgaggatatagatgcacaaaccaatgcagggaggcctccaggagccactggagaagaaatcttcagatcctaccaggcccatagctgttgcctttgtgggctcctgggttaatttccacacatcagtggcccaccttatgatatcctccctgcatgccacactcccggccatgctctgtggacagccattatttccagtaattgctaatgggagccagtctccaaagagtaatgaatcagaggtgttccttggaatgtgttacactaggacttcgccgatctcacaggctcctttccagatgagctgactgtaatctctgggaagctggatctggaggaacaatgggatgggatttgcggtgacccttcctgcccttcttgagcagcttgtgaaccagaagatgtgcctggagagaaagcctcatttggggaagtgcagtagtcgaagttctttattttgaaaatggagaacaacccttctcacaatcctgtctccccttccccctttccaactagaatatcagctcccctgaacatgagtcagtcacatttcagggaaaactggctgatgttgaagaaatcacttgagggcaaactttgtccttcaagctgtgggtctctgaagtgtagagccagcagatcccccagtgtagggactgggccttccttgcccattgaatgctttctatacatgaagacttggagctctttacagatgacagtagccagtgaggaagataaaagaagagaaaagacccaaaatgcgggtttgccactcttttttgccagcaccgtggggacagtcactctgccttctttccaccacctccaacttcacactcacacgcacactctggtcccacagagcctgtttggtacttgcctgacagcccaccttgaaaccagatggtcatgaacctgtcaccaagtcatctgaagatcttccactgcaacctgtatggcatctgccacagggaccatgggacatgattgaagaaccactccagtgcagttgatgaaggggtgggtctgcactggagttaggtgcaccagggcctgggccaagggtgggctgggtccatcttgtgtgtggtggtcttcttcagagtagcagctgattcagagggattccatagaactgcacaggctaggtctagtcagatatcttggacattttctatttctagattagagaatatagcatacgctgattttaatataactgtgtatgtgactttttcagtgagaaaaattttaagtgatgttctaaacaatttttggcatgtagacagaatagtcaaatatctgtttaactagcaacatagttactcgtgcatatttaaaatactacatgagtatggcctggcacagtggctcatgcctgtaatcctagcactctgggaggccgaggtgagcatattgcctgagttcagtttgagaccactttggacaacatggtgaaaccctgactctataaaaatacaaaaatgtagccaggtgtggtggtgcgtgcctgtagtcccggctacttgggaagctgaggtgcaagaattgcctgaacctgagaggcagaggttgcagtgacctgagattgtgtcactgcactccagcctaggtgacagagcaagactacatctcaaaaaataaaacaaaataaaataggccctgtgccgtggctcacgcctgtaattccagcattttgggcagctgaggcgggcagaccacctgaggtcaggagttcaagaccagcctgaccgacatggtgaaaccccatctatactaaatacaaaaaattagccaggtatggtgatgcatgcctgtagtccaagctacttgggaggctgaggcaggagagaatggcttcaacctgggaggcagaggttgcagtgagccgagattgcgccactgcactccagcctgggtgatagagcaagacttcgtctcaaacaataaaataataaaataaaataaaataaaataaaataaaataaagtaaaatgctacatgagtttggaaacattgctttttcccacattactcacctcctttacagcaccagcatcttggtcgacacaagatctctctttaattatgtcacagtttgttgatgaatacattgcctttgcttcagttaaatcaagtaggatgcagtgactccaagtctgaggggtgcttcccaggaagagccaccccccacagccatttgcagagcattggagtaagttttaccttcatcccttagatgtgaatttgttatcctcactgtgacaatcccttatcacatggcttttagaaggattctcaaaaagctagactctcacattcaactttgcaattgcctggctgggtgttacgtttctttgcctcctattagagaccctatcagcatctaaaactagcgttgtttgaggatgttggagccaacggttctttgccagatagaactttgtgtgtccaaataaatggttcaaaatcatcaagcaaataaataccctggaataagagaagcctcatgaggatttgactccaaattgacttcctctgttctgcagtaagaagttaggaattaaaccaaaccttgcctgaggttcaggtatactcaaaagcaatgaggtgtggctcaggtgtgcgctggcaaggtcactgtgaagttcagccagaggctttgcaagcctgggcctgagaagccagacctcttagatccagaagggccaatggagctgggctggcctgctgccactcacaggcagagactctgccagcagaagggactctgctgtcagagctggagggcagcggaccacatggctgaggcccaaccacaggtctcctgactcaaaacctcttcccagggcttgtcctcctccctaaatatatgtgccccaaattgtcaccagatctcgggaaagcactggctttgtctgggataaacaccaactccacagcacacccagtcattaccagattggcagttgttgtctaggtcttgtggcttcttggggttttctcgggtgtctctctcccaaatctttcccctttcctttgattatattcacataaacattgagctttgtagccctcaagctctctcaagcataactcactttgtccctctctgtttccctatgcagtcgcctctccctctgctgtcagaggcccatccaactgctccagccctgtggctccagcgtctcctcctctctctttcccctgctctgtttctgggaagatctatctgagggtcctgaaggaggagactcgaggttgttctcttggacaaagaggtctgggtggatgacataattcactttacgtcttagaaaaataaccttgtggctcttggctctcctgggctgtcattttggttgcctaagggctctaggcagaaggccagggagcccagccccagcctagaacttgcagggctcagagagctgcagtgacggggtgtccgctgtgcctgccgccccccttgccatggactctacttgcagaacttcacagctgagaggctggccctgagattcccctttatgcctcccaaagcttgcgattgcttaattatacgctgctgtgtaccaatttccactttctctcccggtgtgttttgactgataactttgacttaacctcctgatgccagaaactatgttggctactgctctggcggcaggaaaaggccggttccagggaaggctgaatgcctattgttctggatcattttgagaaaaaaaaagagataccttgaagaaagatgaagacaaaatatggaagggtgctgaatttacaaaaagcctaaggggaaaaaactcaaatgtccctcaggagtggaatgagtaaacaaatcatggcgtgttcacacaatggaatgctacctaccaataaaaaggaatgaactgcggatgcacacagaaacatgggtgaatccactaggcatcatgttgtgtaaaagaaagccaacttggccaggcgtggtggctcacgcctgtaatctcagcacgctggggaggctgaggcaggtggatcacttgaggtcaggagttcaagactagcctggccaagatgatgaaaccccatctctactaaaaatacacaaattagctgggcgtggtggcgcgtgcctgtaatcccagctgcttgggaggctgaggaagagaattgcttgaacccaggaggtggaggttgcagtgagccaagattgcaccactgcactccagcctgggtgacagagtgagactctgtctcaaaaaaaaaaaaaaaaaaaaaaaaaaaaagcagacgcaaaagacatactacatggttccatttatatgaagttttagaacaggcagaaataatccatgtggataggatagtggttattgaagagcaagagcaagggagaatgtggattgcctgggagggaaagagaggcacttctgggagtggcctgtatctcattcacagtggtagtcacacctatgtatgtgtgcaaaaattcacccagctcttaatatttatgcactttactgtatgcatgtgatgtagtttggatgttgccccctccaaatctcattctgaaatgtgacccccagtgttggaggtggggcctagtgggaggtgtttgggtcatggaggcggacccctcaggaatggcttggtgccctctcctcagtaatgagtgagtcctcactctattagttcatgctagagctggttgtttaagagagtggcactcctcccaccgctcttcttcctcctcctcctctctcacctcgtgacatgcctgctctccctttaccttctgccataagtggaagcttcctgaggctttaccagatgcagatgctggtgccatgctttttgtacagcctgcagaaccatgagccaaatatacatatttcctttataaattgcccactctcaggtattcctgtgtagaaaacaaaacagactaatatggcatgttacacctcaataaaaaccttataaaaatagataaaggcaatgaggagtcagtggaggaggatccaaggctcagaaagagaaggaggtatatgagaagctgagggaagcaggggagagcatttcagtaacagagagacacggtggaccaatgtggagagactcttggattgggtgactgagaaattctgtcctgacagaaaaatttcaacaagatagctccaacttgaagaaagagcaaggttaaggaagattctggaggctgatgttcttgttcttgttgtttaag

SEQ ID NO: 596 - DNA, 4601 bp, Homo sapiens
aagactgaaaaaccctaaacagaaacattcttttaaatcttcttctacagaaagtaatttgaaggccttccctgacttaaagtggatgctgctttggaaagcactggaaaaatggatcctgtctttcttagccaaggactggtctcttttctccaatgtgtccctaacagagtggtgaggctggctcttcccaccagtacagacagaattttcaattcacaaatcatctgaaaaacaggaaattttggagaaacatgcttatgataacaaacaagggatctatcgtgtggtatagaagtttacacaaagaggcatctgattttaagtttttgtttttttttttttttttttttttaccgttctgggcttctggctgcattctaggaagatcattccttaaaagaaatagccatatggcttataaggtaagactactcagttcccatcccaacccccagaagagaatggaggaagggaagcagactctggctatatttttatggctgcactccaggcagtactgcagaggcaacaggcaggctctgaaatgccttcttccccctgctatcctcaggcctgtgtttctctcttactccacccaagtcctgggcccttacatggcagagggagggagaagggccagcaacattggttaacaggaatagagaatgttcgaggaaggcagtggcaggcaatagccatagagagtcacagaaggttaaagaggttgtggaaacagtcatttgtttttcaagcagttccggtggggtttgagaaagcagcagcactcaactgtgagcagacaaactcactttggaaacctatgcagccacttctaagtaaactaccaagagaattattattttatttaggttcctcatttcagtgacaatcttttaatcctttgaactgtatgctgaaaaggacattatagatcctcctgaaagataatttttagtgtccacggttccctcaatatgatgatttttttccttggtccctatctttcaccattccctttaccttttatccatgcttttccctgattgaaggaagacagagtctatttgcttcctagcatcttcttctatggctcttgctactgaaagtgtgatctagattccagcagcagaacagcagcattttgcttctgagaagtgcagaatctcaggcaccatcctatgactactgaatcagaatcagcattttaacaagatccttggtgatttgcatgcatgttagtttgggaagggctgatctgtacagatctgccctataggcctgactcataacccacactccccaaaacctgcaagatcctacatttctggccctgtatacttctctagtctcatcccatgtcactctacctctcattcactagttccagccccactagtctttctcgttctggcctccaagcctttgtacttgctgttctctctgcctggagtgctcttgtcccatctagtatggctgactcttttatttcagcttaactgttacttctggctgtgagcggtggctcacacttgcaatcccagcactttgggaggccgaggtgggcagatcacttgagcccaggagtttgagaccagcctgggcaacatggcaaaaccccatctctacagaaaatacaaaaattagtcaggtgtggtggcacacacctgtggtcccagctgctcaggaggcttgagcctggaaggctgaggttgcagtgagccaaaattacaccactgtactccagcctgggcaacagagcaagaccctgtctcaaaaaaaaaaaaaaatttacttcctttgaggatgctttcctgacccctctatatgaagaactacctccaacccagctactctctattccattaccctgttttatatttttatggcacttactgttatctgaagtaattttattcattcatttttgggtctattttattcaggattgtgtgtccagtgttcagaagagtgcctggcacatcaaaagtgctgagttaatgtttattgggtaaatgaatacagttttgggaatcatgaacattgagaacctaggcccagacaattctaaggtaaaatatgtcaccctctgaaccaacccgacagctttcagctgattgacctaagaccagtgcttttgggtgcccggatgagcatatcaaagcctggtcccctgagcagttgcatcaatatctcctaggaacttgatagaaaggcaaattcttgggccttaccacagacctactgaatcagaaatcttggcaatagggttcaccattctatgttttaaggagcctgccaggtaattctgatgcactgccccacacaataccaacatcttaccagtgtggagaacccacagtgttcaaagctctcttacatatatcgctgttgttctggacttcataaaagccctgagaataggcatggcaggtgtcattatttcccctttacagatgaagaaattgagccctaggaaattattccatttgtgttggtaatacttgctttatcagaatcacttggaacgcttgttaaaattgcagatacctgggctctaccctagacctactgaatcagaatcattggggctggggctctggaatctagatgaaaaaaaaaagaagctcctaggacattctaaagctaaaagtttgagaaccaattgcaacaggaaacagtggaatagatatcagagcttatagcccctcattcctaaggcatgctcttagagagtcttgagaagagtaagtaatgataaagaatgatattgatctttagtatcttttagtgaaaatagttaaaacaaactggcagtaattctttcacctttattagaccctaaccctacttgctactgttgtaaaccagggagaatcaaactccatgacaatggactgtttctttgtatataatttagttgtgtatagaaccaactaactggacatcaactaaggggtggcaggttttcctgattagtttgtgatacaggaatttttatttattattaaaaaaaatttttttttgagacagagcctcactctgttgcccaggctggagtgcgatggcaccatcttggctcactgcatcctcacccactgggggcgatcttcccacctcagcctcctgagtagctagaactacaggagtgcaccaccacacccggctaatttttttttttttttttgagatggagtctcactcttgtcacccaggctgcagtgcaatggtgcgatctcggctcactgcgacctctgcctcccgggttcaagtgattcttctgcctcagcctcccaagtagctgggattacaggtacgtgccaccatgccaggctaatttttgtatttttagtagagatgggatttcaccatgttggccaggcttgtctcaaactcctgacctcaggtgatccacctgcctcagcctcccaaagtgctgggattatgggtgcgagccaccatgcccagtcctggctaatttttaaaaaacatttttttgtagagactgagtcttgctacgttgcccaggctggtctcaaactcctgggctcaaggggtccacttgccttggcctcccaaagtgctggaattacaggcatgagccactgtgcccggcctaaaaacagtaacttttaaaaatacttctccaaatgggcaagtaactcccaaatctcttctcctgccccagcttccctggctccaggcccatacattgaactgcatatggaacagttctcttctagatgacctgcgggcatcttcatcttagtatgtccaaattcattactttctttcccaccccatccattcttcttcctggctacactctatcagcgaatgactacatatatcacccactgtgtcatcttagccaggaatccaggcagtttctggattccttccatcctgtctctggatagctaaccagtcatttcattgtactccttagattgctctcaaatcaccaccccttccttcatctctactcaactccagttcaagccctcatcatctcttgcttgggttgtcatgatggcttccaaaatggtccctttgtcggtgcttctagttgacctcatttctcctcttccttccttttggctctatgcttcagtgctgtcaaattgctttcacttttttaaaaaagagttttccattttaatttctgagacacatgacacatctttgtcaatgttaggtctgggaaagtttctattaacttcacaagacagaaaggacccttctctccagcagtgaaaaattcaaaagaagagagcttcagggagttcagttgctacccagcagaagcttcaatttctaacaaaactgtgaagtttcaaataatgaaggggaacttcaccccaagatgtgttctttcctgtatgaagcccaagctgtccacttggagagacatctggccagccccccgttgttccagccatccccagttcaggcatcagacatgtggtgaagaagccatcctagatgcccagccccagctaccatctgatgcaaccacactgctcaccccgagcaagaactgcctgcaggagcctagtattatcctctctcacagaaccatggcagggaataataaattg

SEQ ID NO: 597 - DNA, 414 bp, Homo sapiens
cttcccgtcctccccaccccggggacacgcttctagtaggccaaactcccaggtgacccccgcaagaaacgcggtccggagagggtctggccccactgctggggcaagggctctaggcgcccggaccccacgcccgcagcctgcggagaacgtgccgacaaggacctgtagggccccactccccctcctccctccctcggcgcagcccggcccaggggtctgtcctcccaggcccaggaaaggaggaaacccacttccgccgcgtccatgatctcccgcggcttctcctgactcttgcggctggcgctggcgctgggcatcgggacacggaactgggcagtggacaccaccctccctcgcaggcttcctaggaagttggggaaagaggagagtccaggtttggttgatccatgc

SEQ ID NO: 598 - DNA, 1782 bp, Homo sapiens
cgcgctcctacttccggggcggctggttcttcccgtcctccccaccccggggacacgcttctagtaggccaaactcccaggtgacccccgcaagaaacgcggtccggagagggtctggccccactgctggggcaagggctctaggcgcccggaccccacgcccgcagcctgcggagaacgtgccgacaaggacctgtagggccccactccccctcctccctccctcggcgcagcccggcccaggggtctgtcctcccaggcccaggaaaggaggaaacccacttccgccgcgtccatgatctcccgcggcttctcctgactcttgcggctggcgctggcgctgggcatcgggacacggaactgggcagtggacaccaccctccctcgcaggcttccagtgttctttcttggaaccatctgccaagctgtgaggaagctccagagccatatgacaagacctgatggaggataactgaggactttggccaacaaccccagctgagctccagttggaatgtgaatgaggccattttgagtgttccagcctattggagccctagccaacactctacaaactagaactgcctgattgacccgcagaatcataagaaataaagtaatttgaaggccttccctgacttaaagtggatgctgctttggaaagcactggaaaaatggatcctgtctttcttagccaaggactggtctcttttctccaatgtgtccctaacagagtggtgaggctggctcttcccaccagtacagacatggaataaacttgacaagtgctaaagatgctctttgatttttgtgtggcatgagacctcaggctgaaacttctcatctgagccattgaagggagcctctcatctctccaccgagaggggagaccagaatgctctgtttctggcaggaatctgacaccacttactccttgggtagaaactcccccaagtctgaactatgtgattgcctgagccctgcttcttgttcattaagactgctcctctgaaacggaattgatgaatttttagtggctattagaagcatttgggatccataggcatcagggtttgatgcatggccctcatctctgtgggctcctgtgcaatgattctcatctgtcttagttagaaagtgaattaatcttgaccttggcctcaggggtgtggttctctgccctcttacacatcttcaattcgcttctttatcagaagcacttgttttaggcccaggctcccccaattttaatgacatttagacatttgtctttaagttacattgctttgattttaatcaaaatctatatttctagtattatatgtttccagaaagttctcattctggattgtaatttaattacatggatcattaaagctttgaaggatgctaatgggcagaaaaaagagacttaacaaaacgaaagttattattaggaattacaaatcacttaacatttcaacatcactcgtcggatgtgggcattttgttgaaagagaccttgttttgaacagtgacagtgcagaagacctatggaagaaacaagcttccaacttgatttctattgttatgcatgcatagcaaattattaattctattctaatagggtaatagatttagaaatactattagcagaaaacttgatgtattaggcaatactacataccacattagtctaaccgctcaactgtaatttttcatccatactttcttgggatgtaaataaaattgatattatacaatgaaaataaaattgcccactagtcttgcttattctcttgg

SEQ ID NO: 599 - DNA, 3674 bp, Homo sapiens
tgtgacgccgcgctcctacttccggggcggctggttcttcccgtcctccccaccccggggacacgcttctagtaggccaaactcccaggtgacccccgcaagaaacgcggtccggagagggtctggccccactgctggggcaagggctctaggcgcccggaccccacgcccgcagcctgcggagaacgtgccgacaaggacctgtagggccccactccccctcctccctccctcggcgcagcccggcccaggggtctgtcctcccaggcccaggaaaggaggaaacccacttccgccgcgtccatgatctcccgcggcttctcctgactcttgcggctggcgctggcgctgggcatcgggacacggaactgggcagtggacaccaccctccctcgcaggcttccaaagtaatttgaaggccttccctgacttaaagtggatgctgctttggaaagcactggaaaaatggatcctgtctttcttagccaaggactggtctcttttctccaatgtgtccctaacagagtggtgaggctggctcttcccaccagtacagacagaattttcaattcacaaatcatctgaaaaacaggaaattttggagaaacatgcttatgataacaaacaagggatctatcgtgtggtatagaagtttacacaaagaggcatctgattttaagtttttgtttttttttttttttttttttttaccgttctgggcttctggctgcattctaggaagatcattccttaaaagaaatagccatatggcttataagggactatatcttaagactatgtgtcttctgcagttctttgcatagagtcaacgttgaaggacaagcaacttcaaatttccaagcaacaaaattatgttcgggtggttttctgaaagcgagatcttaagaaccacctgtatcagaatcccatgaagagcttgtttagtgtgcaaatttacagattgtcccccctcagaaatgctcatttaggagttcctgtcctttgcggggacatggatgaagctggaaaccatcattctcagcaaactaacacaggaacagaaaaccaaacactgcatgttctcactcaaaagtgggagttgaacaatgagaacacatggacacagggaggggaacgtcacacaccagggcctgtcgggggtgggaggtaaggggagggagaggattaggacaaatacctaatgcatgtggggcttaaaacctagatgatgggttgataggtgcagcaaaccaccatggacatgtatacctatgtaacaaacttgcatgttcagtacatgtatcccagaacttaaagtaaaatataaaacaataataaaaaggaaatgctcattcaggagttttggggtgggggttcaggaggctgcagccttaacaattacctctggtgattttgacacaggtagcacagcagccaaacttggagagatttgttcacagcactgcatcaccaaccttactttctgttaggcctttaatcactttttttttttttttttttttttttttctgagacagggtcttgctctatcacccaggctggagtacagtggcacgatcttggctcactgcaatctctgtatcctgggttcaagcaatcctctctgccttggcctcctgagtagctgggaccacagacatgctccattatgcccaactaattaaaaacattttttttagaggcaggctggtctcgaactcctgagctcaagcaatctgcctgcctcggcctcccaaagtgctgggattacaggtgtgagccactgcgcccggccttttaatcacttttaaaccagcaaccctaatctgcctgtcccttgaatggatccggataaaggtgtggcaaacaagcctcctgtcacagtggggtgtgacagtcacggcatcaccccttcaccacatcatgtgctgccagtcatcacttctgctgttgccaccaacccttgcgtttccctttgtcacttcccccttgccaccaccaacggccactgtccctctgctcctcaccctccatagctgagtcagatccagcattgggcacttgaggaagaagccactgtggaaggcgggatgagggtgttcccattctacattcacaagcccacagcttggagaagaagcacacctaattctgaccctggcttctgaagaagctctgcaaacctggctagaaagttgggcctgtggtttgaggttcctgctgcctttgattttacaatgagtggaaattgaggttgagtaacaggtctcttgcccaagtattaagggccaccacgaagcatacagcaatgaaggcaggagctgatgacatgtggttggttcccccctctaggccaagtatctttgtatagggaaggccgacatggccatcttcacggtttggtattagtggagtgtcttatacatactgaaatttgtttttgttttcaggtgctaaaaggataataccaaggaaaactatgggtgggggcagtgaatggccagcatgcctataatcccagcacttgaagccaggagttcgagaccagcctgggaaacaaagcaagaccctgtgtctaaaaaaatttttttaaaaataagctgggcatggtggcacgtgcctatagtcccagctactcagctactcgggagaccaagacatggaataaacttgacaagtgctaaagatgctctttgatttttgtgtggcatgagacctcaggctgaaacttctcatctgagccattgaagggagcctctcatctctccaccgagaggggagaccagaatgctctgtttctggcaggaatctgacaccacttactccttgggtagaaactcccccaagtctgaactatgtgattgcctgagccctgcttcttgttcattaagactgctcctctgaaacggaattgatgaatttttagtggctattagaagcatttgggatccataggcatcagggtttgatgcatggccctcatctctgtgggctcctgtgcaatgattctcatctgtcttagttagaaagtgaattaatcttgaccttggcctcaggggtgtggttctctgccctcttacacatcttcaattcgcttctttatcagaagcacttgttttaggcccaggctcccccaattttaatgacatttagacatttgtctttaagttacattgctttgattttaatcaaaatctatatttctagtattatatgtttccagaaagttctcattctggattgtaatttaattacatggatcattaaagctttgaaggatgctaatgggcagaaaaaagagacttaacaaaacgaaagttattattaggaattacaaatcacttaacatttcaacatcactcgtcggatgtgggcattttgttgaaagagaccttgttttgaacagtgacagtgcagaagacctatggaagaaacaagcttccaacttgatttctattgttatgcatgcatagcaaattattaattctattctaatagggtaatagatttagaaatactattagcagaaaacttgatgtattaggcaatactacataccacattagtctaaccgctcaactgtaatttttcatccatactttcttgggatgtaaataaaattgatattatacaatgaaaataaaattgcccactagtcttgcttattctcttgg

SEQ ID NO: 600 - DNA, 3554 bp, Homo sapiens
ttaaaattttcccagggattgtgcattacgtgcaggacgtgcctaacccagagagactcaagtgtgacgccgcgctcctacttccggggcggctggttcttcccgtcctccccaccccggggacacgcttctagtaggccaaactcccaggtgacccccgcaagaaacgcggtccggagagggtctggccccactgctggggcaagggctctaggcgcccggaccccacgcccgcagcctgcggagaacgtgccgacaaggacctgtagggccccactccccctcctccctccctcggcgcagcccggcccaggggtctgtcctcccaggcccaggaaaggaggaaacccacttccgccgcgtccatgatctcccgcggcttctcctgactcttgcggctggcgctggcgctgggcatcgggacacggaactgggcagtggacaccaccctccctcgcaggcttccaaagtaatttgaaggccttccctgacttaaagtggatgctgctttggaaagcactggaaaaatggatcctgtctttcttagccaaggactggtctcttttctccaatgtgtccctaacagagtggtgaggctggctcttcccaccagtacaggaagatcattccttaaaagaaatagccatatggcttataagggactatatcttaagactatgtgtcttctgcagttctttgcatagagtcaacgttgaaggacaagcaacttcaaatttccaagcaacaaaattatgttcgggtggttttctgaaagcgagatcttaagaaccacctgtatcagaatcccatgaagagcttgtttagtgtgcaaatttacagattgtcccccctcagaaatgctcatttaggagttcctgtcctttgcggggacatggatgaagctggaaaccatcattctcagcaaactaacacaggaacagaaaaccaaacactgcatgttctcactcaaaagtgggagttgaacaatgagaacacatggacacagggaggggaacgtcacacaccagggcctgtcgggggtgggaggtaaggggagggagaggattaggacaaatacctaatgcatgtggggcttaaaacctagatgatgggttgataggtgcagcaaaccaccatggacatgtatacctatgtaacaaacttgcatgttcagtacatgtatcccagaacttaaagtaaaatataaaacaataataaaaaggaaatgctcattcaggagttttggggtgggggttcaggaggctgcagccttaacaattacctctggtgattttgacacaggtagcacagcagccaaacttggagagatttgttcacagcactgcatcaccaaccttactttctgttaggcctttaatcactttttttttttttttttttttttttttctgagacagggtcttgctctatcacccaggctggagtacagtggcacgatcttggctcactgcaatctctgtatcctgggttcaagcaatcctctctgccttggcctcctgagtagctgggaccacagacatgctccattatgcccaactaattaaaaacattttttttagaggcaggctggtctcgaactcctgagctcaagcaatctgcctgcctcggcctcccaaagtgctgggattacaggtgtgagccactgcgcccggccttttaatcacttttaaaccagcaaccctaatctgcctgtcccttgaatggatccggataaaggtgtggcaaacaagcctcctgtcacagtggggtgtgacagtcacggcatcaccccttcaccacatcatgtgctgccagtcatcacttctgctgttgccaccaacccttgcgtttccctttgtcacttcccccttgccaccaccaacggccactgtccctctgctcctcaccctccatagctgagtcagatccagcattgggcacttgaggaagaagccactgtggaaggcgggatgagggtgttcccattctacattcacaagcccacagcttggagaagaagcacacctaattctgaccctggcttctgaagaagctctgcaaacctggctagaaagttgggcctgtggtttgaggttcctgctgcctttgattttacaatgagtggaaattgaggttgagtaacaggtctcttgcccaagtattaagggccaccacgaagcatacagcaatgaaggcaggagctgatgacatgtggttggttcccccctctaggccaagtatctttgtatagggaaggccgacatggccatcttcacggtttggtattagtggagtgtcttatacatactgaaatttgtttttgttttcaggtgctaaaaggataataccaaggaaaactatgggtgggggcagtgaatggccagcatgcctataatcccagcacttgaagccaggagttcgagaccagcctgggaaacaaagcaagaccctgtgtctaaaaaaatttttttaaaaataagctgggcatggtggcacgtgcctatagtcccagctactcagctactcgggagaccaagacatggaataaacttgacaagtgctaaagatgctctttgatttttgtgtggcatgagacctcaggctgaaacttctcatctgagccattgaagggagcctctcatctctccaccgagaggggagaccagaatgctctgtttctggcaggaatctgacaccacttactccttgggtagaaactcccccaagtctgaactatgtgattgcctgagccctgcttcttgttcattaagactgctcctctgaaacggaattgatgaatttttagtggctattagaagcatttgggatccataggcatcagggtttgatgcatggccctcatctctgtgggctcctgtgcaatgattctcatctgtcttagttagaaagtgaattaatcttgaccttggcctcaggggtgtggttctctgccctcttacacatcttcaattcgcttctttatcagaagcacttgttttaggcccaggctcccccaattttaatgacatttagacatttgtctttaagttacattgctttgattttaatcaaaatctatatttctagtattatatgtttccagaaagttctcattctggattgtaatttaattacatggatcattaaagctttgaaggatgctaatgggcagaaaaaagagacttaacaaaacgaaagttattattaggaattacaaatcacttaacatttcaacatcactcgtcggatgtgggcattttgttgaaagagaccttgttttgaacagtgacagtgcagaagacctatggaagaaacaagcttccaacttgatttctattgttatgcatgcatagcaaattattaattctattctaatagggtaatagatttagaaatactattagcagaaaacttgatgtattaggcaatactacataccacattagtctaaccgctcaactgtaatttttcatccatactttcttgggatgtaaataaaattgatattatacaatgaaaataaaattgcccactagtcttgcttattctcttgg

SEQ ID NO: 601 - DNA, 3554 bp, Homo sapiens; identical to SEQ ID NO: 600

SEQ ID NO: 602 - DNA, 3097 bp, Homo sapiens
cagatgctctggaaccccaggagatctctaccattcagtgggggtggcttcagagatgctcaagcactgaattgtcttaagaaaacaagtaaggttttgtcacctatcctatttctcactgcaagttgaaaaaaatcaaatccaaacaccaccaccccttctatgacaacaaacggctgtggaggtaatcttattttcctaagggtagtttcatgatgacagtgtcaaaaaattactgtggataaagaaaaaattgtctcaatgaaatagaatttttcactgaacacagaaaccatctcaatagttgctgctccctggtttccaggccacgcaacagacatcaaaccaggaagccaaactttcatggacctgtgttaagaaaaacacacatacatgggcatactactttttccagaaaaacggaattaggcagagaaggaagtgtgggtgtacaactgatccacaagctattgggaaatcaatagctaaaaaatgtccacaccctggcttccttttatcaggaactccaggaggctgaaggaatgtgagtgcatgagataagcaagacagatcttaacggtcccctcacatccctttctgggcaatctccagaatgcctagttttgtggagacaccatgtactatctggctgcagagactttcttaggtcccgtgttagaccccatggggtctcagcatgtggtcatgtggtaatgcattcctttcaaaggctttgggttgaactcaagttggaaatacctggaaaagaccaagcttctcctttgggtgtctgcggatcctattaaaaatattcgtgatgttttaagttctccaatacaattttctccacgaaaacaagcatcagatacactacctctaagtatttattggaggggttccaacagcctcgtggacaggccttctcagcagctactgagtgccccctaggggtggggaggggccagtgcacatggaggcaaaccacagagcccttttgtggcctattattatgaagaactaaaatgtggccagtgaaccagtcagtgctcatcactacggggtactttgacaatggcacaatttcattttaccaaaagaaaccttcactggctctggggactgcaatatcttcattttaaaatattttgctgcgttttcttcaagggcggcttgtgacaactgaactgctgattattccttccatggacagcatggtagtggcaagtgcagtaactgggctcattgcattttctctttccatacaagttactgcaactgccatgtgatcacttttccagcaggctgacttcgatttgatttttttcttatttaaatgttagaaacatctcagggctattattatttatctacaaagcagaaatcagccaaagacaaaggaaaaaagtaagctaatcagaacctgaagacctgaaataccacatgaaatgtaaacatttaactttttatttccaaaggatttcttgaagcctctctggagataatgacatcaccacacatactgttaaacaatcttttaatacctttggaattactctttataatttttatacttcaaattaagaaaaccgcccaatgttcaggcaactttggcattaacatttccaagaaagggacaaaaacaactattaatgcaacatcatgaagagattggggacaattgtgggtgtctataaagctctctttgaaaagctctttaaagcgaactcaggtaaatggaaatgaaatctgactttttacttaggccaaataacaatgaggtttgaatataaaatggaagattcaggccctttctacctaagatgaaggcatttagtttgctcaaattcaaactccaccaaatactctgaatggaaagtttggcaacagaactggacatgtggaggttcaccaaccattttgatcaaaggtgatctgattttatctcacttcttgcctaacctttctggcttctttaccttgactagatgcctgtggcattatataatgatgcagcccagcagaagtaggatgctaataaaccctggggtaaagcagcaatcatctgcatttttaccacatacacttgaataatccaaaatactgagagttgcttccctatgctcaacatccataggaccaaatttggaaaggtgaactgtagttggcttatatgctggccttaggtgctcttatgacctgtgcttagccatatttagctcactggctaagaggctgaaaagattctaccaccttcaggtgtgtggggaacatgaacaggaggctgacaaacaaggagggaagtttctattgtacctggtgagtgggttttatgaaaagaatatgggtagggatgagtcagtgatattttggttttatcactttttggagaaacatacatatatatacataaatagaacacatgtttttatatcatttattgacctgaggccaaattctactcgattttctactttccccctactaagagatccagaaaagctattaacattagagaataaagtattacttcttctggaatcctttctacatacccctttgtactctgggaaggtttgaatgtgaccaggaaggaggagatatcaacacaggctaagttaattaacgaaaaacagcattctgactaacctatagttgaatttacaaaatacacttcaaagctatggcctggtacagggggaggatgagatactgcacatatttttctctctcagccttatcaggctaccatgggaaagctatagacagagatatattattcttcaccataaaaagcctgcaaaccccattttaattagccccaaagaactgtgccctaaaatgtaaaatgaaataaaaatctctggataacatagacgactgtgtgaagtgaatgccatcagttagagagaccccaagtgttcccagttctccttctaagtaacttctggggggaaaaatgattgcttagatttgcctttgctaatgacagaccccatttactacgttttatcctcttcaattattactaaggaccataacagaaacatattattttgtaaataagtagggcaagatataatattacggtaagaatttt

SEQ ID NO: 603 - DNA, 3097 bp, Homo sapiens; identical to SEQ ID NO: 602

SEQ ID NO: 604 - DNA, 3097 bp, Homo sapiens; identical to SEQ ID NO: 602

SEQ ID NO: 605 - DNA, 3097 bp, Homo sapiens; identical to SEQ ID NO: 602

SEQ ID NO: 606 - DNA, 1046 bp, Homo sapiens
gaaaagagcttttgctttttctacattttgtttttgttttgttttttcctgatagtcccacaaagctgaagatcttgacctgcaagagcggacaacaacgtgactcaggctgggaccactgagcctacctaggtcacagggaggaaaaaagggaccgcagaacagcagagataggacctcccaaccctgcgccagctggcagctccctgccagagaagcagagacatccctccttcctcccttcccccataagagccaaaggctcgaaggccgaacctcccgccgccgtcagcccacgggggcagctctcagagagccagggaggagttgtgatgaggggagaaccgggatccaggccttagcctgccaggggctcagtccgaccgtggctaccgcctgcggaagatacagcgcctgcataacaccgagccagcaattccaatatcaacatcaataaaaagaatcgaaaacctaggaaggagtggaggaaatttatttgcaacgcgacccaacttttctatgcgccatcttttctgcccttgagttgggacggactaaggaggcctcaaggttttgctgaacttctctttggattcaaaaccattcttgcactagtgtctgtttgctttctccagctctgctccaaatcccggaccggacgtcggaaacccgcgcccgccgccgtcaggaacgctcacgggctccccggagtcttacagaaagccgggaaggaaggtcccgtttcttctctaaggtctgggacttgagaggtgagagggcggaggaaaggatctccccccacccccaaccggtaagaaggaggaggaggagggaggctgaggcgcggacccaggccccgagtgattagtcacacaatttaaaggcaaaggagggattaagcccggagtctattgttccagttgtttaggcacgtgtgacctctgagttcccaaacaaatcgtctggggaaatccttcctgcgccctaatcagattgtccagggacagagggccggacggcaggcagctcgggataccgagagcagt

SEQ ID NO: 607 - DNA, 1046 bp, Homo sapiens; identical to SEQ ID NO: 606

SEQ ID NO: 608 - DNA, 3808 bp, Homo sapiens
cgctcctcgcgcctgccccgcagccaagttagccaaagcagcccagggccgccgcccagcgcccccgagccccgaggagagccgtcgcgaccgggggctgcctgggcaagggcggggcgagagggcagaacgcctgctctcggacagatctggggacccttcacctgcctctactactgcaaatgattggatattcgtctgacttggctcttccctaatgtgtggaactaattttgttcactctgtttcatgctggacctggcctgaaaatgggcccttatattgtctttgcactttccaacttgccaagtttctgaaagaaggaccaaagtaatgccaagaactcccagatgaagaggaccttccttagacctataacagattcactacttgacttcagagggaagtttcagctaattctcaggaaaaggtcaaaacaggcctgtgactgtcccttgaatactgaaggtataaacaagcttctggctcctccaggtcaagcagaggaacacttttattagaatgaagggttacttctttgttattcaaacacacacccacacacatcctctgtagtctccctaatgaaaaacctcaacagatggagagcctgagctcccaagtccgcaggctgagaagatgcacttcactcaagggccagtgggctggtacagactagggaagagaaaagggacaaaggctgctagtataggtaatcactatcttttaatactcctaacacatagaaattcgaaaaatcttgttcagcaatgttagcagcctgtgagcctcggaaactaatttggctgatgtgtctctgatagggagcttggggctgcaccaaggggaaacattctcctcctgtattctctcctctctctcgtttgaaagcctgtacaaagaaatggtacaaatggatggttaacttaatgattccatcagaggcagatttttctctgtcaggtccctggataaggtggaggtctgaaagccaggagacagaatatgtacttaatcgccctttctgacctgcttaccagtgaccaggactactctccaggcctttcttctgccacttccccattcttcctggctagttcagttgggtctcagcacttcaactcctggctggatcctgagtttttcttggttgcagggaaagctctcactgtctgcatctccttccccacccccacctcccgttttgcagctggccattctggctgcctcacagctatcctgccttaattcatatttgattgcctggacagaaccacctagaatgtccagacgactgccacccctcagccatgggcctgagatcctgccctgacccctttcttcagaccccaggaggacccacaatctccctgatccccaccttccccaaagtagtctctaggaaaaaagcagagctggctaaggcctgagacagagccatttcttccccttgggcaaacgaggtagaccctcccagagaccaatgccggagaggcccggatccgagctccctttatatggcctcccccatcacggatcccgtgggaaaacctgacacacaatggcgcggctgctccgggcaccctcaacccagcgccctgcggcaaggcctggagcagcctggtggtcttggtgcgctccctttgccctccccgcaaccctctgcgagcactcgtcccaggagagagaccctggctagggtggaggttgcctcccgcaaagggcgctgttgctggggcctcccctcccccattctcttgtttttctgcttctgagactcgggagggaggcggcaggcgcctccgcagccgatagagcagctattgtgaccttcccttgcagagcgggaacccagccgagtgtgtaccgccggcggtggcgggggaggaggcgactgtgtgtgcaaacctcagtcggagagggggtggcgctgggaaataaaggtttgcaacctcaggcagttgggcccttcagagggcgtttggttgtgtttagactcggttgctttctaacactaattgcaggctcaaaaggagcggaatttattgcgaaggccaaggcggcttgtttataatttatgaagttttaaatggctgtgccgcgggccccaactttctcctgggctggcagccgcgcggaaacgcgccctcccccggctcgccgcccacccccacccacgcccctcagatgagtctcacgccaatggcaggaacagatccgagctattagaagtctcgggaacctccagagatgacagaaggtggcagatttggtccaagccctcaccccactcgagaggagggcgtcggggaaagctgtggctgcctggagagggagcccctgatcccacacttccttggagcctgagtgtgagaggaagctaatgtcagccgggctagacaccgtttaaagtctaatccatgaaaccctaagccgcaaatgacacttggggctttgcagacacccgcagactcagcagatactcctgcggtaacacactgtgctggaaaacgcctggagccatgacacattacgtatttttattattatttatggtaggaagaggagatgagggaaaatcgggctgaatctaagcagcctgacaattcagctagttaatatttagccagttaagaaaggtggttgtaatccctgcaaggcagtgagctctcctttgatttctctaatagcttaaaaaataatttcttacaagacaattagaaattctgcctatggatgcaaatttcatagaaaacaatgttaagccttgaaagtgggtaaaatgtgccttcgattgaagtcatttattctgttgatacacttctacaacatatatattttaaacctgctcagataaagtgaaatttagcaaaaggatatcccctcccacccccaaatctaacatgccattttaaaaacagcacaaaggaacaaggaaactaaatattattttgagccatcattacttagtgaaatacaaacatccaaatagaaacgattgttgttccaccagaagattagaagttaaattatttccacacaataggaatttcacttcgtgtcatcggggatgtagtaggagttgcattatttgtcaaaccaaatagagatgcgtgggctgactttgctgaaatacaaaagaattgaaccttatctgaaggcgttttctaagtggcccctcccatagaagccgggaagttgtccacccctagcagaagccacattaatatttacaaaatggttataaatccttgaagacatttttgcccattttgtataagaaacaggagtaaacaaggtgtttatacttgttatgtttcattaatgaaatattattactttacatcttggggaatgtttgttttctttagaaatgaactaatgatcactacaaaggaagaattcatgacagcatttcctagagaaaaagcttaggtacgcgtctccaaatgatggtttctttttctacaccttagctttttcatagctcaattcttcttacaacttctcttgtgttttttctttgattgtcagttttctttcaaagtttattttttgttacttaatgcagaaaagtgagctctggtctccccagtgtaaaagtcgattgtgtctagaaagaaggcagtaaaaacagcaaagcaggcgctgctttcaaaaagccctgcccaaatcatcccgcccagaaccttcttaggtttgcatcctcatttccccctcccctaatttcaatagctggaaagtaatcaagtatcccgagaaccaatttatgcactagactccaaataaataaaatatttttttcaaa

SEQ ID NO: 609 - DNA, 3808 bp, Homo sapiens; identical to SEQ ID NO: 608

SEQ ID NO: 610 - DNA, 3808 bp, Homo sapiens; identical to SEQ ID NO: 608

SEQ ID NO: 611 - DNA, 3808 bp, Homo sapiens; identical to SEQ ID NO: 608

SEQ ID NO: 612 - DNA, 1538 bp, Homo sapiens
cagaggagcgctgtttctggaggagttaggggaaggaggctgcctggtaagccaggaaaggggcttctggccgttctgttggagcgcctctgactgacttcccccatgtgtccgtgtggccacaccgtgctactttcagaggcagtgggcttttcgctaagggataaaaagaagtaaaaccttgcctttagcgcagctctccttcactgggcagattgctctccctccccactctcccaggcccaaattggatctcagcgcctgggagctccaactttagcaagtgcgaaatcctgtcttcggttttggaattttcatccgcacagactatatcagccacggataggatatgtgagaataccagcatgtcaaggctgggaatcatccttaggcatcacctagccagtcctgcctctcattttaagatgcagagtgttcatatgaggagagactttcccttgtctccgtcatctgtgatttcacttccctgacagaagacgaagcttccatctcagatgttttcttaaatgatgaaacagcatacgcctctgttcttgtcagctcagggaaaacagatctggggacctcttcatctctgcgttgggaagcataggtggtataatcccctcctgtcacgtccaacgttgcatagtcagaagcttcgcccttgtagttggtgcacacagcacggtgatcacaggatctggtttgccactgaaaggaatcttgatgctgaccacttcacctcggagagcatgaactgctcccatgccttcaagagttttagtgggtaaccaggatggaactgcggtgttgcttgcaggagaagcttactactggtttctacttctccaacctcattggtggctatgcagagaatagacgccttgatggctcctctggcagttcttgatgaccatggatgagctaatggctgtggtctcaatggtggcttcttgagatggtattgcctctgaatttgctgattcagaagatgtcggactcatgttatcctatagaagatgtaacaacccatatacatttatgaaaatcaggaactacattattataatgatgaaggaaaagcccaagaaatcaaccaacctgaaacctgcaatgaagctgtgcagctgtctttgccaacagggttctgcacctcaaaactgtataccccactgtcactcggtgctacattgatgatcttaaggccggatactttgttgaagaagcttattttgtatttgttgtcacttgttagctcttttccatccttaaaccacttagtactgagttcaggggtgccagctactgtacactccaaggtacaggtgtctcccgtggtaacttttatggattctggcttttctacaattgttgcaggctctggaatgaaatgtaaaagatatccatattttaaactcaaattgaaaaactaaagaaaatacagatcctggtgagtgtgtgccttgtatctgtgataacatcatctttttactaaccgagaacggatagcgtggcgaagcactcttgcatcccag

SEQ ID NO: 613 - DNA, 1559 bp, Homo sapiens
cccgcgtcttcagaggagcgctgtttctggaggagttaggggaaggaggctgcctggtaagccaggaaaggggcttctggccgttctgttggagcgcctctgactgacttcccccatgtgtccgtgtggccacaccgtgctactttcagaggcagtgggcttttcgctaagggataaaaagaagtaaaaccttgcctttagcgcagctctccttcactgggcagattgctctccctccccactctcccaggcccaaattggatctcagcgcctgggagctccaactttagcaagtgcgaaatcctgtcttcggttttggaattttcatccgcacagactatatcagccacggataggatatgtgagaataccagcatgtcaaggctgggaatcatccttaggcatcacctagccagtcctgcctctcattttaagatgcagagtgttcatatgaggagagactttcccttgtctccgtcatctgtgatttcacttccctgacagaagacgaagcttccatctcagatgttttcttaaatgatgaaacagcatacgcctctgttcttgtcagctcagggaaaacagatctggggacctcttcatctctgcgttgggaagcataggtggtataatcccctcctgtcacgtccaacgttgcatagtcagaagcttcgcccttgtagttggtgcacacagcacggtgatcacaggatctggtttgccactgaaaggaatcttgatgctgaccacttcacctcggagagcatgaactgctcccatgccttcaagagttttaggatggcatcaactgttccaaaaacattgctgagctggactttgtatttcccagcatgagtcttacgttggacattcttcatgacaagatgagtatagtgctcagtgttttcaatagtaatgttttctgagttttgcaaaagtttctgaccatggaaccaagtcatggcaggtactggacgaccaatgtacataacatgaagccgaagtgtggaacccacagctccataatatttctctttcagtgggtaaccaggatggaactgcggtgttgcttgcaggagaagcttactactggtttctacttctccaacctcattggtggctatgcaggcactgtctccagactgtctatattcaacccagtatccaagaatttctttaccaccatcacattcaggtttctcccactgtagagtgacactatctttggatattgaaagaatctcaagttctcctggttggcttggtttatctgaaatattttaaaataatgaaaagggagtcagctttactggtgaaataaaaggaccaaacatggcttgcttctttaatttaaccccttcttctgaattccttaccaaatggatctttgcaaacaactggttcagaagcagggctggtctcactcaggccaacatcattctgtgcgatgatgcggaactgatactcagcatcgggaacaagccctgtgacagtgtacattgtggtggtgatctgagtcttgttgtgtctgacccacttgtcagtggatgtctctttgc

SEQ ID NO: 614 - DNA, 4816 bp, Homo sapiens
tattaacacacactgaaaccggttctctggtatggccataaaactaattcctggccaatggcctatgggcttgaagaatggattaatcttctgagctgttctcttaagagaatcctgggtgccttcaactttctcaatttctccttcctgctggctagaatgaggacgatggaaagaactactgtggactatgtgaattaagcaacacactggtgatggcagagaaaacaggtaaaaggaaactagaaccttgagactgtggaaccgccataccagccctgcaattttgtgcccagaattgagaattttctgttgggtattgctgctcatctagaaaacaccagctaccaatagatgtcctctctgtgccgaaatactgcttacctcaggggatattggcttgcttgcttccttttctgccaccgccctcccccacaccccccaccatgcaaatccccctgggaaagaagaaagttggacaggaacaagataggttagacacttacaaatcaactcatcaacaagtcacagaaggcataattttaattctgaaagagaatataaatcctatgagccctggcaatgtccacattgaaatttatgacaatagtttgggaggtggaagcagagaaagagacctgatgggcgtgtgggaaccctactattaaatagcacagagggaagaggaactgttttaaggtgaaagactacagaataaagttttgagaatattatttaaagtcctgatggtaaccgatagaaaacctagaaataagattgtatctgactaaatatgggacaagtcaggaggagtgtagagtaatattgtgtgactgagcacaatccccacatttggtagcccctgagatggactcccgtgatccctgacccgagctattgtaacactttgtaatcccatccgtttgaccatagaccagacttactgacttctaacaaataggatacaacagaagtgttgagatgtcacttcccagattagtttacgcagaaactttggctttatctgaggcacccactctattgctctccggattgctccaagggaagacagctgccatttgatgagctgcccacatgacagagaacaggccaatagccctcaaagaattgaaacctaccaaccaggggagtgagattggaagcatatattccttcgattaagagttcagatgagaagacagttcctgccaataccttgattgcaaccttatgagaaatcttgaggtggagacctagctaaaccatgcctagattcccgactcacagactgtgagataatatactaaaaatacatcactaatttagaataaaaatcaaacaagctgtcgaagaatgtacacaaaagttgaaaaaatattacaccaaagatgatagacaaagcacggcaatccattctaagaaaagaggtatttgcaagggcaaatgagaacaaatggagccaaagcaataaattaagagaggaaaatttttgtaagctataaaaatgatctgagcttgtagtcaaaaggagtcaagatattgcatgcaacattgatgagtagagacccatgcttagaaatcatctgaaaaaaagtattttagaaataaagggagtaagcctgtaaatgttcaggaagaatacatggaattgatattttttaaaataactaaaattcattctcctccaatacactggccacaaaaaagtgaagcaacttttatatgaaatgaaaaaaagtggttgtcttctaaagttgtgcacaaaagccactgaaagacatgctcagacataaaagggctatgaaagtaaacaactattaactcttcttttaaaaaatatgtataaactgtatttaattgaatgagcaataaaatattaagaaaatgggatacataagtctgcgtgggaaacactgatgtcagttaagtatgtgggttgaaataaaaatatgataactttagtctgactctaaaagtaaatgtgtataaatacttaaacattcatagcaagaagtttaaagtgatttgatttttattgaatttgatgaaggtattacattctggggtgtttttgaaaaagtgaaagagaaccagtaaaagatcttatcagttaacttttactatgtaacaaaccaccccacaacttactgagccaaaacaaccactatttatttagcttatgagtctgtgggtgagcaatttggattgtgctcagcgggccagttcttttgttcacatctggcctcatgaatgcatctgagttcaactgccaggtgagctggggaactaaatatttgaggatggcttctgctaggacagctcctctttgctccatgtggtctcccatgttccagtaagatagtcgatgctttttcatatgccagtggaggaattttccaagagagcaattggaaaacatgcaaggcctcttaagtttgaggcctgaaacatgatttcacttccattgcattttgttggtcaaagcaaatcacaaagccagcccagacttcagggtggaaaaatcaactcttaactcctggtgggaaattctgcaaaattatgttgccaagcaccatggagaccagaggtgaataattacagccaatattacaatctgccacagcctaacatctggccttaattattcacatccctctcacaggcaaaatatactcacctccggagtcatcccgaagtctaatctaatcacagcattaggctcaaagttcagaatcttgtgatctgtatttggtctgattgtagctcctcttgacatggaggcctctgacctaaaaagacaagttgtctgtcacccatataccctacctacaatagtaaggcagggcagaataaccacaagagatactcccattcaaaaaagtgggaggattaaaggcatataacagtcatggtccatagacattataaaattcagccaagcaactatttctactcagaggcagtaatgttccttgattaaggcccagcttgaatcccaggaagtggcttcccaataaattgttctccatgacccgtggctcctctcactagctgcccttcctttataatgctgtcaagtcaacttgagtatgagcctgctcaatgaaatgtggctcagctgtccctttgccaccatggctgacaaccagccaaccccagaagcagagctaccctactctgtgcatgcaggattccaactgagccattgaaactcaccctaaattgcaagcctactgaatccgagttaaataactgtctttgttttagctactctattttaatgtagtttattatatagaaatagctaacaacccatgaagttttaaaaaagagtatacctactgcagtagatttaagaaaaataaaattatagtccttataaagagataaaacacagctaacagaaacataaaaacagaggatcaagtgtatcacttatttcagaaagtaataaataggctaaatcctgttcctcaggtaaaaggaaaatactgtcattcagttcaaaataaatttcagctatatgtggttaacaacatttctaaaatgatatgatagagaaatgtcaataaaagtgtgggcagataagtattagcaaatagaagcaaaaaaaaagaaaggcagtgattacattattataaaattaaagactcaaaagcttcaaaggtattaatggtctatttatttttaaatagataaggggttaagtcaataatacataacaattataaatcattacttagtatcataaaaatatgtaaacattatgagttcaagagaaaaatgacaaatatttacaaattaaatttgaattaagattgatttatttagattcaatattctataaagagtgaatacgcattattctcaagcatccctagaatgtctaaaaatctatcacatagtagataataaagaaaacttcaagaaaatctcagaaatcaaaaatttcaagggttcattttctgatagaccaagggcccttatccatgtatgggcttcagaaaatccataggcttcctgacacagtattttgtgtttatgatcattttctctgtgttgcatgtacagtttttcatcaatattccaactaatcccaatccttcataaatatgagattaggagctaataaagacaattataatgaaaagttaaaactccagacacacaaaatttctaaagaaaaaatattttaaatgttagtatttaatatgatacaaacatggtataaactactgtctgcatttaatgaacagatgtgtgtaattggaattgctctaggtttacagtggacataattgtcatgtttattaatcaatgatccataaataagagtgcttgttagtgagtcctgcatgcatactgcaataaatatatggcttattgttttatgtgtatgatttttatcaattagaaattttttcttgcaagtgaaagaaaatctattgcctgttctatttacagacaggctccttccttagagaacttgagcaactccagaaatacataatctcagcttcccaaaatttccctctagaacctccctctatctcggaagtctccaaaaagtctcatgatatttctttggctctgatggcatcacctgagtgtccatgaactaatcattgacaacagggaaaagtggggatctgattggctatgcctaattcacatatcccaatagacctccacccaatcacatttgctgagagcaattgatgagtagattccaagttcaaaatgggaataactatctaaactagctgaataaataatgttactagtaacatgatacatacagtctattgaatataag

SEQ ID NO: 615 - DNA, 4816 bp, Homo sapiens; identical to SEQ ID NO: 614

SEQ ID NO: 616 - DNA, 8125 bp, Homo sapiens
ttatcatgttgaggaagtttctctctattcctgtttttctgagaactatttatcatggatgggtgctgactttttcaaatgctttttctgcatcaattggcataattatgtgatttttcttctttaacctgttgtggtgaatattgatttacatttgtgaatattgaaattaccttgcgcttatccctgaaatagacttgacttgatcatttggtcatggtgtttgtgtgtgtgcatgtatatatttatttatttactgtattagttcattttcatgctgctataagaacataaacaagactgagtaatttataaaggaaagaggtttaattgactcaccattccacatgccttgggaggcctcagcacacttacaatcatggtggaagaagaagcaaacacttccttcttcacctggtggtgtagcaggacaagacgcagacaaaatccctcagacactgagttgtagaaagaagggctttattcagctgggagcatcggcagactcacatctccaaaaactgagctccccgagtgagcaattcctgtcccttttaagggcttacaactctaaggtggtccacgtgagggggtccacgtgagagggtcgtgatcgattgagcaagcagggggtacgtgactgggggctgcatgcactggtaattagaacagaacagaaaaggacagggatttttcacagtgcttttctatacaatgtctgtactctatagataacataactgattaggtcaggggtcgatctttaactaccaggcccaggatgtggcgtcgggctgcctgcctatggatttcatttctgccttttagtttttacttcttctttctttggaggcagaaattgggcataagacaatatgaggggtggtctcctcccatagtggcagggaagagaagtgccaagtgaagtggggaaaggccccttataaaaccatcagttcttgtgcgaactcactcactatcacatgaacagcatgagggaactgctcccaggattcaattacctcccactaggtccctcccatgatatgtggggattatgggaattacaaatcaagatgagatttcagtggggacacagagcaaaaccatatcattccaaccctggtccctcctaaatgtcatgtccttacaaacacaatcatgccttttcaacagtcccccaaagtcttagctcattccagcattaatcccaaagttcaagtcaaaagtctcatctgaaacaaggcaagtcccttctgcctatgagcctgtaaatctgaaagcaagtcagttactttttagataaaatgggggtacaggcattgggtaaatatgcccattccaaatgggagaagttggccaaaacaaaggggctataggccccatgaaagtccaaacttcaacagggcatcaccaaatcttacagttgcaaaatgatctcttttggctccatgtgtcacatccaggtcacactgatgtaagaggtggactccaacagccttgggaagctcagcccctgtggcttcaaagggtacagccccattcctggctgcttagctggctggcactgagtgtctgtggcctttacaggtggatcagtggacctaccattttggggtctgaaggacagtgggccttctctcacagctccagtagagagttccccatttgggactctgtgtgtggactccaaccccacatttaccttctgcactgccctagcagaggttctccatgagggaccacctttgcagcaaacttccgcctgaacgtccaggcatttccatacatcctctgaaatctaggtggaggttcccaacctcaattcctgacttctgtgtacctgcaagctcaacaccacatggaagctgccaaggcttggggcttgcaccctctgaatccatggcctgagctgtaccatttttactcacgtccctgtgaagagaacaccaaacaggctttgtgtgagcaacaaggctgtttatttcagccaggtgcaggtgggctgagtccaaaaaagagagtcagcgaagggagataggggtggggccattttataagatttgggtaggtaaaggaaaattacagtcaaaggggggttgttctctggtggtcaggggtgggggtcacaaggtgcttggcgggggagcttttgagccaggtgagccaggagaaggaatttcacaaggtaatgtcatcagttaaggcaggaacaggccattttcacttctcttgtggtggaatctcatcagttaaggcaggaactggccatctggatgtgtatgtgcaggtcacaggggatatgatggcttagcttgggctcagaggcctgacattcctgtcttcttatattaataagaaaaaaaaaaaaccgaaatagttgtaaagtgttggggcggcgaaaatttttgggggtggtatggagagataatgggtgatgtttctcaggactgcttcgagcgggattggggcggcatgggaacctggagtgggagagattaagctgaaggaagattttgtggtaaggggtgatattgtggggttgttagaagaaacatttgttgtgtagaattattggtgatggcctggatatggttttgtatgaattgaaaactaaatggaataagagaaggagaaaaacaggtattaaaggactaagaattgggaggacccaggacatctaattagagagtgcctaaggaggttcagcatagccttgccagcaaagattatttatttacgttaagagttaagagtggcagtttggggatagcaccaggagatatcagctgtgatggcttggagaaacagtgtaaaccggcagtgtaaacaagagcagggcatgcaggagtagttgagaacagtgaataggagtatgactagagagaagatagtagggatgacaagttttttggggcacagtccaagttggtctggtatctggaatgagactggggcctaataaaaaggagcatccatacaggagcttaaatgggctataacctgtagcattccgaggacaggcctgaattctgagaagggcaagtggtaaaagtattgtacagtcctttttaagttggtggctgagattggtgaggtgtgtttctaaaggaccattagtccattctacctttcctgaagattgaggatggtaagggatgtaaaggtttcactgaataccaagagtctgaaaaaatgcttggctgatttgactaataaacgctggtctgttatcagactgtgaagaggtgggaagcccaaactgaggaattatgtctgacagaagggaagaaatgaccatggtggccttcttagaccctgtgggaaagtcctctacctatccagtgaaaatgtctacccaggccaagaggtattttagtttcctgacttggggcatgttgagtaaagctaatttgccagtcctgggtgggggcaaatctccgagcttcatgtgtagggaagggagggggccagaataatccctgaggagtagtagaatagcagatggaacactgagaagttatttccttgaggatagatttccacgatggaaatgaaatgagaggttctaagaggcggggtagtggcttgtactatagcatagcctgcctttgctggtgtgtggcgattaggcctggtgggaactgccatcaataaactaagtgtgatcagggtgaggaacaagaaagaaggaaatatggggaaatggggtgaatgtcaggtggatcagagagatacagtcgtgggggtcaggtgtggtatctggaataatgtgggaggctggattgaagtccgggccaggaacagtggtgattgtgggagactcaacaaagagtgagtacagctgaagaagccagggagcagacagtatatgtgtcaggtgtgaggaagaaaatagattttggaagttatgagaactgttgatcatagttcgtgattttaagggcctctaaaagtattagggcagcggcagctgccgcacgcagacttgagggctaggcaaaacagtaaggtcaagttgttgggataaaaaggctacagggtgtggtcccagttcttgtgtaagaattctgactgcacagtcctgcacttcagctgtgggtaatgaaaagggttctgatgagtcagggagagttagggtgggggaagtctctaaagctgtcttcaaggaacggaaagaggagtggggaaaggatttaggatctatggggtcagataggtttctttttgtgagtttatataatggttttgttaggatggcaaaaccaggtgtctaaagtcgaaagtatctaaccatgcctaggaaggaaaggagttattgttttgtagaaggtgttggggtttgagagatcagttggacacaatcggcagggagagcatgtgtgtttttatgagaattacgccgagataagtaacagatgaggaagaaatttgggcttgattgaaagaaatttgggcttgattgaagtaatgggggccgtctgtgaagccttgcggcagcacagcccaggtaatttgctgagcctgatgggtgtcagggtcagtccaagtgaaagcgaagagaggctgggatgaagggtgcaaaggaatagtaaagaaagcatgtttgaaatccagacagaataatgggttgtggaggggggcattgaggctaggagagtatatgggtttggcaccacagggtggataggcaaaacaatttggttgataaggcgcagatcctgaactaacctgtaagccttgtctggttttaggacaggtaaaatgggggaattgtaaggagagtttataggctttaaaaggccatgctgtaacaggcaagtgataacaggctttaatccttttaaagcatgctgtgggatgggatattggcattgaggggggtaagggtgattaggttttaatgggatggtaaggggtgcatgaccagtcaccaaggagggagtagaggtgtcctatacttgtgggttaaggtggggggatacgagaggaggatgtgaaggaggctttgaaatggggaaaagggtggcaatgaggtgttgctgtagtccaggaatagtcagggaaacagataatttagttaaaatgtcttggcctaataagggaactgggcaggtggggataacttaaaaaagagtgtataaaagaatgttgtctaagtgggcaccagagttggggagttttaagaggtttagaagcctggccgtcaatacccacaacagttatggaggcaagggaaacaggcccttgaaaagaagtaatgtggagtgggtagcctccgtattgattaagaaggggatggacttaccctccactgtgagagttacccagagcatctgtgattgtcctgtaggcttccaaggcgattgggcagtgtcagtcttcagctgctaagccgagaagatctgggaaggagtcactcagagagccttgggccagagttccaggggatctggaagcggctgccaggtgagttgaagagtccgattttcagtggggtcccgcacagacaggacacggcttagggggaatctcgggctgtgggcattccttggcccagtggccagatttccggagtaaaccttggcagctgcagttcaggcgtttggaagttcttgtgtgtggagatgtggctggggtttctttcacagtggaggcaaggaattgcaactcagaaatatattgctacttggcttcctctactctattattgtacaccttgaaggcgaggttaattatgtcttgtttgtggggtttgagggccggaatttaatttttggagttttatttaatgtcaggagcggatttggtaataaaatgtatattgagaataagatggccttttgaccttttagggtctagggctataaagcatctcagggttgctgccgaatgagccatgaactgggctgggtttttcatatttgatgaaaaagagcctaaatgctaactgattttgggagaggtcggataaagaaaaaggagcattaacctcgactatgcctttagctccagccaccttttttaagaggaaattgctggacaggtcggggagggctagttgctgaacgaaactgtaagctggaccgggtgtgaggaggggaggtgataaaagggttacagggtgggggagcagaggctgaggaagaattgggacctggcttggcctggcgaggagcagcctggggaggaggggagaagtcagatgggtctgtagaaaaggaagattacaaatactcagcgacccttagggttgggactgagaggacaggcgggagggaaagaaggaggatttgggactagtcgcattgggaacagagactagggaggcactgatgtgtaaaagaatgcctggatgtcaggcacctcagaccgtttgcccattttatgacaagaattatttagatcttgtaggatggaaaaatcgaaagcgcctttttctggctatttggaaccactgtcgagtttgtattgtggtcagattgcattgtagaagaaaataaggcatttaggttttaggtcaggtgtgagttgaagaggttttaagttcttgagaacacaggctaagggagtagagggaggaatggagggtggaaggttgcccatagtgaaggaggcaagtccagagaaaagagagagtagagacacggagagaaggggtcagggggttcttgtcccccagaaaagcggcatttgccgctaagggtgaaggaccaaggcaggcgtccccgcgtggtcagacacacctgaaatgtgtgtgaataatcaggcaggtatccccacgtgattaaacaccaagggaaggctgccttcccgagtctgtgactggcgccggagttttgggttcatggataaaatgcatctcctgagttgtctctaccagaaaagggaaggaactgaaattaagagaagggagagattgaaagatggtgccaagattgaaaggagaaagaggttgatggatagtgagaggttggagaagagagtaaaaagaggtcgcttacctgatttaaaattggtgagatgttccctggcctggtcggtctgaggaccagaggtcgtaggtggatctttctcacggagcaaagagcaggacgggggattgatctcccaagggaggtcccccgatccgagtcacggcaccaaaatttcactcgcatccatgtgaagagaccacgaaacaggctttgtgcgagcaacaaggctgtttatttcacctgggggcaggtgggctgagtccgaaaagagagccagcgaagggagataggggtggggccattttataagatttgggtagataaaggaaaattacagtcaaagggggtttgttctgtggcgggcaggggttggggggggggtcacaaggtgctcagcgggggagctttaagccaggatgagccaagagaaggaatttcacaaggtaatgtcatcagttaaggcaggaacaggccattttcacttcttttgtggtggaatgtcatcagttaaggcaggaatcgcccatctggatgtgtatgtgcaggtcacaggggatatgatggtttagcttgggctcagaggctggacaaccatgacccctttaaaccacagttggagcagctgggatgtgaggcacaaagtctcaaggttgcaaacagtaggggtgtccctgaacccagcccatgaaaccagtttctcctcctaggcttcctggcatgtgatgggaggggctgtggagaaggtgcctgacattccctggagacattttccccattgtcttggtgattagcatttggctcctcattacttatgcaaatttctgcagctggcttgaatttctccccagaaaatgggtttttcttttctactgcatcattatctgagtgcaaatttttcaaactttgatgatctgtcgcctcttgaatgctttgttgcttagaaatttcttccaccagataccctaaatcatctctcacgttcaaaattccacagatctctagggcaggggggaaatgctgccagtctgtttgctaaagcatggcaagagtcacctttgctccagttcccaagaagttcctcagctccatcttagaccacctcagcctggacttcattgtctatgtcactctcagcattttggtcagag

SEQ ID NO: 617 - DNA, 2633 bp, Homo sapiens
ggggtgcaaagatttaaattagcataatttagaaaaagcataaattggaaaaattaaaacacaaattccaacaatatttgtaccgtttttatttgtaaaaataaccatctgaatgcatttccatagtatattacagttaagtacttcattacgttattagagcattcagtagttgcaaaagtattaaactgtgcttgagaagattcagattgtttcaaagtcattcactgaactaaaagtcattttccccatttttacagtcatgacatttaccagagtcattcaactccaatttacataagaaaacattatagacaaaatcccactgaaatcatcaaacaatattttatgctgttacaaatatgttatgcaaaatataacactggcaccagatttgtatcatcgtgctttacaaagatatattgcacatgctagagcataaaatatgtagacaaaactaccaaataaaagatatttgcattgaatttttagatcacataagaaacgcatagaattacattttatacaaacactcagattgtcactatcttaaaatgcttttcccctataatactgacctatggtttatagtttcgtaagacgaaagcattttagcactgcaaaatcaaacaattcctatagaaaacttaagcattttcatattcatttcaatgcaagtacaaggggaaataggaaaaaagacactttatacattcaaagaaaagttgaaatgaaaactcactggtatcatattgctctgataacactcaaatgaaaaaatacaaaacattccacagaacattttcagaatatacaaatataaaaaggcactctaacttcatattacaagacaataaaacggatgagttcttcaaccaacacaacatataagcacaccaagttgctcaacagtacaaagaataactagtgcagcaaatccatttgatgttcttgttctaatttaataacaaaatgataaaccaagcagtgtttactgcctaaagtaccaaaacatactatggtgcccttttagtagtgataaatagaaataccctgagctatttactgtagaatcatagcagattttaggcaatttggagatagtaatgtatttagcaaagacaggcagacactggcaaataagtaagtgcaatgaaacatgatccttgtagttgtggttaaaatacagtctaaaaataacacaaataaaagcactaagcaactaagactcagttaaaaacacatttttttttcttagaaagctatggtgcaaacataattttatttctaagagatgtaattaaaatacagaaatgatagtttttaaagtcatttctttaaaaaaattttgccttggggtatgggagaaagagaaagagaggaagagagagagagagagatcagttgatgtaatgaacagttcattgtgagcatgatttcatttcgttcctttgtcctccttctatgagtaagagagtgggaaaagtcaaaacgcagctccatggagataacgtctcatggtgagtcactgctttgctgaaatgattcttgtactctctgctacacgacaggaaaaatgttaacgctgctttgccattaaagcaagcatttcatttcctgcttgaaatgccaactgagcaagatttccattcacttctagaaaaagacaccgcagcatattgtgcttcttcaacactgaacctctcttaattttcagtgttttggtaaagataaggtcattattgctcattagcaatttatctgctttttaaaaattcatcttctctaaacaaacgaaaaggacagaaggtgggaagcacaacaccaagaattcaaaaaaacaatggtggtggtgtggaaaattttcagtgaaatcaataccagttcaataaatcctttgaacaagttctcatttgtgaagaacccaacaggagttttaattaaatccaggatattaagagtaagattaaagttttatagctagatgaaaaatataatacagttatctgtctttgatccagatatgatagaacattatttttgaaatatctcacatacactataaaatagcaatttccagggtggaaatggaactcattataaaacgtcagagagtactgctctaattcgacacatttcttttctgtctcttcctcaagtagaaaatagcacttgagctggtgatttttatttctccttttggcacatgtgcccacacactgccatcatttctcatcaggttactgagactatgtgagcttttcagtgtacttagggtaatttctagatatttctttgtgctgcctttgtgtatatgatccactacacatctgagttttcatctcgcagaagggcatccagactgcaatgtcttctaagctctaagctggctacagactgtggctgagcagtagaagatgcgtagccctctctaaccaacgcggaagaacctgagggtcatctggaaaccttagcagtggaaatgctaggtttggcccttgggcttttggctagcccagggtcaagtgttttttttttcactttttttttgttattctaaataagatacatagcaattaaaatagagaacaaataatggatgtttcctcaccatttgtttcatttcaaataaa

SEQ ID NO: 618 - DNA, 2633 bp, Homo sapiens; identical to SEQ ID NO: 617

SEQ ID NO: 619 - DNA, 2633 bp, Homo sapiens; identical to SEQ ID NO: 617

SEQ ID NO: 620 - DNA, 5090 bp, Homo sapiens
caagctgccagggcctcgataggcagggcgcggcaggtgccaggaccacgtgcaggctgcagagcacggcccgcacgctccgcaccactcgcagcgccatgttcccaggggtgcggggatggcagcgctacgcctcagccactcgcgcggggaggcggggcggtgtgggcagaagtaaatttctttataaattacccagtctgggcctggtgtgttggctcacatgtgtaattccagaactttgggaggtcaaggtgggaggagcgcctgggcccaggggttcaagacgagcctgggcaacatagtgagacctgtctctataaaatatttttaaaaattagctgggcgcggtggcttacgcctgtaatcccagcactttgggaggccgaggtgggcagatcatgaggtcaggagtttgagaccagcctgaccaacatggtgaaaccccgtctctactaaaaatacaaaaattagctgggcatggtggcgcacacctgtaatcctagctagatcctagtagattgaggcaggaaaactgaacccgggaggtggaggttgcagtgagctgagattgtgccactgcacttcagcctgggcgacaaactgagactccgtctcagaaaaaaaaaataaataaataaaaattagtggggcatggtggctcacacctgtagttccagctgttcaggaggctgaggcaggaggattgcttgatccagggaggttgaggctgcagtgaactgtgatcatgccactgaaccccagcctgggtgacagagttgcctcaatcagtcaatcaatcaacccatcacccagtctgtgatattctgttttaacagcagaaacaaagacaactagacatgcccactgtgttatgtacttacctctattagaatatgttatgtcattactataattgatgcctacatatctcttttagtatactgttagcttcttgaggacattagctaaattgtatttctctttgtagtcttgggtaatgtacttgacacacagtagatactctgcaaaaaaattttgtttttctttttgagatggggtctcgctttgtcgcccatgctagagcgcagtggcgcgatctgggatcactgcaacctccgcctcccaggtttaagcaattctctgactcagcctccagagtagctgggattacaggtgtcttgccaccatgcccggctaatttttgtatttttagtagagatggggtttcactatcttggccaggctggtcttgaactcctggccttatgagagccaccgcacccagctgatactctgcaaatgtttaatagatgttggagctgaatttcaggctttgtaatgtcacagaaccaggcatcagaagagctgatccaaacccaagatctgcccctaacttgcctcttattctttctggcctccatttccacaattataaaatgcaggtataatactaaaatttttttttgtatagtcctttacagatccaaaattatgattttaagaaggaaattaataagttattcatctcagtatctctttaggtgccaatactgtaaattaatcaccagtctcagatcatatatttgccatttccaacatatgcttttagtccagtctaatcaccagtctcagactatacattgccattttcaacatatgcttttagtgagttatttaaaaatattaagatatcagatgttttgagtatcagcaataggtaagtcaatctctaaacattttcagtagtgaaaaacacaaaaaacactttaagcagagggtatttggttttgagatccttgttctcttaaaatctgtgatctgaaatctagtcagttttctcattaacatccttgtcccttgggataaattaaatcagcaaactaaagtgctatgtaactattaaaatattttaaaatattggttatttaaaacttattaggggccgggtacagtggctcatgcctgtaatcccagcactttgggaggctgaggcaggtggatcacttgaactcaggagtttaagaccagcctgggtaacatggcgaaacctcgtctctacaaaaaatacaaaaattagccaggtgtggtggcgtgtgcctgtagtcccagccacttgggagactgaagtgggaggatggcttgagcccaggagatggaggttgcagtgtgctgagatcatgccatgcattgcactccagtctgggtaacagagccagaatcttattagggaattctgacatcttcatctttttataaaagatggccaggctgggtgcgctggctcacatctggaatcccagcactttgggaggctgaggcgggtgaatcacctgaggtcaggggttcaagaccagcctgaccaatatggtgaaacctcatctctactaaaaatacaaaaattgactgggcacggatagctcacgcctgtaatcccagcactctgggaggttgaggcgggtggatcacctgaggtcaggagtttgagaccatcctgcccaacatggtgaaaccccgcctctactaaaaacacaaaaattagctgggcgtggtggtgtgctcctgtagtcccagctactcaggaggctgaggcaggaggatcgcttgaacccaggaggtggaggttgcagtgagctgagattgcgccactgcactccagactggcaatacagtgagactcaatctaagataaaacaaagaaacaaaaaggaatgcacttcttaataagctggagattattttaggcatggctttccctcatagtctatgaaattttcctacaatgatcatcctcagttagcacatggggcatttagtatatgtcaggaaacaggcctaaggtttttacaagctttctgatgtaatcatcaaaacaattctatgaggctggaagtaggtacaattttacaatttttatcctcattttacagatgaagaaatactcttaaagaaaatgttaatgtcaacaacaaacaataaattggtactgggtattgtcaaatatattttttaatttttactttttttcagacagagtctcactctgtcacccaggctggagtgcaacggtgcaatcttgactcactgcaacctccgtctcctgggtttaagtgattctcctgcctcagcctcctgagtgagtagctgggattacaggcatatgccaccatggctggctaattttgtatttttagtagagacagagtttcaccatgtcggacaggctggtctcgaaaactcctgacctcaggtgatccgcctgcctcggcctcccaaagtgctgggattacaggcttgagctactgtgccaggccaagtatatttttaattaatgtattcattataatacaatttactacaaatttgaggggggaggctttccatatggaattcaagatatttttggatatatattcaacttttttttttaagagttgggggtcttgttatgttgctgatatggtttggatggctgtcacttccaaatctcatgttgaaatgtaacccccaatgctggaggtagggcctcgtgggaggtatagaatcatggggcaaatccttcatgaatggcttggcaccatcaccttggtgatgagtgagatcttagttcatgtgaaatttggttgtttagagtctgggacctcctcctctctcttgctccctctctcaccatgtgatatgctcgctcccattttgccttctaccatgattgtaagcttcctgaggccctcatcagaagcagctgctggtgccatgctttgtgtacagcctgcagaaactgtaagccaattaaatctctcttttgcaagaattacccaatctcagatattcctttacagtaatgcaaacagattaaaacagattagtactgacagtggggcactgctatacatattggaaaatgtagaaacagctttggaactgggtaacaggcagaggttggaagaatctggagggctcagaagacagaaagatgagggaaagtttggaacttagagactagttaagtggttgtgaccaaaatgctgatagacatatggtgaagtccagagtgatgaggtctcagatggaaatgaggaagttattgggaacaggaataaaggtacatctatgtcatgctttagcaaatagcttgggtgcattgtgtccaggccctaggaatctgtggaagtttgaacttaagagtgatgacttagggtatcagggtatctggcagaagaaatttctaagcagcaaagcattcaagatgtggcctggctgatgctagcagcctacaatcagatatggaagcaaagaaataacttaaagttggaacatatttaaaagggaagcagagcgtagaagtttggaaaattcacagactagtcatgtggcagagaaggaaaaagcactttgaggagaggaatacaagcaggctgcaggaatacagttgtccatgctggactcaactcatttgctcaagcaatccttgtgcctcagcctcccaagtagctggggctatagcttgtgccatcatgctcagctattcaccttacattgctgtccaaaatgttttcatttgaggcaacctgggatagtaaaagtacttctaattaaacactcctgccattagtatctagctgtgtagccataaataagttatttgatatttcttgagtctcaattaatacctactattagcagagattttgtgaagaatagtcttaatgtatttaaagctttaatggcacttatttagaaggtcctcaggaaatggtattattattccaaggtctttctagattgccttattcacctaaagagacttgatcttgagcctttgtagattttctcattggtgattccttcactgcttagaatgtcatgattccaccagacaggttactctcatctacgtgtatttttcttacatctttttcagtctatttttctctagcaattatcttcaatgtttatgcttacaataaccttagtatttggcattacgacactaatatgtgcccatgagacagacggagcactacttatcccagaggaggtattatttatttatttatttattttttgagagggaggcttgtttcttcacc

SEQ ID NO: 621 - DNA, 5090 bp, Homo sapiens; identical to SEQ ID NO: 620

SEQ ID NO: 622 - DNA, 5090 bp, Homo sapiens; identical to SEQ ID NO: 620

SEQ ID NO: 623 - DNA, 4143 bp, Homo sapiens
gagaagagttgcccccctaactgctgtgccctttctgtattctggacccatggactctcaggaacctaacaaaatggttgttttacatcagtaagttttggggtagtttgttgtgcagcaataggtaagtggaacacctctcagaatctgtgtgttttagttggggagatagctgcccagctagatactgcatttcccagcctcctcacttacgggtgaacgtggctgtaagtcctgtgtagggtatgtgaatggaagatgcaatttccaagtcatatcaataaaatgttaagtgctcattctccgcttgcattccctcaccgcttctttctggcacaccgacctggggtacacagatattaaggacggctgtcacagattggattccctaggaagcagactcagagcagtttagcatgcagaatatttattaaggcgttccctgggagtcaacacctgtgtaagggaggggacaaaagcaagagcgggcaaaaggaaaagttgagctgcaatgcagattcaatggcagcctcagccaaccccacagagaggtcaggagctaaagtggtccttcagaattgtccctcattgggctgagatggctagacctttatacctccacaggtatcagtcattggatgggggtcatcctggcatatgcttttgcaaagttataatcaggatatattagtcatctattattgcataacaaaataatccaaaacttagtgactaaaaacatgcatttattatctcacagttgctgtgtgctagaaatccagaagcatgaggttgggtgcttctgactgaagatatttcaggttgcagttaagctgtcagctggggcagcagtcatctcaactctattgaggccaaaggattcagctcactcacgtggttgctggtaggccccttccttaccacaggatgcccctctgagcatgagagtattcctcaagaccaaggaggaagctgcctatgggacctcagaacatggaaggtggtgatcaagcgtgggagaaccatagagaacccaaaaacgaaacccaagaagaattaggttttaaaacctaatctcagtagcgacatccttattcattagaagtaagttcagcccacactcaagggtagcggattacccaaggtcatcccaggaggcagggatcattgaggccattttagagtcttcctaccacacataccatgcataagattttgtatacttatatttttactttttttttttttgagatagagtctcactctgtcatctaggcgagagtgcagtggtgcgatcttggctcactgcaacctccgcctcctgggttcaagtgattctgctgtctcagcctcctgagtagctagaattacaggcgtgtgccaccatgctcagctaatttttgtatttttttgttttgttttgttttgttttttgagagagtctcactctgtcatccaggctggagtgcagtggtgtgatctcggctcactgcaacctccatctcctgggttcaagcaattctcctgcctcagcctcctgagtagttgggactacaggcgcatgccaccatgcccggctaattttttgtatttttagtagagacagagtttcaccatgttggctatggctggtctcaaactcctgacctcaggtgacccacctgcctcggcctcccaaagtgctgggattacaggcgtgagccaccgtgcctggactactttttatcaacattttgttttcctacagattcttcatttaaacaattttttttttgagatggaatttcgctcttgttgcccaggctggagtgcaatggtgtgatctcagctcaccgcaacctccacctcccaggttcaagcgtttctcctgcctcagtctcctaagtagctgggattacaggcatgcaccaccacatctggctaattttgtatttttagtagagatggggtttctccatgttggtcaggctggtcccaaactcttgacctcaggtgatctgcccgccttggcctttgggattacaggcgtgagctaccgcacttggccacaatatgttgtttctaaaaattataaagcagtatattgtaaaatttttcaaatgtttgatcaaggtataaaattcatttccttatactataccacatgttaattgatccaggggtaatcacaattaagtttttattgtatctgctgagatactttccatacacacgtaagcatatacatatatacacacacacacattattgtacacttaatttatgtccttaatacattctgaagcactttccatatcagcacgttgagatctagctcattggtttaaacatctgcatgtttcattttatgattatacaaaaaaatttttcagcagttccctattgatggatatttacatatttttgttttgtctgacatgacaaacattgcaaatgtacatcctttgtctcatgatgaatcatgccttgagtctcactcatatctgatttagatgagactttggactttgactttaaagttgatgctggaacaagttaagactttttaggggctattgggatggaatgaatttattttgcatgtgaggacatgaatctggggagcccaaggtgtggaatgctatgttttgaatgtgttgtctccacaattcatgtgttggaaacttaatcccaatgcaacagggttgggaggcggagccttctgggagatgattaggtcacaaggactctggcctcatatttgattgatgccattataaaaagggtttgcgggagcatgttagctctcccttgcccttccatcttctgccatgggaggacagcaagaaggcccttcccagatgctggcacctgatcatggtcttcctggcctccagaattgtaagaagtaaattttttttttttttaacgaagaagtgagtattttattattttgctgtacagctgttgcttcactatataaaaacagcaccagcaaatgcagtgtattgcaaaattaagatagtgttgttcttcatctgacactgtacaagcaacaaaaacttcttcactcccagttatttccaatggaaagatcattaagtatttcatcccaagtccaggtatggacatacacaagttacaatattatataaggcttaagaataacaacattatctttgaattatgtaatttttgtaactaatttttaccatggataatttcatggataatttcatgaatactagagcctagtctaaaaatcataggatgttgtgaaaaagacacatattatgtttatctacaatcattagaaagttaaaaggcatcttctttcattagcagtgttaacagtagtttttttttcccatgggtaatgctaaaagttgctattctaagtcttctatccaccactaatttaggacaactctgctgggttgcgttatttcatactagcttatttagtggttccattttcactcctcaatagattttatgtatttctcatatgcttcttcactcataagttcatctagttatgaagggttactcagtgtcatcttgatcagccaaccatcttcataacgagatttgtttacaagtcctggattttctgcaagagcttcattaatttcggttacttctcctgataaaggagaatagagttcactagcagctttcacactctccaaagcaccaaactcatcttgtttgttcaattttgtcccaacttcaggcagattacagtaaccagacggcgcccatcccaagctgccagggcctcgataggcagggcgcggcaggtgccaggaccacgtgcaggctgcagagcacggcccgcacgctccgcaccactcgcagcgccatgttcccaggggtgcggggatggcagcgctacgcctcagccactcgcgcggggaggcggggcggtgtgggcagaagtaaatttctttataaattacccagtctgggcctggtgtgttggctcacatgtgtaattccagaactttgggaggtcaaggtgggaggagcgcctgggcccaggggttcaagacgagcctgggcaacatagtgagacctgtctctataaaatatttttaaaaattagctgggcgcggtgacaaattttgtgcaattttaagttttacatttttttgtacaaat

SEQ ID NO: 624 - DNA, 4143 bp, Homo sapiens; identical to SEQ ID NO: 623

SEQ ID NO: 625 - DNA, 4143 bp, Homo sapiens; identical to SEQ ID NO: 623

SEQ ID NO: 626 - DNA, 774 bp, Homo sapiens
gcccaagttgtaggaaaaactccaagtggcagggttatacctggttctcttcatcctgcgtctttcctccaccaggtaaccccagatcccatgaggtggcagtgtcaccattgccccagcccagagtcatttcaaggaggagcaggtcacttcctgattcccaaagcatctgcctgtaccattgaaaacttattcctgctcagcccacacactgaggaaaggccatatgagcacacaggaagaagactgccatctgcaaatcaggaagacaatcatcatcaagaacttaccatgctggcaccccgaacttgggcttctgttgtttaagccacccagtctgatattttcttatagcagcccaagctgactaagacaggcagtcaagaattaaaatctgcttggaggagcaccaacatacccattttaaaaaccttattatgtgaaatggctacagttatttaaactcaagaagaacatggaacaagaaagagaaataaagtcagtgagatgaatggactaaaataacctagcagttaatggaataaataggaatgaagccccttttccagtgttagggtcagcctgggatttatcaaggctctaaacaaaaggaattgatcatgagaggttagcagagacatacgggaagcactgcgagagtattcagcactagttggagatttgaattctaactttaaaattctgagacttttgatctattaatttatccattttcattgttcttttgctttgactataaagaaacaaaataag

SEQ ID NO: 627 - DNA, 774 bp, Homo sapiens; identical to SEQ ID NO: 626

SEQ ID NO: 628 - DNA, 774 bp, Homo sapiens; identical to SEQ ID NO: 626

SEQ ID NO: 629 - DNA, 1533 bp, Homo sapiens
tttcagtcagcatgactggaactttgatcaacaaatccccaagagccacaacccgtcttttgtgaacaagtagtatcaaggtgggggtgggcttggagtgcactggatgcttttcttctttcatcatgaaacctggtggttttgtgtcatgtgatatgtttttcagagattcggcaggaagcttgcaccgagtgaaggatttataaagattataggagataacacaaagctattttatctctttaaaaaaaatcaaaggtgtaagctcatcctacacatgtcatttggaccagaccaaggctgctgtcatggaggacccacaccacagcttgggaaccattcatctaccagagggtcacatgacttcaaatgactcttctaggggccacctgccatgatagggtaccagctcttcctctgaattcccaatccatttcttgagaactactgtttctaataagaggggaagaaggtcatgtgggaatcagttaaatcacgtgtggatagaagacaagttccagctttgtgggaaatcctgtagccttcgccaggtacaccctgacaatctcagaactgatcagagtttttgttccatgtgagatacccacgccactttaaaaaacaaactatcctgacatctaattactttgtgaatgattgtaatggcaataacaatagagatggaagaattttggaaacaatactagtttcacagctttcatgtgagatgccaaggttttagcatcgtcagattggcaatgagattggataacttctggggtctttttgaaattatatctttcttttctctaggatcctacttctggaaaataagattaatactaatactaataagacacaaagatttttaatggaaataggaatatcttcaaaggctggatggacattgcatgcactgtatgacaacattcgtgtataataagatcctttccttagagaatggggcaaatccagatggaatgtgagaaagacttcaaggtttcagtggaatatgcttatattgggaattgtattagttaagactaggtttggctgcacatgacagaaaacccaacatagtcacttacacaggattaaaacatttccttgtcatatgaaagtctagaagtggtatgtagctctgggtgtcagggatgaagattccttctaactgggaacccagcttcccatttcaaagattgcttcatattcaaaatggctgctgggtctccaggtatagagtccaccttccagctagaagaacaaagaaccaaaatgaggcgtgttctcccctgtaaggatactttcgtaagttgaataggatgctttcataagcatctcattggccagactggttagaacttagtaactggccacaatcagctggaaagaaggctggcaaatagaatatttaaggtggtcactgtaatcagcaaaaaaatcatgagttacataatatatagaaaaggagaacaagcacagaatgacaactagcagtgtctgcatatcattcttccaagcaaataaatggaa

SEQ ID NO: 630 - DNA, 1634 bp, Homo sapiens
gacatggaccctcctgggcatggaccttcctgggcatggacacttttaggcatggggccctcctgtgcatgaactggcctgggcatggaccctcctgggcatgggccttcctgggcatgaggatctcatgggcatggcccttactgggcatggaccctcatgggcatggggttctccttgacatggtccttcctgggcacagggctctgttgtgtatgggccctcctaggcatggacctttctggacatgaaccctcctgggcatggacccacctcagcatggaccctcctgggcatggaacctccttgacatggaccctcctgggctggaccttcctgggcatgaacgctccttgacatgggcccttctggtaatggatcttcctaggcagggacactcctgggcatgaaccctcctaggcatgaatctttcttgacatggagcctcctgggcatggagcctcctggacagggacactcctggacatgtatcctcctgagcacagggccctctgtgcacgtgactctcccgggcatggggccctccagggcataaactctcctgggcatgaaccctcctgagcatggacccttccaggcatgggaccctcctggacatagaccccccccaaccaggcatggacacccttgcgtatggaccctcccggacatgggacccttttgggcatagagccctcctgggcacgggaccctcctgggaatgaggccctcctgctcatggaccatcctgggcatggaccttcctgggcatgggcccacctgggcatgcacccttttaggcacagagcccttatggggctctcctgggcatgggccctccggagcctgggtcctgtgagatgccatcagccgcatgcttgtgccatgtccctgccagaacatgactgccatctctctccagtcctgtggaacatggaacagggtggggcggtgcctgtggacatgcaatatgggatgacaggatggggtttgagcccaggccgtgctggcccacactcacaggaggtctctggagtgccctgtccttccagcttgggtttcgagatgccctccatgcaggagtacaggagaggcagaaaccagcaggacatcgtgcctttacctgagtgggcacccaacccctgcccctgccagacatggtttccagcctttccctgaaggaaggagaagagggctgggttccttgacagaccctggccacccccttcactgccacccaccccaacccaccctcacctgcttgaccttggtcacccccccttgcaccgctgtgcagcccctacatggagatcagctgctcccagccctgtcttgagcaaggaaacctgggctgggggcctctactgtggtcctgccaggagcttccaacagcccctgctcacgctccaggtgggtgggggtgggaaggggtgaaagggtccaagggggacctcaaagtgaagagccccgaagggtccctggaagatgtccgccagccctctgagccacgcgctccctccctgcctcccaccacacgagtgcgaaacacagagggccccactaggactgactctgggtggggagttttattccagccccgaggggcagcggcaggtgtcatcaaggctgcaccc

SEQ ID NO: 631 - DNA, 7212 bp, Homo sapiens
atttgcttctaggaaaattaactaagatagtatctgtcaggcctctgagcccaagccaagccatcacatcccctgtgacttgcacgcatatataagcccagatggcctgaagtaactgaagaatcacaaaagaagtgaatatgccctgccctaccttaactgatgacattccaccacaaaagaagtgtaaatgcctggttcttgccttaagtgatgacattaccttgtgaaagtccttttcctggcacatcctggctcaaaaagcacccccaatgagcaccttgcgacccccactcctgcccgccagagaacaaaccccatttgactgtaattttcctttacctacccaaatcctataaaacggccccacccttatctcccttcgctgactctctttttggactcagcccacctgcacccaggtgaaataaacagccatgttgctcacacaaagcctgtttggtggtctcttcacacggacgcacatgaaatttggtgccatgactctgatcgggggacctcccttgggagatcaatcccctgtcctcctgttcttcgctctgtgagaaagatccacctacgacctcaggtcctcagaccgaccagcccaaggaatatctcaccaattttaaatctggtaagcggcctctttttactctcttctccaacctccctcactatccctcaacctctttctcctttcaatcttggcgccacacttcaatctctcccttaatttcaattcctttcattttcggggagagacaaaggagacacgttttatccgtggacccaaaactccagcgccggtcacggactgggaaggcagccttcccttggtgtttaatcatggcagggatgcctgattattcatccatgtttcaaaggtgtcagaccacacagggacgcctgccttggtccttcgcccttagcggcaagtcccgcttttctggggaaggggcaagtaccccaaccccttctctgcttttctgggcaaggggcaagtaccataacgccttctctccttgtctctaccccttctctgctttcctggggcaagggcaagtttccctcaaccccttctccttcacccttagtggcaagtcccgcttttctgggggggcaagaatccccaatcccttatttccgcaccccaacctcgcatctctgcccctcgatcccttatttcggtgccccgaccccttacttctgtgccccatcccttatttctgccccccgacctcttatctctgcaccccaaccccttttcccacttttttggaaggtaagaacccccgaaccccttccctccgtttctatactctctcttttctctaggcttgcttccttcactataggcaaccttccaccctccattcctccttctactcccttggcctgtgttctcaaaaacttaaaacctcttcaactcacacctgacctaaaacctaaatgccttattttcttctgcaatgctgcttgaccccaatacaaactcgacagtagttccaaatagccagaaaatggcactttgaatttttccatcctgcaagatctaaataattcttgtcgtaaaataggcaaacagtctgaggtgcctgacgtccaggcattcttttacacatgagtcccttcctagtctctgtgtccagtgcaactcatcccaaatcttccttctttccctcccacctgtcccctcagtaccaaccccaagcgtcactgagtctttctaatcttccttttctacagacccatctgacctctcccctcttggccaggccgagctaggtcccaattcttcctcagcccctcctcctccaccctataatctttttatcacctcccctcctcacaaccctggtccagcttacagtttcattccgtgactagccctcccccacctgcccagcaatttactcttaaaaaggtggctggagccaaaggcatagtcaaggttaatgctcctttttctttatcccaaatcagatagcgtttaggctctttttcatcaaatataaaagtccagcccagttcatgacttgtttggcagcaatcctgagaaactttacagccctagaccctaaaaggtcaaaaggccgtcttattctcaaaatacattttattacccaatctgctcccgacattaaataaaactccaaaaattaaattccagccctcaaaccccacaacagcatttaattaacctcgccttcaaggtgtacaataatagaaaaaagttgcaattccttgcctccactgtgagacaaaccccagccacatctccggcacacaagaatttccaaaagcctgaaccgcagcagccaggcgttcctccagaacctcctcccacaggagcttgctacacatgccagaaatctggccattgggccaaggaatgcccgcagcccgggattcctcctaagccgcgtcccatctgtgtgggaccccactgaaaatcggactgttcaactcacttagcagccactcccagagcccctggaactctggcccaaggctctccgactgactccttcccagatcatctcggcttagcggctgaagactgacactgcccgatggcctcagaagccccctagaccatcacggacactgagcttccggtaactctcacagtggaaggtaagcccgtccccttcttaatcaatacagaggctacacactccacattaccttcttttcaagggcctgtttcccttgcctccataactgttgtgggtattgacggccaggcttctaaacctcttaaaactccccaacgctggtgccaacttagacaatactcttttaagcactcctttttagttatccccacctgcccagttcccttattaggccgagacactttaactaaattatctgcttccctgactattcctggactacagctgtatctcattgctgcccttcttcccaatccaaagcctcctttgcatcctcctcttctatcccccaccttaacccacaagtataagatacctctactccctccttggcgaccgattatgcaccccttaccatctcattaaaacctaatcacccttaccccaccaaacgccaatataccatcccgcagcacgctttaaaaagattaaagcctgttatcactcgcctgctacagcatggccttttaaagcctataaactctccttacaattcccccattttacctgtcctaaaaccagacaagccttacaagttagttcaggatctgcgccttatcgaccaaattgttttgcctatccaccccgtggtgccaaacccatatactctcctatcctcaatacctgtctctacaacccattattctgttctagatctcaaacatgctttctttactattcctttgcacccttaatcccagcctctcttcactttcacttggactgaccctgacacccatcaagctcagcaaattacctaggctgtactgccacaaagcttcacagacagcccccattacttcaatcaagcccaaatttcttccccatctgttacctatctcggcataattctcataaaaatacatgtgctctccctgccaatcgtgtccgactgatctctcaaaccccagcaccttctacaagacaacaactcctttccttcctaggcatggttagcacagacagaattcttacgcaagagccaggaccacaccgtgtagcctttctgtccaaacaacttgaccttactgttttagcctagccctcatgtctgcgtgcagcggctgccgctgctttaatattgttagaggccctaaaaatcacaaaccattctcaactcactctctacatttctcataacttccaaaatctattttctcctcatacctgatgcatatactttctgcttcccggctccttcagctgtactcactctttgttgagtctcccacaattaccattgttcccggcccagacttcaatccggcctcccacattattcctgataccacacctgacctccatgactgtatctctctgatccacctgacattcaccccatttccccaaatttcctggtttcccgttcctcaccctgatcacgcttgatttattgatggcggttccaccaggcctaatcgccacacaccagcaaaggcaggttatgctatagtacaagccactagcccgcctcttagaacctctcatttcctttccatcatggaaatctatcctcaaggaaataacttctcagtgttccatttgctattctactactcctcagggattattcaggccccctcccttccctacacatcaagctcgaggatttgccccaacccaggactggcaaattagcttttctaaacatgtcctgagtcaggaaactaaaatacctcttagtctaaatagacactttcactgaataagtaaaggcctttcctacagggtctgagaaggccaccacagtcatttcttcccttctgtcaggcataattcctcagtttagccttcccacctctatacagtctgataacagaccagcctttattagtcaaatcagccgagcagtttttcaggctcttagtattcagtgaaacctttatatcccttacggtcctccgtcttcaagaaaagtagaacggactaaaggtcttttaaaaacacacctcaccaagctcagccaccaacttaaaaaggactggacaatacttttaccacttttgcttctcagaattcaggcctgtcctcagaatgctacaaggtacatcccgtttaagctcctgtatagacgcctttttattaggccccagtctcattccagacaccagaccaacttagactgtgcccccccaaaaaaacttgtcatccctactatcttctgtctagtcatactcctattcaccgttctcaactacccatacatgccctgctcttgtttacactgccagtttacactgtttttccaagccatcacagctgatatctcctggtgctatccccaaactgccactcttaactcttgaagtaaataaataatctttgctggcagaactatgctgaatctccttaggcactccctaatcagatatcctgagtcatcccaattcttagaccttttacacctgtttttctccttctgttattccatttagtttctcaattcatccaaaaccgtatccaggccatcacctatcattctatacgacaaacgtttcttctaacatccccacaatatcaccccttaccacaagacctcccttcagcttaatctctcccactctaggttcccacgccgcccctaatcccgcttgaagcagcccttagaaacatcgcccattctctctccataccaccccccaaaaattttcgccgccccaacatttcaacaccattttgttttatttttcttattaatataagaaggcaggaatgtcaggcctctgagcccaagccaagccatcgcatcccctgtgacttgcacgcatatataagcccaggtggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggctcatcctggctcaaaaagcacccccactgagcaccttgcgacccccactcctgcctgccagagaacaaaccccctttgactgtaattttcctttacctacccaaatcctataaaacggccccacccttatctcccttcactgactctcttttcggactcagcctgcctgcacccaggtgaaataaacagccatgttgctcacacaaagcctgtttggtggtctcttcacacggacgcacatgaaagtatctgtatgagtcagatttcatgctgctgataaagacatacccgagactgggaagaaaaagaggtttagttggacttacagttccacatggctggggaggtctcagaatcatggcaggaggcaaaaggcacttcttacatggtggcagcaagagaaaatgaggaagaagcaaaagcagaaacccctgataaacccatcagatctcctgagctttattcactatcacaggaatgaccagcccccatgattcaattacctccccctggttccctcccacaacacgtgggaattctgggagatacaattcaagttgagattcgggtggagatccagccaaaccatatcattatcttaattgacatcagtgtcccggtggtcttctgccagtgaatgatacctactattactaaagtatgtccctcaaagatgagtgccatagcaaaagacctttgtaaaataataaaaaaaaaaaaactgctctcctacgggagctgaacagaagtctacaaaataggctggggctcaccctgaccttcctttaactaccacaaatcactcctctttgctgagtaacttaccattgcctctcaattttgtttcatttcaggcattacacctaaaagtaatttgagcaccttgagcttagagcctaccttggctaatgtgaaacactccagctgtgctaagatggtcctcaatagtcaacaagcacttctgaaagtctggtagcggcagttcattaccaacatcacaagcaaaacatgcgctctccctgggcattgaaggtccaccggaaattaagcagacggggctgcaaagcacctcagagtgaagccagccagcttcatctgctgcagcaggctggaggcaagcacaaggagcggcaggaatgaaaggcttcagcgccttccctggtgtctctgtgccttctgagttttcagctgacatggagcagtgattccctgaaaaggatgggatcttgctccctcaaagatcagccttctttgatgagcctgctccagctctgtttcaggcagcaatttcatgccacgcagaatatgaatctaacaggtgaatttccatccagggtccaattctcttactactgatgtggagaaaaccgtaaacaaagccacagtaaagcctcctttttgaggctgagtaaagccagatgaaaggcaagagagactcagcaaaacatatttaggagatgggaaaataaataaattcctttaaaagttgcataatgttcaatagcatgtatccactgttacgtattcaatctttaccttgttgatgcattttccagcttacttttcattttcttcctcggcaaagctgcaataaacattctcctat

SEQ ID NO: 632 - DNA, 2756 bp, Homo sapiens
cccttatgcaccttataaacctttaatttcaaggcaggttgatgagtgagcatctgctataacatactttcttttttcttttttttttttttttcagagacaaaggactttattactcacagcacagcacacagcatgagcatcttgtttgtactcagtccagatgaatactacacatgcagtgggtttgtgtcataatcaaagaactttgtgcttagcaaatctcagtctttttatttatttatttatttatttatttatttatttattttggaggggacagggtcttttttttttattgattattcttgggtgtttctcatagagggggatttggcagggtcataggacaatagcggagggaaggtcagcagataaacaagtgaacaaagaaacaaggagcatgctgccttcaagcatctgtttaacaaagcacatcttgcaccgcccttaatccatttaaccctgagtggacacagcacatgtttcagagagcacaggtttgggggtaaggtcacagatcaacaggatcccaaggcagaagaatttttcttagtacagaacaaaatgaaaagtctcccatgtctacttctttccacacagacacggcaaccatccgatttctcaatcttttccccacctttcccccctttctattccacaaaaccgccattgtcatcatggcccgttctcaatgagctgttgggtacacctcccagacttggtggtggccaggcagaggggctcctcacttcccagtaggggcggccgggcagaggcgcccctcacctcccagaccgggcggctggccgggcggggggctgacccccccacctccctcccggacagggcggctggccgggcggggggctgacccctccacctccctcccggacggggaggctggccgggtggggggctgaccccccacctccctcctggacggggcggctggccggacggggggctgacccccccacctccctcccaggcagggcggctggccgggcagaggggctcctcacttcccagtaggggtggccagggagaggcgcccctcacctcccggacgaggcagctagccgggcagggggctgacacccccacctccctcccggacggtgcggctggccgggtggggggctgacccccccacctccctcgcggacagggcggctggccgggcagaggggctcctcacttcccactaggggcggccgggcagaggcgcccctcacctcccggacggggcggctggccgggcggggggctgacccccccacctcccggacggggtggctggccgggcagaggggctcctcacttcccagtaggggcggctgggcagaggcgcccctcacctcccggacggggcggctggctgggcggggggctgacccccccacctccctcctggagggggcggctggcctggcggggggttaaccaccccacctccctcccggatggggtggctggccaggtggggggctgatcaccccacctccctcccggacaaggcggctggctgggtggggggctgacccccccacctccctcctggacggggcggctagccgggcagaggggctcctcacttcccagtaggggcagctgggcagaggcgcctctcacctcccagacggggcagctggccaggtgggggactgacccccccacctccctcccagatggggcggctggcctggcgggggctgacccccacctccctcccggatggggtggctgccgggcagagacgctcctcacttcccagatggggtggctgccaggcggaggggctcctcacttctcagatggggtggctgccgggcggaggggctcctcacttctcagacagggcggttgccaggcggagggtctcctcacttctcagacagggcagctgggcagagacgctcctcacctcccagacgggctcgcagccgggcagaggcgctcctcacatcccagacggggcggcggggcaaaggcgctccccacatctcagatgatgggcggccgggcagagacgctcctcacttcctagatgggatggcggctgggcagagacgctcctcactttccagactgggcagccaggcagagggactcctcacgtcccaggcgatgggcggccaggcagagacgctcctcacttcccagacggggtggcggccgggcagaggctgcactctcagcactttgggaggccaaggcaggtggctgggaggtggaggttgtagcgagccaagatcacgccactgcactccagcctgggcaccattgagcactgagtgaaccagacaccgtctgcaatcccggcacctccggaggccgaggctggcagatcactcgcggttaggagctggagaccagcccggccaacacagcaaaaccccgtctccaccaaaaaaatacgaagaccagtcaggcgtggtggcgtgtgcctgcaatggcaggcactcggcaggctgaggcaggagaatcaggcagggaggttgcagtgagccgagatggcagcagtacagtccagcttcggcctggcatcagagggagaccgtggaaagagagggagagggagaccgtggcgagagggagagggagagggagagggaggccatggcgaggggagaaggagagggagagggagagggagagggagcaacatactttgtcatttaattcaccattatttgggtataccttatattaaagtgattattaaaaactggaaaatatttaacacatcttca

SEQ ID NO: 633 - DNA, 5319 bp, Homo sapiens
cacggtatgacccacacagctgaggaagagcagggcctggggattccttcagaggggcgaagaggtgtcggatgacaggcacgctccaggaccttcccagcagcttctggcgggcaccacggcccatgttggacacgtctgtgtagtgcacaggaaagccaaagatcctgggggtaccggagtgaaaagacagcaagtcagaagtgcctccaggatgttgacagcctcaaccagccaggtcccactctttctgccctcgccatccctcagtcccatcagtaaggtccccaaggacctaaattcagagcccttaattcagaacacttgcttacaaattgctcacaaatgaaagtcccccgttttgtgcaggcctagcaccatactcttggcatagagttggtgctcagaggaccttcctagaataaatgcatgcatactaaatcagccagccagcaatgtatccattttcaaaacactatgatgggagaagttaagcaatttccttaataaggaacaaggtcactcaaaaacagcctagattttcagtcatcacaggctcaggcaaccagagttttccttccctcttcaaacccagctgccggatgaaggaccatgctagatgactccaggcagatggcatcaaatataccaaaagcttcctctataggattctaccaggcctggaaagaggctacagaggctgagcctcagtgttactcaggtatacaatccaatactaaaagtcatcccaacaggccaatggctgcgtgggttattcagaaacatgccaaagatgtgatacctcaggcctgtgtcttgcttggtcttagcgtctacacaatgtcagccatctgcaccaaccattttaggtttaggtccatacagaataatctacagcataaatactaatcagaagttacttttatactcagaaaactgttggtaagtcaaagaagaaattaaatgagttatagaagtgaaatatctggaatgaaaatactctatatcaaagccttcagaatacagaatacatgtaaagaggaatgttcaaagccataatcactatagcaaataatgatttttaaaaaatagtataagcaaaatgaacaaacaatagaggagtgaaagaaaacagaacagaacagaactgaaatccaagagatggttatttgcatcaaaacagacaaacttagcccaaagaaagggaaggagaggataaactgtggctaagaaggaatcatttatagaatgagcaaactgaagtcttcaagaatggcatgtctgtggggttttctttcactggcttctcacacatcgtagtgtcccagcatgttgggacaggcagatgtcacggcagtgcagccaacagacagatggtgtggcctaatgacctcatgtctcagattcctcaccaccaccacaccccctccgccatttttgtcaggaaataagggcgaactatgaaaaggtattattactcctcgccccagtaacaccaaagggcagtgaggccatcaagaatgaaggtaagcacctgcccatgtctgcccatttgtgttttgatctacacagtttccctctccaagtgcagccttgctcacctttcgagctcagtgcaccacaaaacatcttctttgccattcatgacaacagggaaaagttggtttttcccctgtttgatcgagttcgacttggtggttattgtctgtactttctttaactggagaacaaaatgacatcatggagtgagcacagaatgaagggacctggggagtcaaggctcaaaagtacctgggaaagatggaggggagagcgcaggtgcggcagaagagtggcagggctgggagagaaaagtacctgggaaagatggaagggagagggcaggcgcgggagaggaatggcagggcagggagcgaaaagcagagttggagagacaagaacattttgtgcttcccacaaatgccaagacgttaacaggaaggaccagcctcagagaaaatgagataaacaaaaaagtgaccatgaacgagatcacgtggggggccaagaagacaccagagttcctgatcaagcaagattaagtaaaaaagtaaaaaccacccagatacagagaatgctcaattggagtttagaaaatggatcttagcttgatgcaaacattgagatttaggtttatggaggtcttcatattctatgacttgacagcaaattaattttttggcaaaaggattaatgattcctttctccctgagagggccagctgaaactctttgtctttatgtatccagtactaaaattaaaaagactagttgccttttctcgtcgtgattacttatcacgaatgtctcctagtctctgtatttgaggatgggacagaacaatcatgtgggagagggaagcccaacaccaggaagtcacgtggggggaggagtaggaaccaatcaaacaccaaggtcatctcccaagtccccacttggaggtcaccaagtgcatttttccagagggccacagctcgtcttaccttggctatcctattgtattccaagcagtcctgcagctcgagtttatcattctttgatgctatcacgggcctgggaacagccaaaacccattacttcttactagctatagagggtcctctgctaggcacaaggtgggagtgagggtctatgttgcagagatgtgccctggcagtgaacttggctacaaataaatgatgaaaatgatcctggcatgagcacaagcctgtgtgccaaagccaaggatgggctagaggggacagcccagcatccaggaggtaatgctcccctgcctggacttcaaagtcaggttcccattgagcaggaacactgcatggggtagggcaggagaaacctcaggtcccagctccacactgctcactgactgagcttgagcgagtcacactacccctttgggcttcctgtctattttaaagtgaggagcttggaatagatttttgtgggtctacctgatacaattatcatatcacacccacggtttggtggctcactgctggggatacagcctcaggaggctttaaaagtgaatggcaaccgcctgcagtggttcctacccttaatcccagcaatttgggagttcaaagcaggaggatcgcttaagcctaggagttggaggctacagtgagttatgattacaacactgcactccagcctgggagacagaccctgtctcttaaggttccaaaaaaaaaaaaaaaaaaaaagactaagcacccttttaactttcacccttgaaaattattttgcaaatgcagagagaggcaaacagatgactaagaagggcaagggctagaactgaaagtagttgagcagctccagaacagaaactggtgcaagaggactggacgcagggacggccatagtaacctgtgttaggaacgtcaaggccaaacaactcagacatgagaacgggaaccgtgcctacaagaggggctgaggaaatcacaacacatatttcccctagactgatagatttccttgacctcacctgccaggcttcaaatgctacctctatccccattcctacctccgacatggacccaggggagctgagggcccagaagaaaaggacactgcacagccccgccttgtgctgactataagattaagctctaaacaagccagatgacttgggtctgtcccctaaatgatgcctgacacacccatcctataagcctgcagagcttagtcacagcatcagatctgcatcaggtctcactgctctttccacctcatagcctacacatccaatgcatcagcaaatgtcctaccctccacatatgttgaatctgatccgtccttgctaagtcacaggattgctgtgctgcaaaccccaggggccaccactcacactgtgttctctatggatggcacctcctggggcataacatcataatcagtcatctctccttctttgagcagtctagtcccttcacttgtctccccattcccgcctccatcctgttattgtctataatccacccagaaactaccatgaaccaaagcacaattcatctcatctgtaacttcccatgccaaagtgatttcagcggtaccacattaaggcccaagttacttggtccttctctcccagccaccccacctagggtgctctgagctggtctggggatgtttcccatcatcccagaccctcttcccacctggagtactctaataactgcatgggtccatcccttcacttaggaccttcgctagaatgagaagccttccccatcaacccttccaatgtccatccgccagcaataaaccccaaatcattgtcttctctccctcccccttcggcatgtcactatcgacatgatgtgtttaaccatgaaaatggcaacagcgtaacagtgcctggcctactgggagttcaaatgttgaaagcattaacccatttaattccagacacagacatggcaccctaagactggctgcttagccaagtacacgggcaaggtgaccaacaaaaatcctccaagctaccccaggaccctcacctctgtccacacttcactaagtggcagaaggttattatgtttccatgcctccttctacaggagaatgttttaagctcaactcatttgcaagtctgggatgtcacattaccataacattttacatcttaattagcaagttcttctccttgaaaccacatatagaagaaataattaatcctcagcaaagctgctttgtggctttcagagtgtctgaagaagactgtttttagtatacgataacaaaatatgaaatgctcctggtgatgagaatctgagggacatagtctttgggctattgtttgtcatagcagctctgccacctggttggtcaccatgagcctggccaagatcgcttcatctccagggcaggaggaaaggcaccggtaacaacaatctacttccatttccagacggctgtcactacatcaacggggaggagaggtgaagggcaggagcatcaacaagctcaagtcttgagagatccctggcaggaaggaggtacacagtctggccacagctcatgagacttgtatttttctttatttttttgtagagacggggtctcactttgttgcccaggctagtctagaactcctgggctcaagcgatcctccagcctcggcctcccaaagtgctgggattacaggcgtgagccaccacacccagccacgtgggacttttaggatcaggtccatcagcagcttacaacaggtaagagtgggactcctacagagattcccaggtacttgctgaacatcttaacagagatcaacccg

SEQ ID NO: 634 - DNA, 5319 bp, Homo sapiens; identical to SEQ ID NO: 633

SEQ ID NO: 635 - DNA, 5319 bp, Homo sapiens; identical to SEQ ID NO: 633

SEQ ID NO: 636 - DNA, 478 bp, Homo sapiens
cgtgtctgtgcagaaagaagtagacatgggagacttttcactttgttctgtggtaggaaaggttcttctgccttgggatcctgttgatctatgaccttgcccccagccctgtgctctctggaacatgtgctgtgtccactcagggttgggtggattgagggcggtgcaggatgtgctttgttgggcagatgcttgagggcagcatgctcgttgacagtcatcaccactccctagtctcgggtgcccagggacacagacactgcggagagccgcagggtcctctgcctgggaagaccagagacctttgttcacttgtttgtctgctgaccttcccttcactgttgtcctatgaccctgcggaatccccctttgcgagaaacacccaagagtgatcaatggaaaaaaaaaaaaaaacaaagaaaaaaggaacagaagcaaatgtggcaacatcttgataactgttggaactggacgttgg

SEQ ID NO: 637 - DNA, 511 bp, Homo sapiens
attgcatttactgtggattttatttctattattattaccttgtaatatataatgaaataattgtacaacacaccataatgtagaatcagtgggagccctgagtttgttttccagcaactagacagtcccatcaaggcgtgacgggagacagtgacagatcatcaggcattagattctcataaggagcatgcaacctagatcccttgcatgcgcagttcacaatagggtttgcattcctacgagcatctaatgccaccactgatctgacagaaggcagagctcaggtggtaatgtgagcagtggggagtggctgtacatacagatgaagcttcgctagctcacccacctttcaactcctgctgcgtggcctggttccgaacaggccatggaccggtaccggggttgcggaccccttactctagagctcattcaacctccacagcaagttaaaggaacttcataattacctactccaagtttgcagtaaatgtacccactgggattttaaaat

SEQ ID NO: 638 - DNA, 511 bp, Homo sapiens; identical to SEQ ID NO: 637

SEQ ID NO: 639 - DNA, 511 bp, Homo sapiens; identical to SEQ ID NO: 637

SEQ ID NO: 640 - DNA, 511 bp, Homo sapiens; identical to SEQ ID NO: 637

SEQ ID NO: 641 - DNA, 10140 bp, Homo sapiens
gaaaaccatacacttctccagcatactgttactactacttaaaaagtatcttagccatttctttttttaacttttaacttttaaattcaggggtacaagctcaggatttttacttaggtaaacatgtcatgggggtttgttgtacagattatttcatcacccaggtattaaccctagtacccattagttgtttgtttcccaatcctctccctcctcccatcctccaccctctgaaaggtcccagtgtgtgttgttcccctctgtgtgtccatgtgttctcatcatttagctcgcacttataaatgacaacatgcagtatttggttttctgttcctgcgttagtttgctaaggataatggccattatcttagccatttgaaaataatgatttaacctctctcaccttcattgtcattttagaagaaactaccatttggtgtcctgctgagacaagaaaatattttcacaactcaagacaagttaaatatccacttatgggaacagtgctgaaggcctggactaggatggtagcaatggagacagactaaagaaagagatgcaatcattcccttgcatatggtccgtatgaagacgggatcattacaggaaaggtgaaggagatacagtcattatgctctatatacacccatttttatggctagcggctgaagatgggatgctttctttgctggaagacctattacctgttaggttgcaaaagatgtgatcatcttcctaaacaataatttagagtcccataacaattttaagtgtgctgttcatgaaaatttgaatacattgtattgggaatataatggaagtgagatgcctcatgtcgtgagaaaatctgacataaactccttaagcatgagaggccatgtgggtatggaagccctgaaagggaggaaaaaacagccagaccctagctgttccagtcatcccaactgaggtgccagacttgtgattgaggccatcttgcatcatctaggcctagtagagctgccaactgactgcagacacatgagtcaatccagctaatgccacatggagcagagacaagccgcccagctgagcccagtccagatgacagaatcatgagcaaataaggttgttgttcttttaagccactaaattttcgggtgatttgttacacagtaataaataactgaaacaactatgtacagtttaatgatctgaaatcaatccatagtgttatgatagcctttttaacaaaattgaaatgataacttattcatttacaatgcaaatcaatttaatggcaatagttacaactgccctgaaatgatctaaagcctcatgaagttgatttaatatctagctacccaacatacttaatcacatgttcacagttgatgaatagtgactgaatctccatgagcaagataatagtaaagctctttttttctctttctctttttttccagatgaataattttacatttacactgataaaaagttaaagttgcagctctgttttcacactacctgagggatctttgtagattacataaaccctaagcctcctgtgtaagttaaggaaaaaaattccaaactcacagtgttatcgagaggattaaataacataatttatgcaaagtcttaaccatagttgctagcatttaaactttaacttttgtccatgtctctaatgtaatttaaaatgatcttactctttaaggtttgatctaatagaatatttgtcagacacaaagaccaagatttgtcccagttgatgaaccctgggtataactcaatagcatattggcagtttttattttctgttaagtctggatccattcaattagtgatttatttcttaatttgtcaaacattacattaacaaagtaacaacttttctatccatattatattgtggttacaaaaaatggatcaattatatttgaattaaaaaatttaattgccaccaaagaagagaaaaataactagagaaaaataaaagagatgtgtcaagaaggaataaagaggctgataacatgagatctcttctagctttgaaacatgtcttgtgaaatgactaaaattttaaaagctaggatcaagtattggtgaggagatgaagtaattctaagtctcatccattgctaatggggtatacattggtttaaccagtttggaggactgtttggtaatgtccaaatatttattaaagttaaacctactcctaagtcttatagcccagaaatttcaaacctaggtaaatacctaagagaaataagagtacatgtcttccaaaagatctatacaagaatgtgtatagcagccatagtcataactccctaaaactggaaatgacccaaatgtccataaaaagggaaatggatacatgtatcattacatatttatctaatgaattgctatgtcgctgtaagaatgagcaacccactgatacatgccacagtatcatgaatcacatagacagtatgctgcctgaaataagccaaaataaaaaatgtcttatttcacttatatgaagttctagaatatgtaaacgtgatttatgatgacagaaattaaaatagcagttccctttgcatagggggagcgtattcattacggaagtgtatgataaaacattgtacattggtggaatgttctatatcttcacttgagtgtttaccaggatatatgtccacaaaaaagttaggaatccatacttaagatttgtgccctttataatatgtgtgttatacagccactgaaaataaattgatagataaaaagtaatgtcttctaggttccatatggagaggactgatgaagccagcattaggcgtgatggggacgtgcataaatgtgtatgttatccactgagacacagattctgaagcaccagaacattaaaggcacttctacttgtttcttctacccagctgaaaggacagaaagcttcttccacagagccaggacagtccaggggaacgtagtccttcgactgaaagctatgcttcctattttctaacaaagaggctaggtcatgttgaccacccagttttggcctgcctggcttgctttttattccagcctggaggactttcagggttgaatatccactcaagccaaatcccaagaagcataacctgctattagactcttgtcacttatcgggtgaggggctgtgcggctgttccagtgcttccccacttgggtcttgtgacataccctggggccaagccaagccctggaggttagcttctacagtctgtccttaaagagagctcagggatgtctggacaggacctggagacagtgccctgggccagagacctctgatctctaggccagcagagtcaccatgcagacagatttatgagccttaggcaaaacagctggcattcctgtggccatctttctaccccttcctttccacatgaccatatccttggccagatcttcatgtccttagatggctgttgcctttgggtaaattggcaattaagataaatgagcatatttatcatggccttgtggttacccctcctgaagctctcagggtggcaagctgcctgaccctcctactatgaacttagtaactttaaaacagagagtatcttttcttgcccagctgaaatttcctccccaggcgacctacttttaggattaatatgcgggaaagtctgcagttttgttttcagtgagggtagttgtgttttcaaggaaagaggtagcgccttacagtcagattagccagctttatttctttcatcaaccctttactggctttctaaattttttcaagtaacttcacctctctgagtttcatttacctcattaccttcatcaggtaagatgacatatgaaaagcccttctcaagcaactgcaaagttccaattaatagaagaaattgtaatgactatctgtgtttgaagcggggccatttttcttatttggaattttcacgtattaaaaatatggatcctttacacctgtatgcctttactctccaaattgattcattctctagttcctctatctcattactaagttcaaataatcatcttcctacaaatcactcagtttagatgccttgaaggcttctttgaatacttgctcctgttcacacccgacagtcagtcatcaagccctgtggaacttgtccctggtcaacatccgttcttctccattcctactgccgttcaccacacgcaggccctcattgtcccctcctgggatctatatcctctcctcagcacctttttcttctctattgataccatagacaacttctcatctcatattctctaaactcaactttcaggatatcatactcttattccatagatcagaactttcaatgactttctccttctttacagctcttcataacaactctgaagatagattcagtccttctttttggaattgcctcttatttctttttctttttatgcccatcataaacctcccattggcaaaattaccatgaacattttcttgtgaattcattgccttggttcattggttcatggacgggcaccaccatgagccaattagaatctttccctgagaatctagaatcatggttaagaaggtatagatctgcctgatgctttgttgaatgaagaaaatataatgtcccaagggtggcagccatttttctgccctatgaacttcaaaatgcagaaaatctatctggaatgtgaaagaagaaggatatcaatgtaaaaacaagaacaatatagataagtagagagagaagagagagtgactccccattctgcttttttctgaggccttaatttttttttatttgtcattggtctgctaagataagttatcccccccgcttttttttttttaggagacgactcactctgttgccaggctggaatgcaatgccacaatctcggctcaccacaatctccacttccagggtttaagcgattcccttgcttcagcctcctgagtagctgggactgcaggcatgcaccaccatgtccagctaattttttgtatttttagtagagatggagtttcaccatgttggccaggatggtctccatctcttgacctcgtgatcttcctgcctcagcctcccaaagtgctgggattacaggtgtgagccaccatgcctgggcaccctttttaatttaacaacctggagttagatttctatatttgtgacactgggagtcctacttgttttaggacctacataccaactgtcatttactgaaatgatatttagccatacattttttcccatctgattataaaacaaaaatcacaaatctagagaagtttgctccaatattctaaaatgcttggaacatacataataatataattgaaactcccttccctcttggcttttctgaccttgaactctcctcttttctgactcctcagcccagcaccaccccttcctttcccttctttgcctctcctttttctactcatcttccaaaagtaagtaatgttctgcaaactgaccttggacttattctcttgtctatttgcaagttctcccttagtgtctcatcatttcctggcttcaactattattttcaggtaaccatctcctcatctttacatcctaacttcttttactgccccattctaacactaccaactcttcgctagacatacccacttggattctcctcctgcttctcaatctgaaaatgcctaaatcagtggttttcaactgggggtgattttgttccccagggacatttgacaattctggagacattttcttattatcacaactggggttggagatcctcctagcatccagtgagtagaggccagtgatgttgctaaccatcgtaaaagaacagaagagcctcttacaacaaagaattatctggccaacagttctgaagctgagaagctctgctctgaaacaaatctcaccatgccctccctgtatttcctctatggcctaaatctgatcattttcctgtgtcctcttgcctgttagtgacaccttcaacctctaaatcacccagaccataaatttcagtaggtcttgttcaactatttgtcaaggatgatttataaagtatgcttacagtgggaaaaaaataaagtaaatattacttctaaaatactttctatatctaggagtgtttgattgtatcaatcttaaatataaatattataaaattagacaagaatacatttaaacatataagaaaataaaacatttaatttcaaataccttatctatcaaatagattctggttaaagcaactaatcttctactctttagaaaaacaaacttattgggaccactcatatattgctgcaattttcctgcacattaaattaaggggagcatggtacaacttctgatgaggatggcaagcctgtctagtactctaacattggaatatgggctttataagcttcttatatgtgttttgaaagggcaacccaaagaaaatgcaaagaaaaaggggatggtcaacagataaagtttttatcaatttctctggggaagaaagtagcttcctatgaagctaattccctgcatagcatttattcctgtctgatgtttgtttattgttaatttacctgtttgttttttgttgctttccactagaatgcaagacccacgaattcaggggacttatatactttgttagctgttacatctccagatttaaacctatgctttttattaggcattctatttgttgaccaaaggaatggattaatgaatacatgcttgaataagtatgtgacttatatgaggtccagtgagtgtccacatgacaagagcttctgctcagggtccagatctatctaaagatagtggaaagggcatgggacttgactcaataattcatctaaagctgttacttttacagttagatgtttcagaattcaaatttcaggttttccctgttaggtatgtgactttgagagaattatttatcattcattcatttatttaggcagtagtcattgcttgagttcctaatttatgccaggtcctaggctagactctggaaattagtggcagagatggccaacagaaacctgtcctcaaggaactccctactaattggagagacagccattaaatgtattcataagggaatgcattgctttgaaggggagaaatcacaggatagtatgggattacatataggggatatgggaggagctacgtatgtctggtgggttttctgtatctatgcttattaatctataaaataaaggtcatacaaacttcctcagtggtgtttttgtaaagataaactatgaaatgatctggagcccatattggttgcaggaaagcgacttagtaaatattggatccattctttcttattcccgctgagcacaggagcagctttgggaactgcaacctggggctggtgcgacccaagcacatagcaatgaaactcatctaggccttttcttccttctagaatagtgacaacagatgtgagaagcctaatcagctgattgctccataaaatcataagggctgcaggtctgctccacatggttgaatcgaaggcttctcaattctgccactttcattttttggtccctcttcctgaaattacttaagttttctactcttacctgaaatgctcacagttgggtgtgatgagtccttgtatatgcaatctatctggctttctagaggtcatagaggtcatagcaggctctagattattcctttagtcacatcttcttgacctggcaagctaaggattagctcgtgagccctctttaagaggaggggctcatctgggttcaccgagattgcaggaggcaaagtgctgtagggcaccacctcattctagtgctacgcattgtaactggctgacctctcagagaccacactgcggccgtggaaatctgccttttgtaagatgccctgagaaactggagaatattagagaggaatgaatataaaagcagtaaacacaacaagcctttgttgaacttagtaattgccatcactgggttagatgagcaaggagaaggtttatgaagctgtgtaggcatggttttaatcatatgaggccagatcgattaggcctggcatctcagtctgaacagatgaaagggggtgtgataaaacccacatttgtaggaggtacctcattgggatggtcaaatctttcttacgtgccctatgaacatgggcaagttacttaccccctctacatctcagcttccttacttgtgaaataaagatggtaatagctatcacgtagggaacagagatcacgtgccaacactgtgcctagaacctcacctgcatcagcatgtatcacactcctaatcatcctgtgaggtaggcagattaggtgtctatgttttacagataagcaaattgagtgtctaaatggctaaataactcttccaaagttacacaaacggtaaactgaagagttaggataggagtctggctaatataatgccaaatccattctataaattactgaatcataatgatcttatagagtccatgtgatgatttaatgagatgttaaatgtaaatagctgctcagaagtaatttttagctgctattgttgtggttattttcattagcatcaccatcacaatcagataattgtggaaagtttcttacttagattcagaagtacagattatacaacagcattaagtgtagaataaaggaaaggagatcctattcatcagcaaggatgtagcgaaggaaagtttaaaatattgactgtacaaggtccaacttctctgatgggcttgggcccacaattcacctaagctgagattttttcatgataggaagctgctgctaattatttgcatacagtgcagcacaagaacctgcccctgaagtcatgtcactctagtatttagcagcttctttatgggaaagatattttatattaataccttgggaaaagtagttacagcacatctctcagagataaaataccaaagcaacactcacttccatcttgcataagttattgcaacaatgatgctgtgtaacaaacaaacacaaaacacaatggcataccacaataagtgtttattgttcatgtgtctgaagtgatcagctaaataaatctggcattcttggatttatgcgtctgaggattggttgtctgcctatctaggctagcctcctttgagatatctggaatggcttgggtctgtgtctcatccttctcctggaactagcaggctagtctaggcagatccttgctgatgacaaaggctcaagaaagcaagcaggcatgtgtaagaccacttgaggaagtagaaatccaacagttctacttccttcacttagctaaaggaagttacatgggcaaacccaaaagcaagagatagagttgacctgttgactttaaggaactttggtgaaaggaactgcaaagtcatacagaaaaaaagagtggttataggaataagtgaaaaatcaaataatgtcattatctgcccatatcttttcttaaaaacggaatccatatgtgtttgaattttattaaaggagccccacccatatcattagtctagttttatctccaagataaatatataacacattcagcaaatgggttgaagtcagggtcaggtttgttcctgtttattgtctcacccaagatgagcaccaaggagttcagttgttctcacatgtctgtgtgttgctgggccttgtttctttaacaattaattcgttatgagaacagagcttaatccaccctctttactctcacaatgtgtgtgtgggtgtggatgtgggtgggtgtgcgtgtgttaactagcctgtgaaagactgactttttcctagagtcatcagccttgagggtgactctgagaggtcctcggtttatactggaggtagtagagtgaagtggttgattatacaggctcggaaatgaaaccagccaggattcaaatctcaactcttatgtcttaaatatgagatatgtacttagttactgtaatttcatggattttaagcttctttataaaaagagtaaaacttctaattcagagagatgttgtaggactaaacaagatattatgttttgaaagccttttgcagtgtttgcaaaacatatagtaaactgtcttgttcggtcttgttaataccgaatattttaaagcatatgattttaataataaatgagtg

SEQ ID NO: 642 - DNA, 7906 bp, Homo sapiens
tgtttgtttcccaatcctctccctcctcccatcctccaccctctgaaaggtcccagtgtgtgttgttcccctctgtgtgtccatgtgttctcatcatttagctcgcacttataaatgacaacatgcagtatttggttttctgttcctgcgttagtttgctaaggataatggccattatcttagccatttgaaaataatgatttaacctctctcaccttcattgtcattttagaagaaactaccatttggtgtcctgctgagacaagaaaatattttcacaactcaagacaagttaaatatccacttatgggaacagtgctgaaggcctggactaggatggtagcaatggagacagactaaagaaagagatgcaatcattcccttgcatatggtccgtatgaagacgggatcattacaggaaaggcctagtagagctgccaactgactgcagacacatgagtcaatccagctaatgccacatggagcagagacaagccgcccagctgagcccagtccagatgacagaatcatgagcaaataaggttccatatggagaggactgatgaagccagcattaggcgtgatggggacgtgcataaatgtgtatgttatccactgagacacagattctgaagcaccagaacattaaaggcacttctacttgtttcttctacccagctgaaaggacagaaagcttcttccacagagccaggacagtccaggggaacgtagtccttcgactgaaagctatgcttcctattttctaacaaagaggctaggtcatgttgaccacccagttttggcctgcctggcttgctttttattccagcctggaggactttcagggttgaatatccactcaagccaaatcccaagaagcataacctgctattagactcttgtcacttatcgggtgaggggctgtgcggctgttccagtgcttccccacttgggtcttgtgacataccctggggccaagccaagccctggaggttagcttctacagtctgtccttaaagagagctcagggatgtctggacaggacctggagacagtgccctgggccagagacctctgatctctaggccagcagagtcaccatgcagacagatttatgagccttaggcaaaacagctggcattcctgtggccatctttctaccccttcctttccacatgaccatatccttggccagatcttcatgtccttagatggctgttgcctttgggtaaattggcaattaagataaatgagcatatttatcatggccttgtggttacccctcctgaagctctcagggtggcaagctgcctgaccctcctactatgaacttagtaactttaaaacagagagtatcttttcttgcccagctgaaatttcctccccaggcgacctacttttaggattaatatgcgggaaagtctgcagttttgttttcagtgagggtagttgtgttttcaaggaaagaggtagcgccttacagtcagattagccagctttatttctttcatcaaccctttactggctttctaaattttttcaagtaacttcacctctctgagtttcatttacctcattaccttcatcaggtaagatgacatatgaaaagcccttctcaagcaactgcaaagttccaattaatagaagaaattgtaatgactatctgtgtttgaagcggggccatttttcttatttggaattttcacgtattaaaaatatggatcctttacacctgtatgcctttactctccaaattgattcattctctagttcctctatctcattactaagttcaaataatcatcttcctacaaatcactcagtttagatgccttgaaggcttctttgaatacttgctcctgttcacacccgacagtcagtcatcaagccctgtggaacttgtccctggtcaacatccgttcttctccattcctactgccgttcaccacacgcaggccctcattgtcccctcctgggatctatatcctctcctcagcacctttttcttctctattgataccatagacaacttctcatctcatattctctaaactcaactttcaggatatcatactcttattccatagatcagaactttcaatgactttctccttctttacagctcttcataacaactctgaagatagattcagtccttctttttggaattgcctcttatttctttttctttttatgcccatcataaacctcccattggcaaaattaccatgaacattttcttgtgaattcattgccttggttcattggttcatggacgggcaccaccatgagccaattagaatctttccctgagaatctagaatcatggttaagaaggtatagatctgcctgatgctttgttgaatgaagaaaatataatgtcccaagggtggcagccatttttctgccctatgaacttcaaaatgcagaaaatctatctggaatgtgaaagaagaaggatatcaatgtaaaaacaagaacaatatagataagtagagagagaagagagagtgactccccattctgcttttttctgaggccttaatttttttttatttgtcattggtctgctaagataagttatcccccccgcttttttttttttaggagacgactcactctgttgccaggctggaatgcaatgccacaatctcggctcaccacaatctccacttccagggtttaagcgattcccttgcttcagcctcctgagtagctgggactgcaggcatgcaccaccatgtccagctaattttttgtatttttagtagagatggagtttcaccatgttggccaggatggtctccatctcttgacctcgtgatcttcctgcctcagcctcccaaagtgctgggattacaggtgtgagccaccatgcctgggcaccctttttaatttaacaacctggagttagatttctatatttgtgacactgggagtcctacttgttttaggacctacataccaactgtcatttactgaaatgatatttagccatacattttttcccatctgattataaaacaaaaatcacaaatctagagaagtttgctccaatattctaaaatgcttggaacatacataataatataattgaaactcccttccctcttggcttttctgaccttgaactctcctcttttctgactcctcagcccagcaccaccccttcctttcccttctttgcctctcctttttctactcatcttccaaaagtaagtaatgttctgcaaactgaccttggacttattctcttgtctatttgcaagttctcccttagtgtctcatcatttcctggcttcaactattattttcaggtaaccatctcctcatctttacatcctaacttcttttactgccccattctaacactaccaactcttcgctagacatacccacttggattctcctcctgcttctcaatctgaaaatgcctaaatcagtggttttcaactgggggtgattttgttccccagggacatttgacaattctggagacattttcttattatcacaactggggttggagatcctcctagcatccagtgagtagaggccagtgatgttgctaaccatcgtaaaagaacagaagagcctcttacaacaaagaattatctggccaacagttctgaagctgagaagctctgctctgaaacaaatctcaccatgccctccctgtatttcctctatggcctaaatctgatcattttcctgtgtcctcttgcctgttagtgacaccttcaacctctaaatcacccagaccataaatttcagtaggtcttgttcaactatttgtcaaggatgatttataaagtatgcttacagtgggaaaaaaataaagtaaatattacttctaaaatactttctatatctaggagtgtttgattgtatcaatcttaaatataaatattataaaattagacaagaatacatttaaacatataagaaaataaaacatttaatttcaaataccttatctatcaaatagattctggttaaagcaactaatcttctactctttagaaaaacaaacttattgggaccactcatatattgctgcaattttcctgcacattaaattaaggggagcatggtacaacttctgatgaggatggcaagcctgtctagtactctaacattggaatatgggctttataagcttcttatatgtgttttgaaagggcaacccaaagaaaatgcaaagaaaaaggggatggtcaacagataaagtttttatcaatttctctggggaagaaagtagcttcctatgaagctaattccctgcatagcatttattcctgtctgatgtttgtttattgttaatttacctgtttgttttttgttgctttccactagaatgcaagacccacgaattcaggggacttatatactttgttagctgttacatctccagatttaaacctatgctttttattaggcattctatttgttgaccaaaggaatggattaatgaatacatgcttgaataagtatgtgacttatatgaggtccagtgagtgtccacatgacaagagcttctgctcagggtccagatctatctaaagatagtggaaagggcatgggacttgactcaataattcatctaaagctgttacttttacagttagatgtttcagaattcaaatttcaggttttccctgttaggtatgtgactttgagagaattatttatcattcattcatttatttaggcagtagtcattgcttgagttcctaatttatgccaggtcctaggctagactctggaaattagtggcagagatggccaacagaaacctgtcctcaaggaactccctactaattggagagacagccattaaatgtattcataagggaatgcattgctttgaaggggagaaatcacaggatagtatgggattacatataggggatatgggaggagctacgtatgtctggtgggttttctgtatctatgcttattaatctataaaataaaggtcatacaaacttcctcagtggtgtttttgtaaagataaactatgaaatgatctggagcccatattggttgcaggaaagcgacttagtaaatattggatccattctttcttattcccgctgagcacaggagcagctttgggaactgcaacctggggctggtgcgacccaagcacatagcaatgaaactcatctaggccttttcttccttctagaatagtgacaacagatgtgagaagcctaatcagctgattgctccataaaatcataagggctgcaggtctgctccacatggttgaatcgaaggcttctcaattctgccactttcattttttggtccctcttcctgaaattacttaagttttctactcttacctgaaatgctcacagttgggtgtgatgagtccttgtatatgcaatctatctggctttctagaggtcatagaggtcatagcaggctctagattattcctttagtcacatcttcttgacctggcaagctaaggattagctcgtgagccctctttaagaggaggggctcatctgggttcaccgagattgcaggaggcaaagtgctgtagggcaccacctcattctagtgctacgcattgtaactggctgacctctcagagaccacactgcggccgtggaaatctgccttttgtaagatgccctgagaaactggagaatattagagaggaatgaatataaaagcagtaaacacaacaagcctttgttgaacttagtaattgccatcactgggttagatgagcaaggagaaggtttatgaagctgtgtaggcatggttttaatcatatgaggccagatcgattaggcctggcatctcagtctgaacagatgaaagggggtgtgataaaacccacatttgtaggaggtacctcattgggatggtcaaatctttcttacgtgccctatgaacatgggcaagttacttaccccctctacatctcagcttccttacttgtgaaataaagatggtaatagctatcacgtagggaacagagatcacgtgccaacactgtgcctagaacctcacctgcatcagcatgtatcacactcctaatcatcctgtgaggtaggcagattaggtgtctatgttttacagataagcaaattgagtgtctaaatggctaaataactcttccaaagttacacaaacggtaaactgaagagttaggataggagtctggctaatataatgccaaatccattctataaattactgaatcataatgatcttatagagtccatgtgatgatttaatgagatgttaaatgtaaatagctgctcagaagtaatttttagctgctattgttgtggttattttcattagcatcaccatcacaatcagataattgtggaaagtttcttacttagattcagaagtacagattatacaacagcattaagtgtagaataaaggaaaggagatcctattcatcagcaaggatgtagcgaaggaaagtttaaaatattgactgtacaaggtccaacttctctgatgggcttgggcccacaattcacctaagctgagattttttcatgataggaagctgctgctaattatttgcatacagtgcagcacaagaacctgcccctgaagtcatgtcactctagtatttagcagcttctttatgggaaagatattttatattaataccttgggaaaagtagttacagcacatctctcagagataaaataccaaagcaacactcacttccatcttgcataagttattgcaacaatgatgctgtgtaacaaacaaacacaaaacacaatggcataccacaataagtgtttattgttcatgtgtctgaagtgatcagctaaataaatctggcattcttggatttatgcgtctgaggattggttgtctgcctatctaggctagcctcctttgagatatctggaatggcttgggtctgtgtctcatccttctcctggaactagcaggctagtctaggcagatccttgctgatgacaaaggctcaagaaagcaagcaggcatgtgtaagaccacttgaggaagtagaaatccaacagttctacttccttcacttagctaaaggaagttacatgggcaaacccaaaagcaagagatagagttgacctgttgactttaaggaactttggtgaaaggaactgcaaagtcatacagaaaaaaagagtggttataggaataagtgaaaaatcaaataatgtcattatctgcccatatcttttcttaaaaacggaatccatatgtgtttgaattttattaaaggagccccacccatatcattagtctagttttatctccaagataaatatataacacattcagcaaatgggttgaagtcagggtcaggtttgttcctgtttattgtctcacccaagatgagcaccaaggagttcagttgttctcacatgtctgtgtgttgctgggccttgtttctttaacaattaattcgttatgagaacagagcttaatccaccctctttactctcacaatgtgtgtgtgggtgtggatgtgggtgggtgtgcgtgtgttaactagcctgtgaaagactgactttttcctagagtcatcagccttgagggtgactctgagaggtcctcggtttatactggaggtagtagagtgaagtggttgattatacaggctcggaaatgaaaccagccaggattcaaatctcaactcttatgtcttaaatatgagatatgtacttagttactgtaatttcatggattttaagcttctttataaaaagagtaaaacttctaattcagagagatgttgtaggactaaacaagatattatgttttgaaagccttttgcagtgtttgcaaaacatatagtaaactgtcttgttcggtcttgttaataccgaatattttaaagcatatgattttaataataaatgagtg

SEQ ID NO: 643 - DNA, 8471 bp, Homo sapiens
gaaaaccatacacttctccagcatactgttactactacttaaaaagtatcttagccatttctttttttaacttttaacttttaaattcaggggtacaagctcaggatttttacttaggtaaacatgtcatgggggtttgttgtacagattatttcatcacccaggtattaaccctagtacccattagttgtttgtttcccaatcctctccctcctcccatcctccaccctctgaaaggtcccagtgtgtgttgttcccctctgtgtgtccatgtgttctcatcatttagctcgcacttataaatgacaacatgcagtatttggttttctgttcctgcgttagtttgctaaggataatggccattatcttagccatttgaaaataatgatttaacctctctcaccttcattgtcattttagaagaaactaccatttggtgtcctgctgagacaagaaaatattttcacaactcaagacaagttaaatatccacttatgggaacagtgctgaaggcctggactaggatggtagcaatggagacagactaaagaaagagatgcaatcattcccttgcatatggtccgtatgaagacgggatcattacaggaaaggtgaaggagatacagtcattatgctctatatacacccatttttatggctagcggctgaagatgggatgctttctttgctggaagacctattacctgttaggttgcaaaagatgtgatcatcttcctaaacaataatttagagtcccataacaattttaagtgtgctgttcatgaaaatttgaatacattgtattgggaatataatggaagtgagatgcctcatgtcgtgagaaaatctgacataaactccttaagcatgagaggccatgtgggtatggaagccctgaaagggaggaaaaaacagccagaccctagctgttccagtcatcccaactgaggtgccagacttgtgattgaggccatcttgcatcatctaggcctagtagagctgccaactgactgcagacacatgagtcaatccagctaatgccacatggagcagagacaagccgcccagctgagcccagtccagatgacagaatcatgagcaaataaggttccatatggagaggactgatgaagccagcattaggcgtgatggggacgtgcataaatgtgtatgttatccactgagacacagattctgaagcaccagaacattaaaggcacttctacttgtttcttctacccagctgaaaggacagaaagcttcttccacagagccaggacagtccaggggaacgtagtccttcgactgaaagctatgcttcctattttctaacaaagaggctaggtcatgttgaccacccagttttggcctgcctggcttgctttttattccagcctggaggactttcagggttgaatatccactcaagccaaatcccaagaagcataacctgctattagactcttgtcacttatcgggtgaggggctgtgcggctgttccagtgcttccccacttgggtcttgtgacataccctggggccaagccaagccctggaggttagcttctacagtctgtccttaaagagagctcagggatgtctggacaggacctggagacagtgccctgggccagagacctctgatctctaggccagcagagtcaccatgcagacagatttatgagccttaggcaaaacagctggcattcctgtggccatctttctaccccttcctttccacatgaccatatccttggccagatcttcatgtccttagatggctgttgcctttgggtaaattggcaattaagataaatgagcatatttatcatggccttgtggttacccctcctgaagctctcagggtggcaagctgcctgaccctcctactatgaacttagtaactttaaaacagagagtatcttttcttgcccagctgaaatttcctccccaggcgacctacttttaggattaatatgcgggaaagtctgcagttttgttttcagtgagggtagttgtgttttcaaggaaagaggtagcgccttacagtcagattagccagctttatttctttcatcaaccctttactggctttctaaattttttcaagtaacttcacctctctgagtttcatttacctcattaccttcatcaggtaagatgacatatgaaaagcccttctcaagcaactgcaaagttccaattaatagaagaaattgtaatgactatctgtgtttgaagcggggccatttttcttatttggaattttcacgtattaaaaatatggatcctttacacctgtatgcctttactctccaaattgattcattctctagttcctctatctcattactaagttcaaataatcatcttcctacaaatcactcagtttagatgccttgaaggcttctttgaatacttgctcctgttcacacccgacagtcagtcatcaagccctgtggaacttgtccctggtcaacatccgttcttctccattcctactgccgttcaccacacgcaggccctcattgtcccctcctgggatctatatcctctcctcagcacctttttcttctctattgataccatagacaacttctcatctcatattctctaaactcaactttcaggatatcatactcttattccatagatcagaactttcaatgactttctccttctttacagctcttcataacaactctgaagatagattcagtccttctttttggaattgcctcttatttctttttctttttatgcccatcataaacctcccattggcaaaattaccatgaacattttcttgtgaattcattgccttggttcattggttcatggacgggcaccaccatgagccaattagaatctttccctgagaatctagaatcatggttaagaaggtatagatctgcctgatgctttgttgaatgaagaaaatataatgtcccaagggtggcagccatttttctgccctatgaacttcaaaatgcagaaaatctatctggaatgtgaaagaagaaggatatcaatgtaaaaacaagaacaatatagataagtagagagagaagagagagtgactccccattctgcttttttctgaggccttaatttttttttatttgtcattggtctgctaagataagttatcccccccgcttttttttttttaggagacgactcactctgttgccaggctggaatgcaatgccacaatctcggctcaccacaatctccacttccagggtttaagcgattcccttgcttcagcctcctgagtagctgggactgcaggcatgcaccaccatgtccagctaattttttgtatttttagtagagatggagtttcaccatgttggccaggatggtctccatctcttgacctcgtgatcttcctgcctcagcctcccaaagtgctgggattacaggtgtgagccaccatgcctgggcaccctttttaatttaacaacctggagttagatttctatatttgtgacactgggagtcctacttgttttaggacctacataccaactgtcatttactgaaatgatatttagccatacattttttcccatctgattataaaacaaaaatcacaaatctagagaagtttgctccaatattctaaaatgcttggaacatacataataatataattgaaactcccttccctcttggcttttctgaccttgaactctcctcttttctgactcctcagcccagcaccaccccttcctttcccttctttgcctctcctttttctactcatcttccaaaagtaagtaatgttctgcaaactgaccttggacttattctcttgtctatttgcaagttctcccttagtgtctcatcatttcctggcttcaactattattttcaggtaaccatctcctcatctttacatcctaacttcttttactgccccattctaacactaccaactcttcgctagacatacccacttggattctcctcctgcttctcaatctgaaaatgcctaaatcagtggttttcaactgggggtgattttgttccccagggacatttgacaattctggagacattttcttattatcacaactggggttggagatcctcctagcatccagtgagtagaggccagtgatgttgctaaccatcgtaaaagaacagaagagcctcttacaacaaagaattatctggccaacagttctgaagctgagaagctctgctctgaaacaaatctcaccatgccctccctgtatttcctctatggcctaaatctgatcattttcctgtgtcctcttgcctgttagtgacaccttcaacctctaaatcacccagaccataaatttcagtaggtcttgttcaactatttgtcaaggatgatttataaagtatgcttacagtgggaaaaaaataaagtaaatattacttctaaaatactttctatatctaggagtgtttgattgtatcaatcttaaatataaatattataaaattagacaagaatacatttaaacatataagaaaataaaacatttaatttcaaataccttatctatcaaatagattctggttaaagcaactaatcttctactctttagaaaaacaaacttattgggaccactcatatattgctgcaattttcctgcacattaaattaaggggagcatggtacaacttctgatgaggatggcaagcctgtctagtactctaacattggaatatgggctttataagcttcttatatgtgttttgaaagggcaacccaaagaaaatgcaaagaaaaaggggatggtcaacagataaagtttttatcaatttctctggggaagaaagtagcttcctatgaagctaattccctgcatagcatttattcctgtctgatgtttgtttattgttaatttacctgtttgttttttgttgctttccactagaatgcaagacccacgaattcaggggacttatatactttgttagctgttacatctccagatttaaacctatgctttttattaggcattctatttgttgaccaaaggaatggattaatgaatacatgcttgaataagtatgtgacttatatgaggtccagtgagtgtccacatgacaagagcttctgctcagggtccagatctatctaaagatagtggaaagggcatgggacttgactcaataattcatctaaagctgttacttttacagttagatgtttcagaattcaaatttcaggttttccctgttaggtatgtgactttgagagaattatttatcattcattcatttatttaggcagtagtcattgcttgagttcctaatttatgccaggtcctaggctagactctggaaattagtggcagagatggccaacagaaacctgtcctcaaggaactccctactaattggagagacagccattaaatgtattcataagggaatgcattgctttgaaggggagaaatcacaggatagtatgggattacatataggggatatgggaggagctacgtatgtctggtgggttttctgtatctatgcttattaatctataaaataaaggtcatacaaacttcctcagtggtgtttttgtaaagataaactatgaaatgatctggagcccatattggttgcaggaaagcgacttagtaaatattggatccattctttcttattcccgctgagcacaggagcagctttgggaactgcaacctggggctggtgcgacccaagcacatagcaatgaaactcatctaggccttttcttccttctagaatagtgacaacagatgtgagaagcctaatcagctgattgctccataaaatcataagggctgcaggtctgctccacatggttgaatcgaaggcttctcaattctgccactttcattttttggtccctcttcctgaaattacttaagttttctactcttacctgaaatgctcacagttgggtgtgatgagtccttgtatatgcaatctatctggctttctagaggtcatagaggtcatagcaggctctagattattcctttagtcacatcttcttgacctggcaagctaaggattagctcgtgagccctctttaagaggaggggctcatctgggttcaccgagattgcaggaggcaaagtgctgtagggcaccacctcattctagtgctacgcattgtaactggctgacctctcagagaccacactgcggccgtggaaatctgccttttgtaagatgccctgagaaactggagaatattagagaggaatgaatataaaagcagtaaacacaacaagcctttgttgaacttagtaattgccatcactgggttagatgagcaaggagaaggtttatgaagctgtgtaggcatggttttaatcatatgaggccagatcgattaggcctggcatctcagtctgaacagatgaaagggggtgtgataaaacccacatttgtaggaggtacctcattgggatggtcaaatctttcttacgtgccctatgaacatgggcaagttacttaccccctctacatctcagcttccttacttgtgaaataaagatggtaatagctatcacgtagggaacagagatcacgtgccaacactgtgcctagaacctcacctgcatcagcatgtatcacactcctaatcatcctgtgaggtaggcagattaggtgtctatgttttacagataagcaaattgagtgtctaaatggctaaataactcttccaaagttacacaaacggtaaactgaagagttaggataggagtctggctaatataatgccaaatccattctataaattactgaatcataatgatcttatagagtccatgtgatgatttaatgagatgttaaatgtaaatagctgctcagaagtaatttttagctgctattgttgtggttattttcattagcatcaccatcacaatcagataattgtggaaagtttcttacttagattcagaagtacagattatacaacagcattaagtgtagaataaaggaaaggagatcctattcatcagcaaggatgtagcgaaggaaagtttaaaatattgactgtacaaggtccaacttctctgatgggcttgggcccacaattcacctaagctgagattttttcatgataggaagctgctgctaattatttgcatacagtgcagcacaagaacctgcccctgaagtcatgtcactctagtatttagcagcttctttatgggaaagatattttatattaataccttgggaaaagtagttacagcacatctctcagagataaaataccaaagcaacactcacttccatcttgcataagttattgcaacaatgatgctgtgtaacaaacaaacacaaaacacaatggcataccacaataagtgtttattgttcatgtgtctgaagtgatcagctaaataaatctggcattcttggatttatgcgtctgaggattggttgtctgcctatctaggctagcctcctttgagatatctggaatggcttgggtctgtgtctcatccttctcctggaactagcaggctagtctaggcagatccttgctgatgacaaaggctcaagaaagcaagcaggcatgtgtaagaccacttgaggaagtagaaatccaacagttctacttccttcacttagctaaaggaagttacatgggcaaacccaaaagcaagagatagagttgacctgttgactttaaggaactttggtgaaaggaactgcaaagtcatacagaaaaaaagagtggttataggaataagtgaaaaatcaaataatgtcattatctgcccatatcttttcttaaaaacggaatccatatgtgtttgaattttattaaaggagccccacccatatcattagtctagttttatctccaagataaatatataacacattcagcaaatgggttgaagtcagggtcaggtttgttcctgtttattgtctcacccaagatgagcaccaaggagttcagttgttctcacatgtctgtgtgttgctgggccttgtttctttaacaattaattcgttatgagaacagagcttaatccaccctctttactctcacaatgtgtgtgtgggtgtggatgtgggtgggtgtgcgtgtgttaactagcctgtgaaagactgactttttcctagagtcatcagccttgagggtgactctgagaggtcctcggtttatactggaggtagtagagtgaagtggttgattatacaggctcggaaatgaaaccagccaggattcaaatctcaactcttatgtcttaaatatgagatatgtacttagttactgtaatttcatggattttaagcttctttataaaaagagtaaaacttctaattcagagagatgttgtaggactaaacaagatattatgttttgaaagccttttgcagtgtttgcaaaacatatagtaaactgtcttgttcggtcttgttaataccgaatattttaaagcatatgattttaataataaatgagtg

SEQ ID NO: 644 - DNA, 8912 bp, Homo sapiens
gaaaaccatacacttctccagcatactgttactactacttaaaaagtatcttagccatttctttttttaacttttaacttttaaattcaggggtacaagctcaggatttttacttaggtaaacatgtcatgggggtttgttgtacagattatttcatcacccaggtattaaccctagtacccattagttgtttgtttcccaatcctctccctcctcccatcctccaccctctgaaaggtcccagtgtgtgttgttcccctctgtgtgtccatgtgttctcatcatttagctcgcacttataaatgacaacatgcagtatttggttttctgttcctgcgttagtttgctaaggataatggccattatcttagccatttgaaaataatgatttaacctctctcaccttcattgtcattttagaagaaactaccatttggtgtcctgctgagacaagaaaatattttcacaactcaagacaagttaaatatccacttatgggaacagtgctgaaggcctggactaggatggtagcaatggagacagactaaagaaagagatgcaatcattcccttgcatatggtccgtatgaagacgggatcattacaggaaaggtgaaggagatacagtcattatgctctatatacacccatttttatggctagcggctgaagatgggatgctttctttgctggaagacctattacctgttaggttgcaaaagatgtgatcatcttcctaaacaataatttagagtcccataacaattttaagtgtgctgttcatgaaaatttgaatacattgtattgggaatataatggaagtgagatgcctcatgtcgtgagaaaatctgacataaactccttaagcatgagaggccatgtgggtatggaagccctgaaagggaggaaaaaacagccagaccctagctgttccagtcatcccaactgaggtgccagacttgtgattgaggccatcttgcatcatctaggcctagtagagctgccaactgactgcagacacatgagtcaatccagctaatgccacatggagcagagacaagccgcccagctgagcccagtccagatgacagaatcatgagcaaataaggttgttgttcttttaagccactaaattttcgggtgatttgttacacagtaataaataactgaaacaactatgtacagtttaatgatctgaaatcaatccatagtgttatgatagcctttttaacaaaattgaaatgataacttattcatttacaatgcaaatcaatttaatggcaatagttacaactgccctgaaatgatctaaagcctcatgaagttgatttaatatctagctacccaacatacttaatcacatgttcacagttgatgaatagtgactgaatctccatgagcaagataatagtaaagctctttttttctctttctctttttttccagatgaataattttacatttacactgataaaaagttaaagttgcagctctgttttcacactacctgagggatctttgtagattacataaaccctaagcctcctgtgttccatatggagaggactgatgaagccagcattaggcgtgatggggacgtgcataaatgtgtatgttatccactgagacacagattctgaagcaccagaacattaaaggcacttctacttgtttcttctacccagctgaaaggacagaaagcttcttccacagagccaggacagtccaggggaacgtagtccttcgactgaaagctatgcttcctattttctaacaaagaggctaggtcatgttgaccacccagttttggcctgcctggcttgctttttattccagcctggaggactttcagggttgaatatccactcaagccaaatcccaagaagcataacctgctattagactcttgtcacttatcgggtgaggggctgtgcggctgttccagtgcttccccacttgggtcttgtgacataccctggggccaagccaagccctggaggttagcttctacagtctgtccttaaagagagctcagggatgtctggacaggacctggagacagtgccctgggccagagacctctgatctctaggccagcagagtcaccatgcagacagatttatgagccttaggcaaaacagctggcattcctgtggccatctttctaccccttcctttccacatgaccatatccttggccagatcttcatgtccttagatggctgttgcctttgggtaaattggcaattaagataaatgagcatatttatcatggccttgtggttacccctcctgaagctctcagggtggcaagctgcctgaccctcctactatgaacttagtaactttaaaacagagagtatcttttcttgcccagctgaaatttcctccccaggcgacctacttttaggattaatatgcgggaaagtctgcagttttgttttcagtgagggtagttgtgttttcaaggaaagaggtagcgccttacagtcagattagccagctttatttctttcatcaaccctttactggctttctaaattttttcaagtaacttcacctctctgagtttcatttacctcattaccttcatcaggtaagatgacatatgaaaagcccttctcaagcaactgcaaagttccaattaatagaagaaattgtaatgactatctgtgtttgaagcggggccatttttcttatttggaattttcacgtattaaaaatatggatcctttacacctgtatgcctttactctccaaattgattcattctctagttcctctatctcattactaagttcaaataatcatcttcctacaaatcactcagtttagatgccttgaaggcttctttgaatacttgctcctgttcacacccgacagtcagtcatcaagccctgtggaacttgtccctggtcaacatccgttcttctccattcctactgccgttcaccacacgcaggccctcattgtcccctcctgggatctatatcctctcctcagcacctttttcttctctattgataccatagacaacttctcatctcatattctctaaactcaactttcaggatatcatactcttattccatagatcagaactttcaatgactttctccttctttacagctcttcataacaactctgaagatagattcagtccttctttttggaattgcctcttatttctttttctttttatgcccatcataaacctcccattggcaaaattaccatgaacattttcttgtgaattcattgccttggttcattggttcatggacgggcaccaccatgagccaattagaatctttccctgagaatctagaatcatggttaagaaggtatagatctgcctgatgctttgttgaatgaagaaaatataatgtcccaagggtggcagccatttttctgccctatgaacttcaaaatgcagaaaatctatctggaatgtgaaagaagaaggatatcaatgtaaaaacaagaacaatatagataagtagagagagaagagagagtgactccccattctgcttttttctgaggccttaatttttttttatttgtcattggtctgctaagataagttatcccccccgcttttttttttttaggagacgactcactctgttgccaggctggaatgcaatgccacaatctcggctcaccacaatctccacttccagggtttaagcgattcccttgcttcagcctcctgagtagctgggactgcaggcatgcaccaccatgtccagctaattttttgtatttttagtagagatggagtttcaccatgttggccaggatggtctccatctcttgacctcgtgatcttcctgcctcagcctcccaaagtgctgggattacaggtgtgagccaccatgcctgggcaccctttttaatttaacaacctggagttagatttctatatttgtgacactgggagtcctacttgttttaggacctacataccaactgtcatttactgaaatgatatttagccatacattttttcccatctgattataaaacaaaaatcacaaatctagagaagtttgctccaatattctaaaatgcttggaacatacataataatataattgaaactcccttccctcttggcttttctgaccttgaactctcctcttttctgactcctcagcccagcaccaccccttcctttcccttctttgcctctcctttttctactcatcttccaaaagtaagtaatgttctgcaaactgaccttggacttattctcttgtctatttgcaagttctcccttagtgtctcatcatttcctggcttcaactattattttcaggtaaccatctcctcatctttacatcctaacttcttttactgccccattctaacactaccaactcttcgctagacatacccacttggattctcctcctgcttctcaatctgaaaatgcctaaatcagtggttttcaactgggggtgattttgttccccagggacatttgacaattctggagacattttcttattatcacaactggggttggagatcctcctagcatccagtgagtagaggccagtgatgttgctaaccatcgtaaaagaacagaagagcctcttacaacaaagaattatctggccaacagttctgaagctgagaagctctgctctgaaacaaatctcaccatgccctccctgtatttcctctatggcctaaatctgatcattttcctgtgtcctcttgcctgttagtgacaccttcaacctctaaatcacccagaccataaatttcagtaggtcttgttcaactatttgtcaaggatgatttataaagtatgcttacagtgggaaaaaaataaagtaaatattacttctaaaatactttctatatctaggagtgtttgattgtatcaatcttaaatataaatattataaaattagacaagaatacatttaaacatataagaaaataaaacatttaatttcaaataccttatctatcaaatagattctggttaaagcaactaatcttctactctttagaaaaacaaacttattgggaccactcatatattgctgcaattttcctgcacattaaattaaggggagcatggtacaacttctgatgaggatggcaagcctgtctagtactctaacattggaatatgggctttataagcttcttatatgtgttttgaaagggcaacccaaagaaaatgcaaagaaaaaggggatggtcaacagataaagtttttatcaatttctctggggaagaaagtagcttcctatgaagctaattccctgcatagcatttattcctgtctgatgtttgtttattgttaatttacctgtttgttttttgttgctttccactagaatgcaagacccacgaattcaggggacttatatactttgttagctgttacatctccagatttaaacctatgctttttattaggcattctatttgttgaccaaaggaatggattaatgaatacatgcttgaataagtatgtgacttatatgaggtccagtgagtgtccacatgacaagagcttctgctcagggtccagatctatctaaagatagtggaaagggcatgggacttgactcaataattcatctaaagctgttacttttacagttagatgtttcagaattcaaatttcaggttttccctgttaggtatgtgactttgagagaattatttatcattcattcatttatttaggcagtagtcattgcttgagttcctaatttatgccaggtcctaggctagactctggaaattagtggcagagatggccaacagaaacctgtcctcaaggaactccctactaattggagagacagccattaaatgtattcataagggaatgcattgctttgaaggggagaaatcacaggatagtatgggattacatataggggatatgggaggagctacgtatgtctggtgggttttctgtatctatgcttattaatctataaaataaaggtcatacaaacttcctcagtggtgtttttgtaaagataaactatgaaatgatctggagcccatattggttgcaggaaagcgacttagtaaatattggatccattctttcttattcccgctgagcacaggagcagctttgggaactgcaacctggggctggtgcgacccaagcacatagcaatgaaactcatctaggccttttcttccttctagaatagtgacaacagatgtgagaagcctaatcagctgattgctccataaaatcataagggctgcaggtctgctccacatggttgaatcgaaggcttctcaattctgccactttcattttttggtccctcttcctgaaattacttaagttttctactcttacctgaaatgctcacagttgggtgtgatgagtccttgtatatgcaatctatctggctttctagaggtcatagaggtcatagcaggctctagattattcctttagtcacatcttcttgacctggcaagctaaggattagctcgtgagccctctttaagaggaggggctcatctgggttcaccgagattgcaggaggcaaagtgctgtagggcaccacctcattctagtgctacgcattgtaactggctgacctctcagagaccacactgcggccgtggaaatctgccttttgtaagatgccctgagaaactggagaatattagagaggaatgaatataaaagcagtaaacacaacaagcctttgttgaacttagtaattgccatcactgggttagatgagcaaggagaaggtttatgaagctgtgtaggcatggttttaatcatatgaggccagatcgattaggcctggcatctcagtctgaacagatgaaagggggtgtgataaaacccacatttgtaggaggtacctcattgggatggtcaaatctttcttacgtgccctatgaacatgggcaagttacttaccccctctacatctcagcttccttacttgtgaaataaagatggtaatagctatcacgtagggaacagagatcacgtgccaacactgtgcctagaacctcacctgcatcagcatgtatcacactcctaatcatcctgtgaggtaggcagattaggtgtctatgttttacagataagcaaattgagtgtctaaatggctaaataactcttccaaagttacacaaacggtaaactgaagagttaggataggagtctggctaatataatgccaaatccattctataaattactgaatcataatgatcttatagagtccatgtgatgatttaatgagatgttaaatgtaaatagctgctcagaagtaatttttagctgctattgttgtggttattttcattagcatcaccatcacaatcagataattgtggaaagtttcttacttagattcagaagtacagattatacaacagcattaagtgtagaataaaggaaaggagatcctattcatcagcaaggatgtagcgaaggaaagtttaaaatattgactgtacaaggtccaacttctctgatgggcttgggcccacaattcacctaagctgagattttttcatgataggaagctgctgctaattatttgcatacagtgcagcacaagaacctgcccctgaagtcatgtcactctagtatttagcagcttctttatgggaaagatattttatattaataccttgggaaaagtagttacagcacatctctcagagataaaataccaaagcaacactcacttccatcttgcataagttattgcaacaatgatgctgtgtaacaaacaaacacaaaacacaatggcataccacaataagtgtttattgttcatgtgtctgaagtgatcagctaaataaatctggcattcttggatttatgcgtctgaggattggttgtctgcctatctaggctagcctcctttgagatatctggaatggcttgggtctgtgtctcatccttctcctggaactagcaggctagtctaggcagatccttgctgatgacaaaggctcaagaaagcaagcaggcatgtgtaagaccacttgaggaagtagaaatccaacagttctacttccttcacttagctaaaggaagttacatgggcaaacccaaaagcaagagatagagttgacctgttgactttaaggaactttggtgaaaggaactgcaaagtcatacagaaaaaaagagtggttataggaataagtgaaaaatcaaataatgtcattatctgcccatatcttttcttaaaaacggaatccatatgtgtttgaattttattaaaggagccccacccatatcattagtctagttttatctccaagataaatatataacacattcagcaaatgggttgaagtcagggtcaggtttgttcctgtttattgtctcacccaagatgagcaccaaggagttcagttgttctcacatgtctgtgtgttgctgggccttgtttctttaacaattaattcgttatgagaacagagcttaatccaccctctttactctcacaatgtgtgtgtgggtgtggatgtgggtgggtgtgcgtgtgttaactagcctgtgaaagactgactttttcctagagtcatcagccttgagggtgactctgagaggtcctcggtttatactggaggtagtagagtgaagtggttgattatacaggctcggaaatgaaaccagccaggattcaaatctcaactcttatgtcttaaatatgagatatgtacttagttactgtaatttcatggattttaagcttctttataaaaagagtaaaacttctaattcagagagatgttgtaggactaaacaagatattatgttttgaaagccttttgcagtgtttgcaaaacatatagtaaactgtcttgttcggtcttgttaataccgaatattttaaagcatatgattttaataataaatgagtg

SEQ ID NO: 645 - DNA, 2198 bp, Homo sapiens
gcgcctctccaacgccccgcacccgcccccctcagaagcacgtgcgccttacgtaatttcctgttattcttcggtttgcctcctcccagtggcgtggatttgctcccgacccgcttttggggcgtgcctgcttcctcctctctgttagatctcgctctgtcacccaggctggagtgaaatggcacaatcttggctcactgtaacctccgcccccaggttcgactgattctcgtgcctcagcctcctcagtagctgggattacaggatggagagtaaaggaggtaaaggaggactctgatgcctcagccatgcgcctgtgtgccgattcccattaagcctgcaccaatttgatttccaagactccagtcaatcctcagagctccaggaggggaggggcagcttttcctggtagctgctgatcaccagcagagggagccctaggactgcagggcctctttccttaccgttggtgaagcccttcactgtggcttcaaaactgtggaagacccgggatttgtggatcacttgcctttagaatagaatcaagaaataaagctgcagaagaaagaatctccatgtgatgagccccagagaggcgaagccacttgagctcgtgagtgacagtcagatgtcaagccctgctctttctaaagcgtgctgccttcagaaaagaagagccagaaggatggaaattacttcagaaagatgaataccagctttgaaggaataaaagctgacgaggaattgaaggagttgaggcacgagcttgaacagggttgcatgtttggcccttgattgtaaatgcccattgctgcacctgttcctgttacttggggagttgcagcagaaggaacagcggcctgggactccagagaactgggttccctctcatccctccagggccaccacttcttgtgggcccttgggcaagtcactgtactttctgagtctcagtttccccatttgcagaatggaaataactaccccggtctaccaacttagaagaattgctttgaggatctgataaggtggtgtggatgatgctgccttgggggctttacagtatggagctcaagggaccccttaagttgggcttacttagtaactccaggggtgggcagaacaggactccaatgagggtttttttctttttcccttttttttcttttcctatctcttaacttttatctttattattttacaatgcccttgtaagatgaaacaagtgatgctgaaatatctttttcttttttaacctttattttagaattggggtacatgtgcaggtttgttacataggtacagtgtgggctgctgaggtttgggagtacgaatgaattagtcaccccagtggtgagcatagtgcccgataagtggttttttcaacccttactcccatccctctccattcttgtgttccccagtgtctgctgttcccatttttatgaccatgtgtactcaatgtttagctcccacttagaagtaagaacatgcccagcactttgggaggccgaggtgggtggatcatgaggtcaagagatcgagaccatcttggctaacaaagtgaaaccctgtctctactaaaaacataaaaaattggccgggtgtggtggtgggcacctgtagtcctagctactcgggaggctgagacaggagaatcgcctgaaccggggaggtggaggttgcagtgagctgagattgtaccactgcactccagcctgggtgacagagtgagactccatctcaaaaaaataaaaataaaaaaataaaaagaatgtggtgtatgattttgttttctgtttctatgttaatccacttaggataatggcctccagctacatccacgttgttacaaaagacacgatttcattctcttatatggctgcctaatattccacggtgtatatgtaccatattttctttatcacatccactgttgatccacacctgggttgattccatgtctgtgctattgtgaatagcactgcagtgaacatgtgggtgcgtgtgtctttgtggtagaacgatttcttttcctttgagtataatatatccattaatgggatggggctgacatacttaaagtagaaacgaaaattgtcatgtgctcccccacgcccctccattctactctgcagagagacagctgcctgctgtttgtggtttagtacacctccttccaggctttaaataaacta

SEQ ID NO: 646 - DNA, 2198 bp, Homo sapiens; identical to SEQ ID NO: 645

SEQ ID NO: 647 - DNA, 4658 bp, Homo sapiens
acttacaatgttcctcaattaccttatgatccgttagtcaatgttcagctcttaccgagttcataaatcatctgagccaatctccccaacccgcagaccgccccccaagtcctctttagccctctctggaaatcagtcagcatttacgtacacatcacatttaagtatacactgctgaaccctacaggcagaaattcatttctttcacaaatatttacagaattcctaccacgtgcatggcactagaatgaatgctagggatagaagcccaaactccatttccgtaaggactagaatctcattcctgccctccaagagcttacaatgtaacactgtgctaagaggctctgaacctacatatgtaacttttaattataccatgctgacttaatagcatggcaggtgatcaccctagatgttaatacaaactttacattcctgttgacacactaaaagatctatcatctaaaaaccaaaacaggccagaattaaaatctggctacagactaaaacttcaggaatgaagttctgtctaaaccattttcagacttccagcatttttttactactcactttttttctcagttattttagccaagagcaaatgagcgttaggcataaccttaagagctagagaagagcatgtttgtaattataaaaggctcattatgctcctctgcatccccagatccccattcaaagaaagggctgtacaactaactccggacaacagatataattggcttgcctttcttcattaatattaaatttgtgggagacagtcttggcgttttcactgcagtgaactcgtgaagttgaacaatctccaaagagatgaaactttaaaaagcctattcgaagttaaagtcaaatcacaccaggcaatttaactttgcctcggattttccacaaccttacaaaaattacaaagttcttctaagttcctccatcaaaaggccaaattcctggttttttctttcaacaaaatggatgcgtcacaatcttatttacatcttgccgttttaaccaagacctccttgaatcccaagcctaggtctacacttccaggcccctgagaagacctaagaacgatcaagaagggatgcgcgggtaagcgttgtcatcacaacattaaagatttcgaaactcccagaccaccagaaagcgtagagtatggggaagaaaaccaaacccagcaactctaagaggcaaactagaccgggaggaaacaatcggcccccaggacaaaaagcacattcacacctctccgtgcaacccactcatccctttatactcgcagcgctgcagccaaagcacaaagttctttcttttcacccagagtctgtgcctgtcgcggttaaacatgaacggaggaaaattcctagtcagaacccagaggggtaggacggggcttggagtgtggggacaacgccaagcagggagctgtccaggggcactgcccgcccggggtctccagctgtgaagttgcgctcctcgggagattcctggggtcagaacgagaggctggagtcggagcgaggcacaagggatgcgggagaagaaaggagtggggccgaagaggtagccaaagagaatggggctccgaggcgagagagaaaggactggaaggggcaaagggcggccaaggagggcgaaaaggggaagctgccgctgggcgggagacggcggaggagcgagacggggcgggggaccgcgggaggacgggaaggcgggaaggggagagagcgtggagctcggagctccagcaggcacaggccgcggcagataagggggcgcggagaggcccaggcccggcccaggcaggaggcgtcgggagacgacgcgacccaaggcgggcgggcccggggaaaaccgcccgcggccagaccggcagtggaagctgagacgcagtgctgcggcccctccccgtcacgtcagggcacttacctcctcgcagctgggacgctccggtgatgcggggcagtcagttcagagcgtctctcccaaatctcggcacccgactgacccggatccaaaccagccaagggggcggcccgcgcctcgggagtcgcgttgcgcctgcgcactccggcatgcacccctccccctgcttatgctcctcccaccccagtgactcggcagcgcggcagccgacgactgcgcagacgcagggcggcggccgcgcctctccaacgccccgcacccgcccccctcagaagcacgtgcgccttacgtaatttcctgttattcttcggtttgcctcctcccagtggcgtggatttgctcccgacccgcttttggggcgtgcctgcttcctcctctctgttaggtgagtgagtaggcgtcattcttcacagtagtcctctgcctccaccgccccgggatctccttgcgctcggtcctctacgtggagtcacctatgcagaggaattccacggggcgggggcgaggacagggtgcgggggtctttatggcagacaatccccggctgagcgcttggccagagtttctgtgatgctagaatctggactgcctgcgacctctccgggactcggacaccagccctcgcctcctggtgatcttttaggtcctgcagagaagtgaagagatctcgctctgtcacccaggctggagtgaaatggcacaatcttggctcactgtaacctccgcccccaggttcgactgattctcgtgcctcagcctcctcagtagctgggattacaggatggagagtaaaggaggtaaaggaggactctgatgcctcagccatgcgcctgtgtgccgattcccattaagcctgcaccaatttgatttccaagactccagtcaatcctcagagctccaggaggggaggggcagcttttcctggtagctgctgatcaccagcagagggagccctaggactgcagggcctctttccttaccgttggtgaagcccttcactgtggcttcaaaactgtggaagacccgggatttgtggatcacttgcctttagaatagaatcaagaaataaagctgcagaagaaagaatctccatgtgatgagccccagagaggcgaagccacttgagctcgtgagtgacagtcagatgtcaagccctgctctttctaaagcgtgctgccttcagaaaagaagagccagaaggatggaaattacttcagaaagatgaataccagctttgaaggaataaaagctgacgaggaattgaaggagttgaggcacgagcttgaacagggttgcatgtttggcccttgattgtaaatgcccattgctgcacctgttcctgttacttggggagttgcagcagaaggaacagcggcctgggactccagagaactgggttccctctcatccctccagggccaccacttcttgtgggcccttgggcaagtcactgtactttctgagtctcagtttccccatttgcagaatggaaataactaccccggtctaccaacttagaagaattgctttgaggatctgataaggtggtgtggatgatgctgccttgggggctttacagtatggagctcaagggaccccttaagttgggcttacttagtaactccaggggtgggcagaacaggactccaatgagggtttttttctttttcccttttttttcttttcctatctcttaacttttatctttattattttacaatgcccttgtaagatgaaacaagtgatgctgaaatatctttttcttttttaacctttattttagaattggggtacatgtgcaggtttgttacataggtacagtgtgggctgctgaggtttgggagtacgaatgaattagtcaccccagtggtgagcatagtgcccgataagtggttttttcaacccttactcccatccctctccattcttgtgttccccagtgtctgctgttcccatttttatgaccatgtgtactcaatgtttagctcccacttagaagtaagaacatgcccagcactttgggaggccgaggtgggtggatcatgaggtcaagagatcgagaccatcttggctaacaaagtgaaaccctgtctctactaaaaacataaaaaattggccgggtgtggtggtgggcacctgtagtcctagctactcgggaggctgagacaggagaatcgcctgaaccggggaggtggaggttgcagtgagctgagattgtaccactgcactccagcctgggtgacagagtgagactccatctcaaaaaaataaaaataaaaaaataaaaagaatgtggtgtatgattttgttttctgtttctatgttaatccacttaggataatggcctccagctacatccacgttgttacaaaagacacgatttcattctcttatatggctgcctaatattccacggtgtatatgtaccatattttctttatcacatccactgttgatccacacctgggttgattccatgtctgtgctattgtgaatagcactgcagtgaacatgtgggtgcgtgtgtctttgtggtagaacgatttcttttcctttgagtataatatatccattaatgggatggggctgacatacttaaagtagaaacgaaaattgtcatgtgctcccccacgcccctccattctactctgcagagagacagctgcctgctgtttgtggtttagtacacctccttccaggctttaaataaacta

SEQ ID NO: 648 - DNA, 4342 bp, Homo sapiens
acttacaatgttcctcaattaccttatgatccgttagtcaatgttcagctcttaccgagttcataaatcatctgagccaatctccccaacccgcagaccgccccccaagtcctctttagccctctctggaaatcagtcagcatttacgtacacatcacatttaagtatacactgctgaaccctacaggcagaaattcatttctttcacaaatatttacagaattcctaccacgtgcatggcactagaatgaatgctagggatagaagcccaaactccatttccgtaaggactagaatctcattcctgccctccaagagcttacaatgtaacactgtgctaagaggctctgaacctacatatgtaacttttaattataccatgctgacttaatagcatggcaggtgatcaccctagatgttaatacaaactttacattcctgttgacacactaaaagatctatcatctaaaaaccaaaacaggccagaattaaaatctggctacagactaaaacttcaggaatgaagttctgtctaaaccattttcagacttccagcatttttttactactcactttttttctcagttattttagccaagagcaaatgagcgttaggcataaccttaagagctagagaagagcatgtttgtaattataaaaggctcattatgctcctctgcatccccagatccccattcaaagaaagggctgtacaactaactccggacaacagatataattggcttgcctttcttcattaatattaaatttgtgggagacagtcttggcgttttcactgcagtgaactcgtgaagttgaacaatctccaaagagatgaaactttaaaaagcctattcgaagttaaagtcaaatcacaccaggcaatttaactttgcctcggattttccacaaccttacaaaaattacaaagttcttctaagttcctccatcaaaaggccaaattcctggttttttctttcaacaaaatggatgcgtcacaatcttatttacatcttgccgttttaaccaagacctccttgaatcccaagcctaggtctacacttccaggcccctgagaagacctaagaacgatcaagaagggatgcgcgggtaagcgttgtcatcacaacattaaagatttcgaaactcccagaccaccagaaagcgtagagtatggggaagaaaaccaaacccagcaactctaagaggcaaactagaccgggaggaaacaatcggcccccaggacaaaaagcacattcacacctctccgtgcaacccactcatccctttatactcgcagcgctgcagccaaagcacaaagttctttcttttcacccagagtctgtgcctgtcgcggttaaacatgaacggaggaaaattcctagtcagaacccagaggggtaggacggggcttggagtgtggggacaacgccaagcagggagctgtccaggggcactgcccgcccggggtctccagctgtgaagttgcgctcctcgggagattcctggggtcagaacgagaggctggagtcggagcgaggcacaagggatgcgggagaagaaaggagtggggccgaagaggtagccaaagagaatggggctccgaggcgagagagaaaggactggaaggggcaaagggcggccaaggagggcgaaaaggggaagctgccgctgggcgggagacggcggaggagcgagacggggcgggggaccgcgggaggacgggaaggcgggaaggggagagagcgtggagctcggagctccagcaggcacaggccgcggcagataagggggcgcggagaggcccaggcccggcccaggcaggaggcgtcgggagacgacgcgacccaaggcgggcgggcccggggaaaaccgcccgcggccagaccggcagtggaagctgagacgcagtgctgcggcccctccccgtcacgtcagggcacttacctcctcgcagctgggacgctccggtgatgcggggcagtcagttcagagcgtctctcccaaatctcggcacccgactgacccggatccaaaccagccaagggggcggcccgcgcctcgggagtcgcgttgcgcctgcgcactccggcatgcacccctccccctgcttatgctcctcccaccccagtgactcggcagcgcggcagccgacgactgcgcagacgcagggcggcggccgcgcctctccaacgccccgcacccgcccccctcagaagcacgtgcgccttacgtaatttcctgttattcttcggtttgcctcctcccagtggcgtggatttgctcccgacccgcttttggggcgtgcctgcttcctcctctctgttaggtgagtgagtaggcgtcattcttcacagtagtcctctgcctccaccgccccgggatctccttgcgctcggtcctctacgtggagtcacctatgcagaggaattccacggggcgggggcgaggacagggtgcgggggtctttatggcagacaatccccggctgagcgcttggccagagtttctgtgatgctagaatctggactgcctgcgacctctccgggactcggacaccagccctcgcctcctggtgatcttttaggtcctgcagagaagtgaagagatctcgctctgtcacccaggctggagtgaaatggcacaatcttggctcactgtaacctccgcccccaggttcgactgattctcgtgcctcagcctcctcagtagctgggattacagatgagccccagagaggcgaagccacttgagctcgtgagtgacagtcagatgtcaagccctgctctttctaaagcgtgctgccttcagaaaagaagagccagaaggatggaaattacttcagaaagatgaataccagctttgaaggaataaaagctgacgaggaattgaaggagttgaggcacgagcttgaacagggttgcatgtttggcccttgattgtaaatgcccattgctgcacctgttcctgttacttggggagttgcagcagaaggaacagcggcctgggactccagagaactgggttccctctcatccctccagggccaccacttcttgtgggcccttgggcaagtcactgtactttctgagtctcagtttccccatttgcagaatggaaataactaccccggtctaccaacttagaagaattgctttgaggatctgataaggtggtgtggatgatgctgccttgggggctttacagtatggagctcaagggaccccttaagttgggcttacttagtaactccaggggtgggcagaacaggactccaatgagggtttttttctttttcccttttttttcttttcctatctcttaacttttatctttattattttacaatgcccttgtaagatgaaacaagtgatgctgaaatatctttttcttttttaacctttattttagaattggggtacatgtgcaggtttgttacataggtacagtgtgggctgctgaggtttgggagtacgaatgaattagtcaccccagtggtgagcatagtgcccgataagtggttttttcaacccttactcccatccctctccattcttgtgttccccagtgtctgctgttcccatttttatgaccatgtgtactcaatgtttagctcccacttagaagtaagaacatgcccagcactttgggaggccgaggtgggtggatcatgaggtcaagagatcgagaccatcttggctaacaaagtgaaaccctgtctctactaaaaacataaaaaattggccgggtgtggtggtgggcacctgtagtcctagctactcgggaggctgagacaggagaatcgcctgaaccggggaggtggaggttgcagtgagctgagattgtaccactgcactccagcctgggtgacagagtgagactccatctcaaaaaaataaaaataaaaaaataaaaagaatgtggtgtatgattttgttttctgtttctatgttaatccacttaggataatggcctccagctacatccacgttgttacaaaagacacgatttcattctcttatatggctgcctaatattccacggtgtatatgtaccatattttctttatcacatccactgttgatccacacctgggttgattccatgtctgtgctattgtgaatagcactgcagtgaacatgtgggtgcgtgtgtctttgtggtagaacgatttcttttcctttgagtataatatatccattaatgggatggggctgacatacttaaagtagaaacgaaaattgtcatgtgctcccccacgcccctccattctactctgcagagagacagctgcctgctgtttgtggtttagtacacctccttccaggctttaaataaacta

SEQ ID NO: 649 - DNA, 1893 bp, Homo sapiens
agcgtccaaacctgcagagcagtggctcccagctgtggcaactttgccccccagaggacatttggcaatgtctggatatgtttgcaattgtcacaactaggagagggggatgctattggcatctggcgagtgaggccaaggatgctgctaaacctcccatgatgcacaggagaagtccccacacagacacatcctgcgcagactgtccataaagcttaaatgagatgctctgacttagagccacagtgaacattccattccatcgtctgggtatctccagggatgtacgtagctggatgtctagcttttcatctgggtatgaccggcctcacgcagaatcaaaaccatgtgtgaacccaccagcaatcctggggacgctgaggaccctccctcctcagcacatggccctcctgactgttgggggagccagcatgaagcccccgtcgccgaccggcaggcccgagctcctggactcagcattgaccgacactgactctgttcccacagcagccgctttgttcgtctcctttgtggacacttagctcagcgcctgtgctgctcggctgtgacctgaccttcgagggtcacctcctgaattcactcgctgtgacctgtgctgcggaccccgtcaggaagctcctggtctcccccggcccctcccccgcctcatttgcacaaaaggcctcattgttctgcagggtctgactcagacctgccctggtttcagtttccgcaaacacccagcactggctttgggtcaggggtcactctggagtgaacggggcgccctgagcaaccccacatcgctgtgtgatcccggctcatccacaggaagccccggcccagggacccaaatgggtcccagaagtggaccagatgcagcgccgacggtgatgtggggacgccggcatctccaacagtgggaaagaggaaactttctacttttcattaaccccgtcctcttctcccccagggttacggggacacagtgtcttcactggccatgttggaacgttctggggagtgaagggaacgtccccaagagcattgacttgaccttcgctttggctgagatttgaaattctcttcttatcaatctctatatctgtacacgcaggagtctgttttacatccagccatccctgtgacctcgggcgagttccttaccttgtgttttctcatctgtaaagtgggtataatgaccaccgcacggcctcgcatgcttgtcagaaccaaatcagacaatgcacgaagacccgttggcccggaaagctgcagctgggccctgacgatgccacgctgtccatctggggaggggaagttcattgctaattcgactcaaaggaggaaaaatgcacgtccccctgagctgaaagaaggaacgaagccaagtccatcaggccaccgggtctccttaggctgaggaaatggacaatgagggcgacatcgaaactgcagagagcagcaaagcccttcactactgctgcccgaaccctgcagcggctcctacagccaccacgggtcactgggccaggagcaagttggggaacagccacatcaccatccagggaagcccccggaatggtggatttgctaacagcagccacacagacacctcacctcacgccaggctgctgagctcagcggggggcacgattgcccaagcaggggtggggcagggcaaggcagaccgagtcacacggtgggaaaagccaaaaaaaaaacctgcctgatttggtaaaatgccagaaaactgcgtgaactgggcatttgaaatttcaggtcccggccccaacggtgaaggaagcgggcaaagcgccctccctctgaggtgacgtctccagggctggtcacagggactccagggccatgagcacatggttgaccactctg

SEQ ID NO: 650 - DNA, 2921 bp, Homo sapiens
ccggcgtgtagagggaagggggcggggctagacgcggcctggacaactactagagcgcctcgggctgtgctgctcgagactacatttcccagagcgacgcgcgcggagcgggcgggaaagagagcgtttcgggtccagtgcgcaggtgcgaaagccatctttggttatataagggaggttcaggaagccattcgttctttcgcgtctgcggtgcccggagtgtggtacttctcctagttgcagtcaggcttcatacgctattgtcctgcccgtaagttcccgttttgtgtgtggttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatgctgttttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacagaggtatctcacttgtatgcttacacctgcacaagatcgtgtatgttaaatcgtgggtattaggccttaatggttgcatgagatgagtaaggatgatgtgggctatggtatttgtttataaacttcataggaaattgcaaaaataggctgcatcatttatcaatatgtgatgattttttatttaaaatacacagtgaataattttttaagtatcttaaaatctcacctcaaagatgggacctctagatttcttttttttttctgaggcagagtctcgctgtgtcacccaggctggagtgcagtggcatgatctcagctcactgcgagctctgcttcctgggttcacattctcctgcctcagcctcccaagtagctgggactacaggtgcccgtcaccacgcccggctaattttttgtatttttagtagagacgggttttcgctgttttagccaggatggtcttgatctcctgaccttgtgatctgcccacttcggcctcccaaagtgctgggataacaggcatgagccactgcgcccagcctgggacctctagatttctaaaatgactcctggtattgactcagaatcccctccccttgactaggctggacctagtgtaacttctgagacttgctagctctttttctcattctccttggcttgctcactttttttttttttttttgagatctcagctcactgcaacctccgtcccctgggtttaagcaaattctcctgcctcaccctcccgagtagcttggattaccacgcctggctaatttttgtatatttagtagagggggttcaccatgttggccaggctggtcttgaactcctgacctcaagtgatctgcctgcgtcaagcctcccaaagtgttggaattacaggcgtgagccaccacgcctggcctagcttgctcacttttaattaagctgccatgttgggagaggccagcgtagcaatcaactgaggttgaaccattagtgtgggaggagttacccaacaaccatgtgagtttgtaagcacgtctttctgtagcggaggcttgtgagaaaccctgagagcggacccacccagattgtgcttggatttctgacctatgggaaatgtatttcaagccactaggttttgagataacttgctacaaagcagtaaattcacaactctataatgcccactctaaaggtcctgacatgggcatctccattacctaagtcaactgatgctacttcaatttctccacgtagcatttgaagcgtttatgtctggccccagcctacattttcagacttatttgtgcatttgacttaacatgtccaaaactaaatgcctgatgcttcactcacctaaccccattccctgcaagtctgtgcttcctgcgatcttcccttcccaggtattggcaacaccagaagtccagttggtcaggagctgtggaatcaacctcatgtaccatgtgaatcccttggcaaatgctattggttctaccttcaaaatacatctgaaacccaccccctcttagcgtcttcattgctaccaccttggtacaaaccatcaaacaagcttggaatactggtctctacttcagcctttgctccctacgatcaattgagatgcaaccagagcgatctgtgaaaacctgaattaggtatggagctctctgctcagaagcctccagtgtcttccccacctcacacagtaaaagccaaagtccatcagggcctacatgatcttccccttcccttaacctctaacttcatctcttccctttcaatcttagccacatgggccccctgacttctccattcctttaggattactccaacctcagtatcttagcacttgattttcccactgcctggaatgatcagccctagacccccagagctttgcacagccctctgccttgtgtcattcag

SEQ ID NO: 651 - DNA, 2921 bp, Homo sapiens; identical to SEQ ID NO: 650

SEQ ID NO: 652 - DNA, 3006 bp, Homo sapiens
cggcgggctcaggcgggcgcggctgaggggagcggaccgcggggggcgggagatgactgcgcccaaggcctttgcgggcctcagccggccccagaggaaggggaacccgtcgagcggtttggtgcgtgtgaagcgcgacatggcgaggaagcggacaagcccgggtggcccggcgtgtagagggaagggggcggggctagacgcggcctggacaactactagagcgcctcgggctgtgctgctcgagactacatttcccagagcgacgcgcgcggagcgggcgggaaagagagcgtttcgggtccagtgcgcaggtgcgaaagccatctttggttatataagggaggttcaggaagccattcgttctttcgcgtctgcggtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatgctgttttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacagaggtatctcacttgtatgcttacacctgcacaagatcgtgtatgttaaatcgtgggtattaggccttaatggttgcatgagatgagtaaggatgatgtgggctatggtatttgtttataaacttcataggaaattgcaaaaataggctgcatcatttatcaatatgtgatgattttttatttaaaatacacagtgaataattttttaagtatcttaaaatctcacctcaaagatgggacctctagatttcttttttttttctgaggcagagtctcgctgtgtcacccaggctggagtgcagtggcatgatctcagctcactgcgagctctgcttcctgggttcacattctcctgcctcagcctcccaagtagctgggactacaggtgcccgtcaccacgcccggctaattttttgtatttttagtagagacgggttttcgctgttttagccaggatggtcttgatctcctgaccttgtgatctgcccacttcggcctcccaaagtgctgggataacaggcatgagccactgcgcccagcctgggacctctagatttctaaaatgactcctggtattgactcagaatcccctccccttgactaggctggacctagtgtaacttctgagacttgctagctctttttctcattctccttggcttgctcactttttttttttttttttgagatctcagctcactgcaacctccgtcccctgggtttaagcaaattctcctgcctcaccctcccgagtagcttggattaccacgcctggctaatttttgtatatttagtagagggggttcaccatgttggccaggctggtcttgaactcctgacctcaagtgatctgcctgcgtcaagcctcccaaagtgttggaattacaggcgtgagccaccacgcctggcctagcttgctcacttttaattaagctgccatgttgggagaggccagcgtagcaatcaactgaggttgaaccattagtgtgggaggagttacccaacaaccatgtgagtttgtaagcacgtctttctgtagcggaggcttgtgagaaaccctgagagcggacccacccagattgtgcttggatttctgacctatgggaaatgtatttcaagccactaggttttgagataacttgctacaaagcagtaaattcacaactctataatgcccactctaaaggtcctgacatgggcatctccattacctaagtcaactgatgctacttcaatttctccacgtagcatttgaagcgtttatgtctggccccagcctacattttcagacttatttgtgcatttgacttaacatgtccaaaactaaatgcctgatgcttcactcacctaaccccattccctgcaagtctgtgcttcctgcgatcttcccttcccaggtattggcaacaccagaagtccagttggtcaggagctgtggaatcaacctcatgtaccatgtgaatcccttggcaaatgctattggttctaccttcaaaatacatctgaaacccaccccctcttagcgtcttcattgctaccaccttggtacaaaccatcaaacaagcttggaatactggtctctacttcagcctttgctccctacgatcaattgagatgcaaccagagcgatctgtgaaaacctgaattaggtatggagctctctgctcagaagcctccagtgtcttccccacctcacacagtaaaagccaaagtccatcagggcctacatgatcttccccttcccttaacctctaacttcatctcttccctttcaatcttagccacatgggccccctgacttctccattcctttaggattactccaacctcagtatcttagcacttgattttcccactgcctggaatgatcagccctagacccccagagctttgcacagccctctgccttgtgtcattcag

SEQ ID NO: 653 - DNA, 3006 bp, Homo sapiens; identical to SEQ ID NO: 652

SEQ ID NO: 654 - DNA, 4202 bp, Homo sapiens
cggcgggctcaggcgggcgcggctgaggggagcggaccgcggggggcgggagatgactgcgcccaaggcctttgcgggcctcagccggccccagaggaaggggaacccgtcgagcggtttggtgcgtgtgaagcgcgacatggcgaggaagcggacaagcccgggtggcccggcgtgtagagggaagggggcggggctagacgcggcctggacaactactagagcgcctcgggctgtgctgctcgagactacatttcccagagcgacgcgcgcggagcgggcgggaaagagagcgtttcgggtccagtgcgcaggtgcgaaagccatctttggttatataagggaggttcaggaagccattcgttctttcgcgtctgcggtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatgctgttttgtttggccattggagataaccattgaacagggataacaagtagtagttaggtattggcaacaccagaagtccagttggtcaggagctgtggaatcaacctcatgtaccatgtgaatcccttggcaaatgctattggttctaccttcaaaatacatctgaaacccaccccctcttagcgtcttcattgctaccaccttggtacaaaccatcaaacaagcttggaatactggtctctacttcagcctttgctccctacgatcaattgagatgcaaccagagcgatctgtgaaaacctgaattagattttgcctgcctgagctcctctagtagtggccacaattgccagagaagatagagcaggtctctcccaggacttgcagctccagcctgtgtctgcaaggggtgttgtagcgactgatttctccagcccatggcaagaggccttcatcttgtgcctggaaagagggaagtacaagtccgtctggcagagatggtgcagatgggcaagtttttcagacactgcagccagcacttctgggaccgcagcagtggagcctgcagagggccggttctccaggcatgggctactgacattgtcacttccagactccttatgcaataaacaacccctaaacagatttattcacaatttctccatcctaacaagtcagtgatcagttttcacttttccacattcccttctgtccccattatgttcccatagtggggcagcttctacctgcatggttggagcttcccatttttaaagaggcaagaaatcctttaaagttctttgaaatgtttgtagcctgttccaattttataaactgtgaagactgagcaacacacaatgcatgggcctcatatggcctggaggccaccagttggagacctctgtagcttgagctgtgtccctttcagcactgttcttgtcattcctgagctgggatgccccctgaaacataggatgctcagttaaatttgaatttctttttttttttccttgaaatggagtgtcgctctgtcgccaggctggagtgctgtggcgtgatctcagctcactgcaacctccacctccctagttcaagtgattctcctgcctcagcctcccgagtagctgggattacaggcatgcaccaccacacccagctaatttttgtatttttagtagagacagagtttcaccatgttggccaggatggtcttgatctcctaacctcatgatctgcccgcctcggcctcccaaagtgctgtgattacaggtgtgaaccactgcgcccggccgatggcaatcattctttaagatgcagcctccgtggacctcgtaccttctcagtaatttccatattctttgctgacttgggtttttcctccaaaattgtctgggataaattgaggtttgtggagtttcctgatggctagtttccaaactggcttcaaagcctgggcttgtggaattggctgggtctgcggccagcctaacccatccttcggtcacagtctcccatggtcctgatattaattcatcacaggtctgtttagaaggtggcagaaacagacggtcttgggcttatttatatctgtggctttttttaaaagacagaaaaggagaaatctggatcctttccttgtcagcctcctttaactaaatggtcttttgctaaaatagactggccccactgtgtgggtaggaagggttgagatgggagtgggccaagtgagtgagaactttttttttttgccttgatgttaaaatggcagcatgtgcagtcttctgcctctgcccaggttgacctgatgtttttacagggagagaggctgcttgttgagtgtggtggtatttatcatagtgtatgttaggctgcctcaaacatccctcgctgtcgtacctttcagccaactctaatgtacctctctcagcctgatttctccccacttgagttataataacaacaactgccttttaaaaaatttcctactgggcttcatgctaggtactttccacgttttatttttatttatttattttttgagacagagtctcactctgtcacccacgctggagtgcagtggtgtgatcgcagctcactgcagcctcaaactcctgggctcaagcgagcctcctgcctcagcctcccgaatagctgggactacaggtttgtgctactgtgcccggctaatttttctatttttttgtagagacagtgtctccctttgtttcccaggctgatctctcctgggctcaagcgatcctcctgcctcaacctcccaaagtattgggattactggtgtgagccaccattatatgttttaaataatttattcctcacctcaagtgagtgaggtaacatcccagttttacagacaaggaaacagattgggcaggggaagtgacttgcctcagatgcacaataaatggctctgccagtgtcttccttagcgcctccgatccccttctcacccttgtcctctctgctcctctctgctcaatgctcctgggagcgtgaactgcattaatggctccttgtctggtggcctcaaggttccccaggaggcagggagggtgaggctgagatgtgtgctcccctaaggcacatgcctcagcctggctgcctctgtctaaggccacagcccctcaagtgcttccccacctgactttctgggctctggtaaccgcttcctgcctgccccatcaggtgtagggggtgcttcatgggtcaacattagcttatgtggtttccttatatcctgggcgcacctttgttagtctcaaattacattctgcttgaactattctctatccagtgggttgtgactatctagaggcagagttgggatttgaaccccaagacttcaaaataagctctgtgcaaatggcctcccagagctgcctgctggtttcttctgcgaggcctggcttctccattttggcttggaccatggcctgctgtcatttccacaacagttgcaggaagttgccaaatgcgttttctgtgactgccaggctggtgaccctgttaaaaacaaagcaacaacaaaaaaagcaatttcttcaattaaaattacaaaacagaaaaaaaaaaagatgtcacacttgggggaagctggttgaagtgtacttgatattctacatactattttcgcagttctctgtgaatcaatagttatttccaaataaaatgttaaaaaaaactttattactaaatcagaaaaaaacaacaacaaacaacaacaaaaaccaaagcagaatatgtggtgcactgttgagggaagtacagaaggat

SEQ ID NO: 655 - DNA, 4202 bp, Homo sapiens; identical to SEQ ID NO: 654

SEQ ID NO: 656 - DNA, 4202 bp, Homo sapiens; identical to SEQ ID NO: 654

SEQ ID NO: 657 - DNA, 4202 bp, Homo sapiens; identical to SEQ ID NO: 654

SEQ ID NO: 658 - DNA, 5507 bp, Homo sapiens
ggggcccagggtggagagcacgagggcctggcccaggcacggccggcgcctccgccctcgaggagggcgtcacctcagctccccccggcggcggagccggcgggctcaggcgggcgcggctgaggggagcggaccgcggggggcgggagatgactgcgcccaaggcctttgcgggcctcagccggccccagaggaaggggaacccgtcgagcggtttgggaggttcaggaagccattcgttctttcgcgtctgcggtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgaaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatgctgttttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacagaggtatctcacttgtatgcttacacctgcacaagatcgtgtatgttaaatcgtgggtattaggccttaatggttgcatgagatgagtaaggatgatgtgggctatggtatttgtttataaacttcataggaaattgcaaaaataggctgcatcatttatcaatatgtgatgattttttatttaaaatacacagtgaataattttttaagtatcttaaaatctcacctcaaagatgggacctctagatttcttttttttttctgaggcagagtctcgctgtgtcacccaggctggagtgcagtggcatgatctcagctcactgcgagctctgcttcctgggttcacattctcctgcctcagcctcccaagtagctgggactacaggtgcccgtcaccacgcccggctaattttttgtatttttagtagagacgggttttcgctgttttagccaggatggtcttgatctcctgaccttgtgatctgcccacttcggcctcccaaagtgctgggataacaggcatgagccactgcgcccagcctgggacctctagatttctaaaatgactcctggtattgactcagaatcccctccccttgactaggctggacctagtgtaacttctgagacttgctagctctttttctcattctccttggcttgctcactttttttttttttttttgagatctcagctcactgcaacctccgtcccctgggtttaagcaaattctcctgcctcaccctcccgagtagcttggattaccacgcctggctaatttttgtatatttagtagagggggttcaccatgttggccaggctggtcttgaactcctgacctcaagtgatctgcctgcgtcaagcctcccaaagtgttggaattacaggcgtgagccaccacgcctggcctagcttgctcacttttaattaagctgccatgttgggagaggccagcgtagcaatcaactgaggttgaaccattagtgtgggaggagttacccaacaaccatgtgagtttgtaagcacgtctttctgtagcggaggcttgtgagaaaccctgagagcggacccacccagattgtgcttggatttctgacctatgggaaatgtatttcaagccactaggttttgagataacttgctacaaagcagtaaattcacaactctataatgcccactctaaaggtcctgacatgggcatctccattacctaagtcaactgatgctacttcaatttctccacgtagcatttgaagcgtttatgtctggccccagcctacattttcagacttatttgtgcatttgacttaacatgtccaaaactaaatgcctgatgcttcactcacctaaccccattccctgcaagtctgtgcttcctgcgatcttcccttcccaggtattggcaacaccagaagtccagttggtcaggagctgtggaatcaacctcatgtaccatgtgaatcccttggcaaatgctattggttctaccttcaaaatacatctgaaacccaccccctcttagcgtcttcattgctaccaccttggtacaaaccatcaaacaagcttggaatactggtctctacttcagcctttgctccctacgatcaattgagatgcaaccagagcgatctgtgaaaacctgaattagattttgcctgcctgagctcctctagtagtggccacaattgccagagaagatagagcaggtctctcccaggacttgcagctccagcctgtgtctgcaaggggtgttgtagcgactgatttctccagcccatggcaagaggccttcatcttgtgcctggaaagagggaagtacaagtccgtctggcagagatggtgcagatgggcaagtttttcagacactgcagccagcacttctgggaccgcagcagtggagcctgcagagggccggttctccaggcatgggctactgacattgtcacttccagactccttatgcaataaacaacccctaaacagatttattcacaatttctccatcctaacaagtcagtgatcagttttcacttttccacattcccttctgtccccattatgttcccatagtggggcagcttctacctgcatggttggagcttcccatttttaaagaggcaagaaatcctttaaagttctttgaaatgtttgtagcctgttccaattttataaactgtgaagactgagcaacacacaatgcatgggcctcatatggcctggaggccaccagttggagacctctgtagcttgagctgtgtccctttcagcactgttcttgtcattcctgagctgggatgccccctgaaacataggatgctcagttaaatttgaatttctttttttttttccttgaaatggagtgtcgctctgtcgccaggctggagtgctgtggcgtgatctcagctcactgcaacctccacctccctagttcaagtgattctcctgcctcagcctcccgagtagctgggattacaggcatgcaccaccacacccagctaatttttgtatttttagtagagacagagtttcaccatgttggccaggatggtcttgatctcctaacctcatgatctgcccgcctcggcctcccaaagtgctgtgattacaggtgtgaaccactgcgcccggccgatggcaatcattctttaagatgcagcctccgtggacctcgtaccttctcagtaatttccatattctttgctgacttgggtttttcctccaaaattgtctgggataaattgaggtttgtggagtttcctgatggctagtttccaaactggcttcaaagcctgggcttgtggaattggctgggtctgcggccagcctaacccatccttcggtcacagtctcccatggtcctgatattaattcatcacaggtctgtttagaaggtggcagaaacagacggtcttgggcttatttatatctgtggctttttttaaaagacagaaaaggagaaatctggatcctttccttgtcagcctcctttaactaaatggtcttttgctaaaatagactggccccactgtgtgggtaggaagggttgagatgggagtgggccaagtgagtgagaactttttttttttgccttgatgttaaaatggcagcatgtgcagtcttctgcctctgcccaggttgacctgatgtttttacagggagagaggctgcttgttgagtgtggtggtatttatcatagtgtatgttaggctgcctcaaacatccctcgctgtcgtacctttcagccaactctaatgtacctctctcagcctgatttctccccacttgagttataataacaacaactgccttttaaaaaatttcctactgggcttcatgctaggtactttccacgttttatttttatttatttattttttgagacagagtctcactctgtcacccacgctggagtgcagtggtgtgatcgcagctcactgcagcctcaaactcctgggctcaagcgagcctcctgcctcagcctcccgaatagctgggactacaggtttgtgctactgtgcccggctaatttttctatttttttgtagagacagtgtctccctttgtttcccaggctgatctctcctgggctcaagcgatcctcctgcctcaacctcccaaagtattgggattactggtgtgagccaccattatatgttttaaataatttattcctcacctcaagtgagtgaggtaacatcccagttttacagacaaggaaacagattgggcaggggaagtgacttgcctcagatgcacaataaatggctctgccagtgtcttccttagcgcctccgatccccttctcacccttgtcctctctgctcctctctgctcaatgctcctgggagcgtgaactgcattaatggctccttgtctggtggcctcaaggttccccaggaggcagggagggtgaggctgagatgtgtgctcccctaaggcacatgcctcagcctggctgcctctgtctaaggccacagcccctcaagtgcttccccacctgactttctgggctctggtaaccgcttcctgcctgccccatcaggtgtagggggtgcttcatgggtcaacattagcttatgtggtttccttatatcctgggcgcacctttgttagtctcaaattacattctgcttgaactattctctatccagtgggttgtgactatctagaggcagagttgggatttgaaccccaagacttcaaaataagctctgtgcaaatggcctcccagagctgcctgctggtttcttctgcgaggcctggcttctccattttggcttggaccatggcctgctgtcatttccacaacagttgcaggaagttgccaaatgcgttttctgtgactgccaggctggtgaccctgttaaaaacaaagcaacaacaaaaaaagcaatttcttcaattaaaattacaaaacagaaaaaaaaaaagatgtcacacttgggggaagctggttgaagtgtacttgatattctacatactattttcgcagttctctgtgaatcaatagttatttccaaataaaatgttaaaaaaaactttattactaaatcagaaaaaaacaacaacaaacaacaacaaaaaccaaagcagaatatgtggtgcactgttgagggaagtacagaaggat

SEQ ID NO: 659 - DNA, 5507 bp, Homo sapiens; identical to SEQ ID NO: 658

SEQ ID NO: 660 - DNA, 1833 bp, Homo sapiens
ctgagagctctgcccttatgaatggattagtatcattattgcaggagtggcttcatgatggagagagtggatttgtcatgaaagtgagttcggccattccttgctgtctcacgtgccacctcttgccatgggatgccctcgccatgggatgacagcaagaaggcccttgcttgagtgagcccctccatcttcggctctccggcctccaggactgttagaaatacatctctgttctttgtaaattacccaggctgtagtactctgttatagcaacacaaaacagactaagacactactatgtagatgaagaaacaggcccaagaggtgaggagtgttgtccaggtcttctggccagaggagcggcagagatgggatttcaaccctgggactgtgtggcttgtgaccactcctagcttcagccctgcccggtgctgaggggtttggggccagaacgatggccagatgtttgggcacactgggccctacccacctggaaagaggctggcctggggttgaatgagaaccagaagtgactcaggctaggacccctctgcaccctccctcaggccgtgggtaattacctgcccaggttaatagcgcccacttcccgccacctttcatcaaggctcctggagctgccaggcagtaattaaccctcacagcacccttctgaagtcagcactggaggcagacgtgtgatgaaacacgtttattacaggaagcaccagttagcccagatgcttctcatctttggagttgagctgcaggctggagacctggaaggccctcgcagcgcctgctcccatcctctcacctcacgaaagcgcaggaatgtgggtttggagccaatgaaaagtactggaatctggctctgctctgtgaccctggacaagtcactgcccctctctgggcttcagtttcctccttggtaacacagaatgattatacctaccccttgggtttgttgacctgaatctacccctcagtcattgcctttccttcttgctgcagccacactggccccttgacagttccttgaacacaacaagccctttcccacctcagggcctttgcatgtgcagtgccagatgcctggaatgtccttccttccaatctccccatggccggctcattctcatctttcttggctcaaatgttacctccccaacctagacagcaccgctgccacctcttcaccccgtcttactcttcttcaagcacttctggaggtatcttgctatttatcttgtttatatctttttcagctccatgagggcaggggattttgtctgtttcattcacaatgtgttcccagagctcagcacagtgtcaggcacacactaggtgagtaagaaacaattgcttcctctacctcttcccctgctagccccaagttcagctaactggctgtgtgaccctggggattgcttttcacctctctggtcccttattctcccttgtggacaaaggatggcctgggcatgagtttcttcaaggactcgggtagcagtgaaatccctgggaccctagcctcagtacctccccaggcaatggggtagagagcaagaaggcaggtgagcaaggaccagcctccgccacgcagacaccctctttccggcttctctgtcctcctactttgccctgggtttgtggacttactctgggcagatctccacgaccaaccaccccctcccttggcatgtctgtcagcacccttgggggaaagaatttggaaaggggagggagaaaaagaaagcagggtgcgaggggctggttcccacacctgtgtaaataatttgtcatcttaaaatgctcaagtatgctcacctttaa

SEQ ID NO: 661 - DNA, 1960 bp, Homo sapiens
gaaggagacatggaggccaggggtttctggtggaccccaccacagggcttctcatctgaggcaccgctgggatgttaagccggatggtgctttgaggtagaggctgccctgtgctaggccttcaggccatttttcagacaggatcgggacttggagaccagggcccagggatgccgcttgaggtgacagaactggaaaagatgaagggaagaaaggaatgtaacccacattgaataatgaagcctgacgctttaaccctacaatggccattgctggatgttgacgtaaacaataggtgtctacaggatgaattagccaaacgacaactccggtgtgagcagaacgggctcattgggtcaagacacaattccaccacagaacgggtttcacaaaggaccatgtcccatcaactcagcaatgaaaccatcgtggtctggaaacctgagatcaggacccacagaatgactggcggaatgacagaccaaatgtggaagatgttccaaccaggaatgaatcacttacttccaacgtttcctaaagaggcaatgggctcctgggccctttctcactcgggagggcctttcctctgccccatcattctgagggtttctggaaggaagcccatcctgacctctagctcccaaagtcacctggacttcctccatcacagaccttgccacagtgtgagaaactgcctcatccacacaccagcttctcacctccacccagaccctctgattgggactcccctgaagactgtgtccccagagcccagaaagagtccagcacagagcagctgagggggcaggtgctggtgaacagtgtcaatgagcccctgctactcaccaagcccttcacacacgggtccttcatttaatgtctttcttctcctagatagaaccttggctttgccaagaccggtatagttgctgctcaagaaatatgtgaggaaattgttgagatgaaccagcactcaggggaagggaggctttctgaggctggggccttagcaggtggagctcctgggataataataataagaaagatgcctggacgcggtgactcacacctggaatcccagcaatttgggaggctaaggcaggcagatcacttcaggccaggagttcaagaccagcctggtcaacatggtgaaacctggtctctactaaaaatacaaaaaattagctgggcctggtggtgtgagcctatagtcctagcttctcgggaggctgaggctggagggtcaatgattgaacctgggaggtggagcttgtagtgagccgagatcgcgccactgccactgcactccaggctgggcaacacagtgagactctgcctccaaaaagaaagacaacaataatcattagtctttactctgctccaggcaccaggctgagtcttctcagttcatctccccagcagattagttctattattgtttccatttcacagatgggaaaatcaaggcacagggaggggaggtggcttactccaggtcacacagttagtgagaggcagaggcaggatcaaagccaagcctgtttgactgaggagcccgccccgagaccttaaccacacaacccctccctagaaggaaggtgccactactggacacattttggagatggaaaccaaggctaagagagtcaggatggcctgcccatgtctggacacagaaactgaggttaagcaggagatgcccgaggcggggtccctgtctcctaggccagcaccctgaagaaggggtgggagacaaccccccaccccccaagctgtcccctgcttgttggagtttctggtcaataccctggcctctgttacccagcccagcacccaagacgctgcctcttccgcctgcctggagtctcgggtgccttcacaatcggattctctgtctctgcagctgctttccatttgagccctttgtgctgaaaataaaaaaaatgaaaagaaaacttgg

SEQ ID NO: 662 - DNA, 1960 bp, Homo sapiens; identical to SEQ ID NO: 661

SEQ ID NO: 663 - DNA, 1645 bp, Homo sapiens
tcaactcttatacctccagggtccaatgtatgctggacaaggcccttcactgaccacatcctgcaggctaactcctgtgctgggcccttgggctactgagagtgggagacaaagccctgtcattgatagtggctcacagtgagtcaggaggggaacgtacacaggcagggagttcagagcaggaaccatcacagggaatcatgggagtgtgggacaggggcccagacacagcctagaggggtccagaaggcttcctggaggaggagggaactctcaagagcacatttttcaagaccaggcagagggaggaggctgcgtagggtggaaatggtgctctaggcaggccacagctggagtaaagccatgaagatcagaaccagctgagttattcagagaaccaccgtggtttgggtattgccggagagcccagcacaaagaagagtggagggaggctggctgcggaggcaggtggggaccagaccatggccgcttgggagtttggaccagacactgctgtacaagccagcccacagggaggactgggcagacctaggcaacaagctgctctcctcctctctgggtgaccccagacaggactcctcacttgtgagattttaccaggcaaccaaaattggatgcttagagcaggaagaagagtctacagagggactcacgggcattttggctttgaatggccgaagcctagctccccaggctcaggcacaatggtgaatgtatttgctcatgcaactggggaatcaagggacactcatgttcaggaatggttggatccagaggctcaagccttcctttcaggcttctttctctccagctctctgctctctgatgagtctctctccacagggccccagccaccgaaggctcaaaaaaaaaaaaaaaaacaaaacaaaaccctgcatggggagttgtgagaatctgaagcctgatactgcacagaaaacctatgaagccactgggtctggcctggaatggaaggctgagtgaatgtgggaaaaaattttcaagtgggaaaaatgaaaccaataagatttttaaaaatacagtcggttatgtatgtgtgggttctgaggatcgaaaatatctgaaaaacaagatgactgcatctgtactaaacacgtgtggacttttttgtcattattccctaaatgatacagtataacaactatttacatagcattcacattgttttaggtattataagtaatctagagatgatttaaagtatacaggaggatgtgcataggttatatgcaaatactatatcatctcatatcagggacttgagtatccatggattttgtacccacagggagtcctggagccaatcccctggggatactgggggacgactgtatgtttaggcatctgttcaatattgtaggtgggatgttgcagatctatttgtacttttgaatcaaaacaaaaagcaggtttttttgttgttttttttttagcgtgcttattgactcacaaactagcagtgttcaggtaaggcctcatccagcagctcaaacaatgtggttcaggacccactgtccctccatctctcttcatggcttcccacagactcagctttttcaggctccacacggagactttccagccactaagagttctgccctgc

SEQ ID NO: 664 - DNA, 1000 bp, Homo sapiens
gtggcctctttcataaggaaagagcaataagtcttcaggagagaattaacatccaatggattcccagaaaacttttccctcgatgtaccagcaaacacctacaatgccctgaaaagccgcctctgcgaccccaatgcagatcacacgtcctgtcccagcccctgcagcctccacgcggcgggtgcactgccaggcacgggaaggcagcgctggcgagtagaactggcccatctcgcagataggaagctgagcctcagggacgtttcacgccttcgtcaaggtggtgagaggaggagcgggattgccgtgaaggtggtgagaggaggagcggggtttgctgcccgacttcagggatctgtcaccctcgtccagcagggttggttcttcccgaggctgggaggatgccaagcctggtggaggatgggggcggtggtgtggtgtggggagcttctgacttgcacatcctgagggaaccttctgcagctgatgtgtgaactggaccccaggccgtgcctccgaggaatccccaaggctatggcccctcaggtcctgctggggtgttggcccccacctctgcctcagaatgcaggggttctgcagggaagccgcagaccagcctgctgccttgggccctagggacactgcagccccagaaagtactgtgggggacaaaagagttgtttctcgggggagaaaacacctgtgaggaaatgcaggtgccacagagggaaatcctcctggggaggagggtacctgttccatcctcggccgacacgggactgcctggtgcctggtacccacagccgctacctgccgcacgcatctctccatggtttgctaattacttccattagttttaaacaaacttgacaagagacagaagggtccagagagaaattaaatctaactgtttaaacatgtagtcggagcctcccttgcctctgtccccctggcggtggttgctgcagaccccaaagccagtgctggaggtggcacagag

SEQ ID NO: 665 - DNA, 1284 bp, Homo sapiens
gagagggagtctcctttccttggaggagtcagggaaaactctgctccagcagcttctggtgggaggctggatattatccaggcctgcgcgcagtcatccggaggcctaaacccctccctgtggtgctgtgcttcaatggtcactctccttgtccactttcatgttcctcccatactcctggttcctctttgaagttcgtagtagatagcggtagcagaaatggtgacagtcttaaagtctttgatctttcttataagtgcatagaagaaaacactgacctatgctgccttctctctgtgtgctttggctacctaagaaggaagggccacctgtcctgtgatcatgtgacttgcttcaccttgtcaatcacttagaagattcaccctccttaccctgcccccttgtcttatatgcaataaatatcagtgtgtccagccgttcagggccactaccagtctatgcgtcttaatggtagtggtccccgggtccagctcttttctcttaatcgttttgtcttgtgtctttatttattacaatctctcatctctgcacaccaggagaacacccgccaagctccgtagggctggaccctatatttctgtaatatggaaatattaatagtggcaagcccacatagctgccacgaggacttcatacaataatgaaggtatgcgtttttggacatccttttattggagagctgaaagagaaggctaccatctttggacgcccttttactggagagctgaaagagaaggctactgagaagatatttttaaaggaatctcatcaaacaaccagggaggatcaaccaccagagaaaagaagagactgggagtcatcaccatgtccccaacagaattttcatctatccttctgaggacagctccaagtgattacctagaggactttgcttcataataagtcaaccttcattcctgtgcagccccacctctcaccttcccaaaatgtctgcctcccatcttctgggtccattcattctctcaaatgatttgctgcccctcaaaagaattttccacgttcctcatctctcccctcccctgggaaaaagcatatataagcttctataccaccctgggttattgggtaatcattctccagcaattctcccatcctgtgcacatcaaataaattctgtatgcgttttcttttattaatgtgctttttgtctgttgattttcagtgagtctttagagggcaaaggggaaattttctccctgcaagagtcttattatccgagtgtctctgcaagcagcacgtggg

SEQ ID NO: 666 - DNA, 1052 bp, Homo sapiens
gtctgagtcctgagaccttcccctggaacctcaataaatttacttgatctaaatgggtccaggtgctggggtgattacccttatcttgtctcctgctaaatcatggaggtttggggagttccttcagaaccccaataagcttctttgtgaagcctggggagtttcttcagactcccaataaaacttgtttaatcctaaatgggtcccgttaaggattccttcgttattttgttatgctttaaggctcaggaaaagcctaggcaaaactcttggtgggcttttgttacattccagtctttgtataagggcactggcttttaaaacttagccagtcagtcagtaccgaagcaggtgttatggaagactgcattagtgagacctggcctgccacaggaccaatacctggaaatagtggggtatttttgtgctcctcaggtatgcgtttttggacatccttttattggagagctgaaagagaaggctaccatctttggacgcccttttactggagagctgaaagagaaggctactgagaagatatttttaaaggaatctcatcaaacaaccagggaggatcaaccaccagagaaaagaagagactgggagtcatcaccatgtccccaacagaattttcatctatccttctgaggacagctccaagtgattacctagaggactttgcttcataataagtcaaccttcattcctgtgcagccccacctctcaccttcccaaaatgtctgcctcccatcttctgggtccattcattctctcaaatgatttgctgcccctcaaaagaattttccacgttcctcatctctcccctcccctgggaaaaagcatatataagcttctataccaccctgggttattgggtaatcattctccagcaattctcccatcctgtgcacatcaaataaattctgtatgcgttttcttttattaatgtgctttttgtctgttgattttcagtgagtctttagagggcaaaggggaaattttctccctgcaagagtcttattatccgagtgtctctgcaagcagcacgtggg

SEQ ID NO: 667 - DNA, 867 bp, Homo sapiens
ggaatttacatcttcccaagacaaataaaatacctctgacactcaactcagagtgcttgcccatgattatatcatggagagagtgtcgtttttaaatctggggagtaaggaatgcagagaaggaaatgaagaataagttaagagctttctgccattgttagactcaggaggggttctgaatttcagaaccaggctgctcattgatgatatcttgactctcccaggttctcaccaggatccaatggccctaaggagacaagtacatttgcttggaaaactggtcacctaattcccaaaaggacagagctaacattatatgtctcagcatccagtccatcctagatggatttcgattctatctagggaatctcatcaaacaaccagggaggatcaaccaccagagaaaagaagagactgggagtcatcaccatgtccccaacagaattttcatctatccttctgaggacagctccaagtgattacctagaggactttgcttcataataagtcaaccttcattcctgtgcagccccacctctcaccttcccaaaatgtctgcctcccatcttctgggtccattcattctctcaaatgatttgctgcccctcaaaagaattttccacgttcctcatctctcccctcccctgggaaaaagcatatataagcttctataccaccctgggttattgggtaatcattctccagcaattctcccatcctgtgcacatcaaataaattctgtatgcgttttcttttattaatgtgctttttgtctgttgattttcagtgagtctttagagggcaaaggggaaattttctccctgcaagagtcttattatccgagtgtctctgcaagcagcacgtggg

SEQ ID NO: 668 - DNA, 3951 bp, Homo sapiens
actcacgagtcccatttgagctgcattaggttggagatgctggagagaggctgaagtaggaatgtcagggagacagccagatgaatgagcccagaggtcacaccaagaagagatgtgggctagagacagaaattattttcaaaccttttaatagaaaattcgaaacctggccaggcatggtggctcgcgcctgtaatcccagctctttgggaggctgaggaaggtgaatcacctgaggtcaggagttcgagaccagcctggccaacatggcgaaaccccatctccaataaaaatacaaaaattagccaggcgtagtggcacacacctgtaattccagctactcgggaggctgagggaggaaaatcgcttgaacccgggaggcggaggtggcagtgaggcaagatcaagccactgcactccagcctgggccacagcaacagagcaaaaccctgtctcaaaaaaaaacaaaaaaacaaaaaaacaaacaaacaaaaaaaaaaacggaagaagaaagaaagaaaagaaaatttgaaacctacatgcaagtagaaaagtagaagactataataaaccaccacccatcacccaactggtaccaagagagatataaatgtgcgagtcatgggcctatagcccgtgtttaatgccagggtttggctgaaatcccccaaaggaacagtgccagggaaggagagaaaaggccttgggcatcacaattagctacatagaaacctgacagagcaggagggtcccaagcagagacagcctgacagggcgggaaaccggaggggtatcccggaaggccagggaagagttcatgagaaaggaaggaggtgaccatggtgttattggaacctaggcagtcaatttagaggacagaaaaggtttcaatggatttaggtttagaagccatggagctggggcgctgggggacagaatccagatttcagggtgctcgggcctgaaccggaaggaggggaggtgcagcgggtgatgggaggcacatctgtagggagggctggcactgagggggcagacttggggtcagggagggctgtcagggcactcggggactggtgggggcctccacttgaactgatagtctccagaagggtcagatgacagccacggtgggatcttgggtcttttggggaagctactttatttagacgcccgccagcagagagctgcaggaggacagggaatcaaaagacgccgggagtctccccctgagtttagggcccagacggtctgtaatccgggcgcggatggggctttctcctgttacagaatcgacggcagcagcagcctagttgcgtctcagcagccggccgtggcgtttgcatcttctctcccgaggccccgaaggctcttaagtcacttgcagggcgcccagggatgggatcaggggcggcatctcgcggggcctcccggttcccaagcgcgccccctccccgcggacccctcacctgacaccagcaggcagccacccagccagctcccaaggctccacgccatggacggacgctgggggttccgcggcttcctccaagcacacgacccccgcccgcgcccgggagagcttgtccgcggcggcttccgggaaccagcggagatgggcggggcggggtggggaggggccgggcgaccgggctcccaccccgctgcaggccccgcccaccagcccgggtccacccgcgaggcgcggggcacaggcttggcagatgcacacgaggaagaggaagggatcctcgcaagctttgaaaggcgccgtcaagtcaaataaataaatgccctacaacaccaacccaggactgagatctgcatgctggaatgacggtggtggtggtggctttcagtattccccaggttttgtccggagcaccggcacgccctctcttgaagtccgctctccgcacagtggttagacgggaagatccggagctgtccagtgtcttgggtaatgcacggcatcgcctgatgtctgacgctagaacaccacgtaaagtcaagcagagggaagtgaatgcgccctaggcccctgcaggccaccaagaagagctagagggagttggtgcaatcctagagatgccggcaggtgcaccaatctgtggcacacgtacgctctccaatggaagacaactcaagaccacaccaagtttgtattaaaaaagtactgttgtgttactttttaccaacctccaatcattatacaaaatgttaaaaaatacacaaacacacacacacactcacagccatagaggttatcgcaaaagatcaacccagaatctttcagaatatgacagatgcactgagaaggcagataaattgattcaatatacaaaaggcctctttcctatggaatttcattagattaaataaggtgttccctcctcacagcctcatccttatgagcaatcatataaataatctatttaaagtccttgaactataacttgtataatttttagttttccccctttgaaggggcctaagagaaaggtttgagaaaccagctcttgaggggggcaggggtgaggggtaagaggtcctgtgcctttcattcatcctgggagcttctcaggattgcagcatttccacctgagtgttcattcttgtacattttctcatctttctcctgggttcctaggatcttggagattacctagtccaatccttttacttcagaaacaaaaaacctgaggctcagaaaggctaagtcaaatgcctagggtcacacagggaaactgtgggagttggatccctgagtcccagtccttaaactggttgctacatgacattctagaacctctccccaccaactccctttttaaagacagggtctggttctgtcacccaggctgaagtgcagtgacatgatcttggctcactgcaacctccgcttcctgggctcaagccattctcccacctcagcctcccaagtagctgggacaacaggcacatgccactacgcccagttaatttttctaattttgttttgtagagacagatttgccatgttgcccaggctggtctcgaattactggcctcaagcgatacgcctgtttaggcatcccaaagtgctggggttaccggcaggagcaattgctccgggccagacttcccttcccccgcccacacccccccaacccggcctagatccacaggcactgtaatcacagctgacacactcgactcggaatcagcatagagagcactctgaaaattgtcaaatagggtccctgaaacttgtataccatacttctcctgaagatcttgaagcatctttgtgtttgctttttttttttttaacttaaaatatggcattcaggttttatccctctccccgacgccatgtttcctttctgtattagtcacacacgtgatcctaaagtctgtcttccccactttaactggggagggctggacaaggtggaattccaattgcaggagacaggatgtgacatgggtgaggtgcccaaggctcaccgactgaaacttcgatggctcttccctgtttccttgtgcagggccccccttctctccactgctcacctggctctcctcctcccttcctgcctgctttgcagctcttgctactattttccttttctttccctgctcccaccctggcccaatttatttcacagaaatatcacagggccagccaggcacagcggctcacccctgtaatcccagcactttacgaggctgaggagggcagatcacttgaggtcaggagtttgagaccagcctggccaacatggtaaaatcctgtctctactaaaaatacaaaaatttgctaggcatggtggcaggcgcctgtaatcccagctacttgcgagggaggctgaggcaggagaatcacttgaacctgggaggcggatgttgcagtgagccaagatcacaccattgcgctccagcttgggcgacagaacgagactctgtctc

SEQ ID NO: 669 - DNA, 2598 bp, Homo sapiens
agaaaacccatgcctgctccatgaacccagcttttcttcaccagccattggcagcatgaatccatggcatgcaaagctaaagggggtcaaagtcatctgccagtgttttctgaataccaaaccttgtgaagatgagcgttgggaaaggagtaggaaggtcccaatttggaattttgacatcctaaaagccttgggtgccgcagaatgagtaagctggagggtactgtgtaaagacctcggctactgcagcagagaaacagatcaaaaaagtcaagaccggcgagaggaaagtgattgaaaggccatcactgaaagagtgactcacccaggtgcagatgagacacagagctcatggttgcctcctgtgaagtgcaggaaggatggagcagacagacccaaaagcactggcctcccagatgaatcaggagggatgtgcaggctgggtgacgtctgccccggaaccaggaaagtgcggctgcttcctccacaccccgcccgccgcccaggacccagggcccttctgaaaagtggagcctccctacaccctacgcacacggcggctgttccccacgacacagcggggggcaaatgaccaccaggagccagggagtcccagggaaaggacgcagatggctcgtgtcctggaatttcatgggagccatttgaaatcatcagcaaatgacgcccgagtctataagggacctcagcgcaggggctggatgagacagggtgggcagccacaaaacagggtggtgaaggcccgaggccaggagggctgggttagcactcggccaccagagggaagcaagcaagctccctccctctctctctttctctctgtctatgtgtctttctctctccctctctgtctctctccatctctctctccacccacacctcctgaggattgttgggttttcccatggactagggttagacagccagcgagtctgaacggaaggcgccaggtgtggcagtggggaagtgaggtggggcctggaacacaagggcaagggcctctgggaggaccgcgcaggctcggcacactgagcggactgactgcagaccctcctcccacaccagggggaccacctctctgtgcaaagatgtcctcacttgatattctcaattctttgaggtcaaggttttattaacactccctgaaaagtgggagagcttagtgataagactgtatcatttttgcaagacacaaagcaagcacagctggatggcatgtgccagctccctcaccatgctgagcacttttactcacatctcacccctgcagacagatgccagtgtcctcactcacccactggggcagacattattagttgccaatgcaagacccatttcctcacgtcctaactaatagaaccccaactgtgtccaggcaggtgacgtgcccagctaaaaatactcaccttttcagactcccttgaagttagtagcggccacgtgatacttccaacaaataagacatacacagagatctgctggggcttctgtgaaaacttttacttccctgaaacgggtaccaccttccttctcccattctttcttcctccttgaagcacagaagcaatgcctggagctgcagcggccattttgtgattgtgaagcaatgacctgaggaatgaaggccaacatcaaggatggcaaaacagagagaggaaaagagcaattgtcccctgatggcatggctgggccactgccccaaccctgtgaggccatgtgactccttattacatgagcacaggctagtcggggtttgtgctatctgcaggtgaatgcttggagattgtacaaaagtttatactggaggctttggaattcaatagaagtagacctgggttaaagtcaggaggatattttggctgtcattggtattgttattgccgataaggacccacaaggccaccactaatggggcctccagaccagagccgtgttgggagttttcccttgtccctagagcctacgcttgtggccacattcctgatcatgaatgtgacatgatcatggagttctgtggggtttgctgatgagttgggcaccgtggaggcagaatctcggcttctctggaccccagctgttgtttatttgtttgatgtccttttgtttttactaaacattaggatgtcttccgggtctaaacttctctactcccagctcagggtggcacgatggccattagatggagttggaatgaggaggaagagatatcccactggaaaactttttctgactctgataacatgaccttgtatcattggggttgtggggaggacttccacatacatagaacactattttgatcagagaagtgttttatttttcttcctgttttacaagaatgcacactcagtataactggtatttgtatgaactcagtcaccctgaacccaaatattgacattccaggtgaattagtcctgcactcgggtctgttggctcacctcaggtgccagcatgtactcgggaaagagtgccaggcccaggtgaagagggcctggggctccctgaggacggctgcccaaagcccatgaccctgctcggcggggccccagataaattactggcgattctgtccgtggc

SEQ ID NO: 670 - DNA, 2598 bp, Homo sapiens; identical to SEQ ID NO: 669

SEQ ID NO: 671 - DNA, 98 bp, Homo sapiens
ccccacacaggacacacatacaatacaactcacacacaacatacacaacacaacacacacacaccctcacatacaccatacacacacaccacacacac

SEQ ID NO: 672 - DNA, 98 bp, Homo sapiens; identical to SEQ ID NO: 671

SEQ ID NO: 673 - DNA, 10845 bp, Homo sapiens
gtgctgggactacaggcgtgagccgctgtgccaggccataaattttatttttcatttccttgttttgctttgtttttgaaatgattctcctttaagccatatttacattatcttgttatcccaagaccaaaggattttttaaacaaagataagcttcaactcctatcttgttttactcatcagtgatcctgaattaccaaagacttctgtatactcatgtttcgaatgccatgtaggtcaggagtcaactggaaaagttgttaggccggtatttctacgtctcgcatttgtcagcacttgccaaaacggtgacgcagcggtgtgttatctgccgacagcgtaatgcgaggcaagtgccagccgttccgcccggcatacaagcttatggagcagccccctttgaagatctccaggtagacttcacagagatgccaaagtgtggagatctgattcctagattgggactgcccttacggatcagctcagataacgggcctgcgtttgtggctgacagtacagaagatggcaaaggtatcggggatcacatggaaaccgcatgccgcctcctggtctcagagttccggaaaggtggggcggataaatcggactatccaaaatggtattactgtcttccccgctggatattaaaaacaattccacaaggggcgtcaaaccacctgccaaatttgagggaatgttatcctctcccccgccccccgtccccagatattagagacaataacacaggggtaatgtatacccactgctttattgggagtaatatcatcctctcccttcttggatattaggaacaatatcacagtgtgcgtgtacgcctgtcgcgaaattcaatgtaatgtcatcctgtgcctctgtggatatgacgaacaatatcacgggggatgtaccacttctgagatattgggagtgatatcatcctctcccctctggaagttagggacaatatcacaggggtagtgtacactctctgtgatgttgggactaatatcatcctcccgccccctggatattgaaaaccatatcacaaggggcgtgtacacacacttcgatattggtattaataccatcctctccctctttggattttcagtgcaatatttcaggtggggtatacaccacctgcaatattggaagtaatattattttctcccactgtggatatcagcaacaatatcacagggggtgtgaaaaacccctgcgacattcagagtaacatcatcgttcccctcatgaatattaagaacaatatcgtggtggggggtgtacaccccctttgatatttgacatcatcctcttcccccctggatatgaggaacaatatcaggaagggatgtacagaccctgagacatttgctgtcatataattgtctctcccctagatattaggaaaaatgtaactggggatgtgaacacccctgcgatattgggagaagtatcatcctctcccccgttggatattaggaacaatatcacaggggaggtgtactgcctctgggctattgggagcaaaattatcctctcttcccctggatattaggaagggtctcagagggggagggtgtacattccctgcgatattcaatgtaatcttatcctctccctcccagggtattaagaacaatattacaggaggggtgtacaccctctgcgatactaagagtcatatcatcctctttggctctggatattaggagcaatatcacagggctgtgtacaccccctgcgatattgggagtaatatcatcctctccacccaggaaattactaactaggtcacggggggtgtactccccctgcgatattgggagtaatgtcgtcctccctaaacctggatgttagcaacaagatcacagagggggtgtacacaccctgcgatattggaagtaatatgatcctcttcccccccaccccagatattgggaaaaatatcacagcacgggtatacatttcctacgctgttgggagtaatatcattcttttcttctctggatattaggaacaatatcgcaggggtggtgtacatttcctttgatattgggagtaatatcatcctctctccattgggatattaggaacaatatcccaggggggtgtctaccctctgcgacattgggagtaatatcatcctctgtttccctggatattagactcaatgtcacaaaaaggtgtacaccccctgtgatattgggaataatatcatactctccttccctggatattagaaaacaatgtcatcaggggtgaacacccgtgcgataatgggagtaatattttctctttcacaggccattaggaacaatatcacagagggtgtttacacaccctgcgatattggaggtaatatcatcctctgccccccggaatattaccaacaatatcaaacagaggttgtgtacacttcctgtgatattgggagtaatatcattctctccacccccggatattaagaacaacatcccggcggggggtggtacaccccccagtgatattgggaataatgtcatcctgtccttccctggatattaggaaccatatcacaggggggtgtacaccttctgtgatattggaagcaatatcatcctctcccccactggatattagaaaaaataccacacatggtgtacacccactgtgatattaggaagaatattacagggtgtacacccactctgactttaggagaaacagctacctaaaatgtcacaaacaatatcacagggtatacagtaatatctccctaggatattacaaatactattacagggtgtacacccactgcgataacaagagaaatacatcccaaggacattaccaataatatcacaggctgtacacccactatgacataaggagtgatatttccctaggatattacgaataacatcacagaatgtacacccatggtgtgcacccatggtgatattaggagtaatatctacccaggacataaccaataacagcacagggtgtacatacatgatgtacacccatggtgatgttatgagaactatctccctaggatattacaaataacatcacagagggtacacacatggtatactcccactgtggcactaggactaataactttctaacatatgaatagcatcacaaaatagaaacacatggtgtacacccactgtgatattaagggtaatatccccctaggatattatgaataacatcacagggtgttcacccatggtgtacacatgctgtaatactaggaataatatctctctaggatattatgaataatatcacagggtgaacacccactgtgatattgggaacaatatctctctgggatattacggattatatcacagagtgtacacacatggtgtacacccactttggtattaggagtaatatcttcctaggacattacaaataatatcacagagtgtacacccactgtaacattaggaatcgcatctccctagggtattacaaataatatcacagggtgtacacccactgtgatattaaaagtcatacctcagtcagatattgtgaataatatcacggatgtacaccacgtgtgcacacccactgtgatttttaaagtaatacctccttaggatattatgaataatatcaaggagtgtacacaccccatgacattaagataacatccctttaggatattccaaataataacccaggctgtataccccatgtgacattaagagtaacatcttcctaggatattacgaataagatcccagggttgacaccccctgtgattttaaaagttaaatccccttagaatattactaataataacacagggtgtacacccctgtgatgttaggagtaacatcctcccaggatattatgaataatatcagaaggtgtacacacatggtgacattagtagtcatatcccgctagtatattgtgaataatatcacagggtatacacacctgtgacattaggagtaacatccccctggaatattctgaataatatcactgggcgtacacctcctgtgactttaggagtatcatcctgctaaaatattacgaataatgtcacagggggttagcctgtgtaatatcacagggtgtacaccccctgtgacattaggagtaacatctttctagaacatcacgagtaatatcacaatgtgtacaccccctgtgacattaaaagcaaaatccccctaagatattccgaataatatcacagggagtacaccccgtgtgacataggagtaataatccgtgaggatataatgaataatatcagagggtatatacgtattgtgacattagtagtaacatcctgctaggatattacgaataatatcacaaggtgtacaccccgggtgacattaattgatggaacagtcccctagaatatgaccaataacattacaaggtgtagaacacctgtgatttatgagtaagagttctatagaatattacaagtaatatcattcagtgtgcaccccgtgtgacattaggagtaacagcccacgaaactgtgacaaataatttcaaaaggtgtacaccctctgtgacattaaaagtaatatcttactaggatattacgaataatatcacagggtatacagcccctgtgacatgaggagtaatgtctttttaggatatcgcgaataatataacaagatgtacacaccctgtgacattaggtgtaacatccgtctaggagactatgaatactatcgcagcgaacacaccccctgtgacaataggagtaacatccccgtaggatattatgaataatatcacaaggtgtacacacattgtgacttcagtgctaatatccctctcatatactgtgactatcacagggtgtgcacccctgtgatatgacattaggagtaacatctccctagagtattatgaatactatcatgagggtacacacgcctttggtttaggagtaatattcccctaggatattacaaatgatatcacagtatgtacactcactgtgatattaggagtcccattttcctaggatattatgaataatatcacagtaggtgttcacacataatgtgtacaccatgtgtgtacacccatgtgatatttgaagtagtatgtccctaggatcttatgaataatctcaaaaggtgtacaccccatgtgacattaaaagtaacgtcccttttggatattccgaatgctatcacagggtgtgatattaggagtgtgatattgggagtaacctcttcctaggataacccatgtgatattaggagtaacctcttcctaggatattacgaataacatcacagggtgtacacccctgtgactttaaaagtaacccccccatagaagattatgaataatataacagggcgcactccccctgtgacattaggagtaacatctccctaggatattatgaataatgtcactgggggcacaccctctgtgatattagcagcagcatctacctaggagattacgaatgatatcacagggtgtccactcactgggatattagaaggaatatctccctaggatataagctatcacatcacagagtgtacacacatggtgtacacccactgtgttattagaagcaatatctccctacgatattatgaaaaatatcacggggtgtaccctctgtgggatactagaagtaatgtttaccatggatattacaaataatatcacagggtgtacacacatggggtacacccactgggatattaggagttatatctctctaagatattacaaataatatctctctataagattacaaataatatctaagggtgtacaccccctgtgacattaggagtaacatccccctacaatattgggaacaatatcacacggtgtacacccctgtaacattaggggtaacatccccccagaatattactaataatatcacaagatgtattgtgacattagtagtaatatcctgctagcatattttcaataatatcacagaaggaacacacctgtgacaataagaataacatccccctagaatagtaagaataatagcacagggtgtacaccccctgtgacattaggagtatcatctcactagaatattatgaataatgtcacagagtgttatcttctgtgacattaggagtacagacccctgggaaattatgaatactatcacagggtttacacccctgtgacattaggagcaacatctttctagaatatcatgaataatgtcacaatgtgtacaacctggtgtcattaaaagtaaaattgccctaggatattatgaaatagaacacagggagaacacctcgtgtgacattagaagtaacatcccctgaggatataacgaatatgaggcatttgtcccggtgggacgccccccagagcagtgtgtggcaggcccccgtggaggatcaatgcagtggctgaacacctggaaggaacaggcacttggagtctgcacatctgaaacttggtaagactggtctttgaaacttgctcactccgtttgagtggaagcgtggcctgatcacccacggcgtgcctgtacaggcactttggttttggttttgacttggtttgaattgcttgacgggactggtcttgagaacttgcccactccatttgagtggaagcatggcctgatcacccacagcgtgcctgtaccggcactttggtttttgtttttgatttgacttggattgcttgatactttggttttggttttgacctggcttagatttctggttactctgattttggttttgatttttgtttggtgcaaactgcaaaactgtgtgtgtgccctttttacccatttttttgttttgtggtgtgcgtgtggagtgagcatggtattttgtctcaaagaagcataggtcaggcacaaataagcccaccctactaggaactatgttggaaaatttcaaaaaaagaatttaagagagactatggagtactgtgacactaggaaaacttaaaactttgtgtaagatagaccggccagcattagaggtagattggccattagaaggaagcctggacaggtcccttgtttcaaaggtatggcacaaagtaacctgtaagccagggcacccagaccagttcccgtacatagacacttggttacagctggttttagaccccacgcccccaacacacagcggttgagagaacagcagcataagcagatggcagaggcaaggaaagagcagcagagagagagagaggaaagagacagagaggaagagaggaaaagagagagaggaagagacagagaggaacagacaaagagggagtcaaggagagagagagaaagagagaggcagagagaggaagagacagaggcaaaaggaaagtcagaaagagagagacaaagtcaaagagagaaagaaagaaagagatatacaagtagttaaaaaaaagtgtaccctattctttaaaagccaaggtaaatttaaaacctataattgataattgaaggtattctccgtaaccctataacagtccgataccactttgttgtcagtgtaaacaagggcatatcccgaaagcactgaggccttcctatcaaaaatccttaaccccataacccgcggatggcccaaatgcattcaatctgtagcggcaactgcttcgctaacaaaaaaaaaaaaaaaaggggaaaaagaataacttttagaggaaacctcattgtgagcacatctcaccagttcagaagtatcctaagggaaaaaaaaaaaaaaaggaaaaaaaagggggcgggtggaatttatataaaaagagtattatatggtaaattcttgtcctgaaataaattaactggttgtttaaagaaagaaatatttgtaataagtcagaaagttgaggcatgtggaagaattgtctgcaaaagtcaagaaagagaaaaatgttataaaaaagaatttatgcaaaaaatgttgtataatttaaaagtaactaggcctcctgaatgtaaaactattgaaaaaaaaaaaaaacaacagtttatgtgcaaggtgtataagaaaagtaaaatatatctttggtaaaaggattataaggaggcataagaatgtacatttttacctacattaaaaagttaaaaatttattgttttgaaggtttaagcaaattttaaaacattaattgtaaaggaaattctgtgtataaacatatttgctaaagttaaagaagtatcatccagtttttctgtgaactagacattaaagtaaaagcataacaggtttttcttaaagcaccaacctgctctttagcaaaaattatgaaaggttaaaaagagtctataaaatcgtaacttacggtcaaacattaaaaattagataaatatgtctacaggcttttattaaaattaggtttaacattaataacacactaatataaacataacatttagcttatctggtataaaaatcatacaagaagcattgttaaatgtaaaatggtatttggctttctttggtttaaaaactaataaaaataggtgctaaaggaaatttctcagtaaaaagacactaaggactataaagtccactgccaaggtccccacatttaaaacaaaaggtcagtttcttaaaaattatatacttggtttatcttccactttcctttctctcaaaaactaaaagtcttttagcacatgtaccaccgctagaatttccagtaaatcagcaccagcctgaagatcacgttctcatcaaagggtggaaagaagaaaaacttgagcccgcctgggaaggaccctaccttgtcctgctaaccaccaagactgctgtttttacagaaaaaaaaaaagatggactcatcacacccaagtcaagaaagcgccaccccctccagaggtgggggccatagtcccaggggaaaaccctaccaaactaaagctaagaaaaatggaggaaacttcgtgttccttggagacctgaaaggatgcagtgaagcataagaattttcaagagcttatcaatgaggcagcccttgttcatccctgagcggatgtgtggtggtattgtggtggacctttactgggcactctgccgaataactggagtggcacttgtactttagtccggttggctatccctttcaccctggcatttcatcaataagacatcataaagcgagagaagctccttaggggtctttcaactctcatgtctatttagacgcaattggagtcccacgaggaataccagatcaatttaaagcttgaaatcaaatagctgcaggatttgagtcaatattttggtaggtgacagttaataaaaatgtagattggataaactacatctattacaaccaacagcaacgagcttttcatgagttaaaagaaaactcacgtcagctccagccctgaggctacctgacctgacaaaactcaacattctatgtgtcagaaagagaaaaaatggcagttggagttttaacccagactgtggggccctggtcaaggctagtggtctatttctcaaaacaactagacagggtttccaaaggctggccccacgtctaagggccctggcagcaacagccctgttagcacaagaagcagataaactaacccttaagcaaaatctgaatataaagaccccccatgctgtggtaaccttaataaataccaaaggatatcattggttaacaaatgatagattaaccaagtaccaaatcatgctatttgaaaatccccacataaccattgaagtttgcaacaccctaaaccccaccacatttctcccggtatcagagagcccagttgaacataactgtgtaaaggtgttggactcagtttattctagcaggcctaacctctgagaccatccttgaacatcagtagactgtgagcagtacgtggaggggagcagctttgccaacccctgcaaagtgactctgaagaagacgacaagccctactccagtcacacctggaagctgactggtccacacacagccgaagcatgagaaaacccattgcgggactcatttttcttaaaatttggacttttacagtaaggacttcaaatgaccttcctcagactaaggacagttcccattgtatacatcaagtcactgaggtaggacaaaaggttgctatggtcctattattttatggttattataagtgtactggaactctaaaaagaacttgttcgtgtaatgttattctatacaaagtatgtagcccaggaagtgaccaacctgatgtgtgttatgacccatctgagcctcccatgaccatagtttttaaaataagattaaggactgaggactggtgtggactcataaatgatacgagtgaagtgttagccaaaacagaagaaaaaggggtgcccaaacaattcatcttaaaatttgatgcctgtgctgtcattaatagtagtaagttaggaataagttgtggttctcttcattagaaaaggctatatggcagaaaataaatacatctgtcataaattagcactgtgtggaaataaatgtaaacactggtcttgtgtcattttggccacttggacaaaaagaaaatgaaaaagatccagtccaccttcagaaaggaaaaaatggcccttcctgtactaagggacaatgtaaccccttagagctagtaataaccaagccccttgaccctcgctagaaaaacagaggagcgcgtgaccttaggaattgattgggccagactggatcctcaactaaatatcttggttcaaggagaagtttacaaacgctttcctgagccagtgtttcaaacttcctatgatgaactaaatgtgccagtaccagaaatttcaggaaaaacaagaaatttgtttttgaaattagttgagcatatagcccagtctctcaatgtcacttc

SEQ ID NO: 674 - DNA, 9282 bp, Homo sapiens
gatctcctgacctcgtgatctgcccgcctgggcctcccaaagtgctgggattacaggtgtgagccaccgtgcccggctgagacaggtctcttgttaatttagaaagtttattttgccaaggttgggcagggacctgtgacaccgcctcaggaagtcctgattgaaagattctcccaggggcctgaaagcttgagggaatgagtaactcctcctcctcaggcccagtcccaacgctcaaacttgcaccagcagcaagatagcagaggcaggaaaagagctggctggaagacacatactctctgaagatcaagggggaggccgtccgcgtactacatagcagtcacgtcaggctgggacaattcctgtttacagagaactataaaagccctgccccctcctcacttggggctgatgccattctaggcctcagtctgtctgcatccaggtgcttattaaaacagtgtgttgctccacaccgcctcgtgttgtctgttggcgcgctctccgggttccaaccaatgcaagagccttggggctggccctgaaacctgcgaggggcttccgtccacgtccccagtggacctaccacccctccatctgggaaagcaggccacagcagccggacaaaggaagctcctcagcctctagtcgcctctctgtgcatgcacatcggtcactgatctcgcctactggcacagacgtgtttatcggccaaactgaccctcacaaaaagctaccaccgaagtggacaggcccctacactgtgatactcagcacaccaactgcagtgagagtccgaggactccccaactggatccatcgcaccagggtcaagctcacccccaaggcagcttcttcctccaaaacattaacagctaagtgtttgtctgggccaatttctcctaccaagtttaaattaaccaacatttttttcttaaaaccaaaacacaaggaagactaaccacgtgcttccaggaatggcctgtatctacccaaccactttctatacctctcttccaaccaaaagtcttaatatgggaatatccctcaccacgatcctaatactgtcagtagctgtcctgctgtccacagcagcccctccgagctgccgtgagtgttatcagtctttgcactacagaggggagatgcaacaatactttacttaccatactcatatagaaagatcctgttatggaaacttaatcgaggaatgtgttgaatcaggaaagagttattataaagtaaagaatctaggagtatgtggcagtcgtaatggggctatttgccccagagggaagcagtggctttgcttcaccaaaattggacaatggggagtaaacactcaggtgcttgaggacataaagagagaacagattatagccaaagccaaagcctcaaaaccaacaactccccctgaaaatcgcccgcggcatttccattcctttatacaaaaactataagcagatgcatcccttcctaagccaggaaaaaatctgtttgtagatctaggagaaccattgtgcttaccatgaatgtgtccaattgttgggtatgcgggggagctttatgagtgaacagtggctgtgggacgggatagacattcccccttacttacaggcatcccaaaaccccagactcactttcactcctcaggaatgcccgcagtcctggacacttaccaacccagtatgagggacggtgtgcatatcccgcaagtggactgataaaacccatcgcgccgtaggtgaaaacccgtcaccaaaccctaacagtcaatgcctccatagctgagtggtggccaaggttaccccctggagcctggtctccttctaacttaagctacctcaattgtgtcttgtcaaaaaaggcctggtactgtacgaacaccactaacccttatgccgcatacctccgcctaagtgtactatgcgacaatcctaggaacaccagctgacaatggactgccactgacggattcctgtggatatggggaacccaggcttactcacagctaccttatcactggcaaggtacttgcttcctaggcacaattcaacctggattctttttacttccgaagcaggcgggcaacaccctcagagtccctgtgtatgataaccagagaaaaatgatccttggaggtaggagggagccaaagattgtgagaggacgagtggcctctgcaacggatcattgaatactatggtcctgccacttgggcagaggatggttcatggggttatcgcactcccatatatatgccaaatagagcgattagactacaagctgttctagagataatcactaaccaaactgcctcagccctagaaatgctcgcgcaacaacaaaaccaaatgcgcgcggcaatttatcaaaacaggctggccctagactacttattagcagaagagggtgcgggctgtggtaagtttaacatctccaattgctgtcttaacataggcaataatggagaagaggttctggaaatcgcttcaaacatcagaaaagtagcccgtgtaccagtccaaacctgggagggatgggacccagcaaaccttctaggagggtggttctctaatttaggaggatttaaaatgctggtggggacagtcattttcatcactggggtcctcctgtttctcccctgtggtatcccattaaaactcttgttgaaactacagttaacctcctgacaatccagatgatgctcctgctacagcggcacgatggataccaacccgtctctcaagaataccccaaaaattaagtttttctttttccaaggtgcccacgccacccctatgtcacgcctgaagtagttattgagaaagtcgtccctttccccttttctataaccaaatagacaggaatggaagattctcctcggggcctgaaagcttgcgggatgaataactcctcctcctcaggcccagtcccaaggtacaaacttgcaccagcagcaagatagcagaggcaggaagagagctggctggaagacacgtaccccctgaagatcaagagggaggtcgccctggtactacatagcagtcacgttaggctgggacaattcctgtttacagaggactataaaacccctgccccatcctcacttggggctgatgccattttaggcctcagcctgtctgcatgcaggcgctcattaaaacagcatgttgctccacaccgcctcatgttgtctgttggcgcgctctcggggttccaaccaatgcaagagccttgcactgatgacatgtccccagggtggttgggccacagcttggttttatacattttagggagatatgagacaccaatcaatatatgtaagaagcaccttggttcttctggaaaggtgggacaacttgaagcaaaggcaggaacactccaagcggggagggagcttgctgggcacagaaaggtgagacactggaggctgcattcttttgagtttctgatcagcctttccaaaggaggcaatgagatatgcatctatctcagtgagcagaggagtgactttgaatagaatgggaggcaggtttcccttaagcagtgtccagcttgacttttccttagtgattttggggcccaaaatatttttctttcacatgggcaacatgggaggatcacttaagctcaggagccagaggctgcagtgagcagaggtcacaccactgagacgctgtctcaagaaaacaaaactaggctgggcacggtggctcatgcctgtaatcccagtactttgggaggctgaggcagatggatcacaaggtcaggagtttgagaccagcctgaccaacatagtgaaaccctgtctctactaagaatacaaaacacccagggaggcggaggttgcagtgagccgagatcgagccactgcgctccaacctgtgccacagagcgagactctgtctcaaaaaaaacaaacaaactaaaccaaacccacttttaggcctggagtagtggatcacgcttgtaatcccagcactttgggagtctgaggcaggcagattgcttgagtccaggagttcgagagcagcctgggtaacatggtgaaaccccatctctacaaaaaattttttaaaaagctgggcatagtggtgcacgcctgaagtcctagctactctggaggctgaggtgggagaatcgcctgaacccaggaggcggagcttgcaatgagacgagatcgagccactgcactccatcctgggtgacagactgagaccccttctcaaaaaaagaaaaacaacaaaatatcactgagctccagccgggacagagtgagaccccttctcaaaaaaacaaaaacaaaacaacaaaatgccacttgtaactgcagctaatcacagcatggatattcggggccatttgagtcagtgctcctggcttgcagtccataaacttggcccagagaatctccacttgcacgagttttgctcctgcttctgttttctgtttttgagacagagtctcgctctgttgcccaggctggaatgcagtgatgtgatctcggctcactgcaagctccacctcccaggttcatgccattctcctgcctcagcctcctgagtagccgggactacaggtatctgccaccatgcccagctaatgttttctatttttagtagagacagggtttcaccgtgttagccaggatggcctcgatctcctgaccttgtgatctgcccgcctcggcctaccgaagtgctgggattccaggcgtgagccactgcgcccggcctcctaaagtgctggaatgacaggcgtgagcccccgcgcctggccacccctgcttcttcctttaggtcagcacctgctaggtttaagacattgtgggcggggacaacagaagggatattttcaaccttttttggtaagaagagttgtttcttttttctttttttcctctgccctatcttataatgctaaaagagttgcttctttatttttatttatttatttattttgagacagggtctcactatgttgcccaggcgggtctcgaacatctgagctcgtgaccctcccatgtcagcctcccaaagtgctgcgattccaggcatgagccaatgtgcctggccaagagttgctttttattttattttatttatttatttagagatggagtcttactctgttgcccaggctggagtacagtggcatgatcttggctcaccgcaacctccgcctcccaggttcaagcaattctcctgccgcagtctcccaggtaactgagattataggccagcgctatgatgcctggctaatttttgggtttttagtagagatggggtttcaccatgttggccaggctggtctcgaacttctaaccgcaggtgatctgcccacttcggcctcccacagtgctgggattactggtgtaagccaccacgtccggcctccaagtttctattttacatttctcatctccatcctgccaagtgtctattccgcacagtactgactcatttgctctgaaggatgagctgaggagttctcctgggctacctcccaagttcctatttgtgtcctccaggttcttggtttatcttctgtttacttgttagggtttataacactctcattctgtcttgtaatctccatagttgtttagccttaattcacaggcaaataggttctaaggtctcccccagtactactgtggccttcaattcttgatttttttcttttttttttttttgagatgactttcgctcttgttgcccaggctggagtgcaagggcgtggtcttggctcactgcaacttctgcctcccaggttcaagcgattttactgccatagcctcccaagtagctgggattacaggcgcccgccatcatgcccagctaatttttgtatttttagtagagacgaggtttcgccatgttggccaggctggtctgaaactcctgacctcaggtgatccacctgtctcggcttcccaaagtgctgggattacaaacatgagccaccgtgcctggcccaatttttgaatttttaatgttagttcatctcttgtttggctggatttcactgtctagttttcctcccacgaagggcttgaggaggtgagagtctctgaatacaggcagttgaaagatggcatatatgggccagcacggtggctcctgctgtaatccctgcactttgggaggctgagggggagagatagcttgaagccaggaatttgagaccagcctgaccaaaatggtgaaatcctgactctagtataaacacaaaaattagccaggcgtggtgccgtttcctaaaggattggcctcagccacttactcagcctgaggctgctctgagactgcagagggtcagggagagaaggtggtagaaccaaggaagctgagcacttaaaacacccacttatttaatttaattaattaatttattttttgagacggagtcttgctctgtcgcccaggctggagtgcagtggcacaatctcggctcactgcaagctctgcctcccgggttcacatcattctcctgtctcagcctcccgagtagctgggactacaggcgcccaccaccacgcccggctaattttttttttgttttttttttttgagacggagtcttgctctttcgcccaggctggagtgcagtgaggctatctcggttcactgcaagctccgcctcctgggttcacgccattctcctgcctcagcctcccaagtagctgggactacaggcgcccgctaccatgcccggctaattttttgtatttttaatagagacggggtttcaccgtgttatccaggatggtctcgatctcctgacctcgagatctgcccacctcagcctcccaaagtgctgggattacaggcgtgagccaccgcacctggccaattttttgtatttttagtagagacagggtttcaccgtgttagccaggacggtctcgatctcctgacctcgtgatctgcccacctcagcctcccaaagtgctgggattacaggcgtgaggcactgcgcccggcctccaacagaacgtgggaaatcacatagacccaaacaatggccccttgggtgaccactgtattgccaccagatggactatcaagaaatcatctgcagtgatagctacaaaatgcagagctgtgcttggtgctggctattcggttttaagcccttccaatgggtggaggagagtaaaccaaaatcccagaaagactagcccaacaggactagttctaagggaagaactttatttttttgagacggagttttgctgttgttgcccaggctgtagtgcgatgctgcaatctccactcactgcagcctctgcctcctgggttcaagtgattttcctgcctcagcctcttgagtagctgggattacaggcatgcaccaacacgcccggctaattttgtaattttagtagagagggggtttcaccatgttagtcaggctggtctcaaactcccaacctcaggtgatccatctgcctcagccttccaaagtgcagggattacaggcatgagccaccgcgcccagccaggaaagaactttatacaagtctcatgctttatcttaaaaatatatgcaaatcaaaatatattcatgttcattttaatattaagggaatttccatttccaaagcatcaccgcccatcacagtagttccacggatcccagcttgagaactattaaatgaaaaaccaaaaaatgcaaatagcaggatagaaaagttgtaggtacattaaaatggttacacctaccaccaccactggggaatcctgtaagatgttaatggctgggaatgggggctcacgcctgcaatcccagaactttctggggccgaggcaggcagatctcttgaaccctgtctctacaaaaaatagaaaaattaggcggacatggtggccagtgcctacagtcccagctacaaagtgggctgagatgggaggattgcttgggcctgggaggacgaggctgcagtgagctgagatcgcaccactcctccgggcaagagtgaggctgtctcaaaaaaaaaaaaaaaaaaaaaaaaaaaaaaagggtgggttagcatagtggattttaggtaagtttactattttctttttggtaatgtagttttaccacttttattataaaaaatgtgtttagaagaatctggctgagttgctaagtctcccgtgtggtaacacaatttgaggcagatgaccacaatactagttttcaattttgatatttaaaaaaaaaaatttttttttgagatgcagtctcacgctgtcacccagactgaatgcaatggcatgatctcggcttactgcaaaccccgcctcccgggttcaagcgattctcctgcctcagcctcttgaatagctgggattacaggcacgcaccaccacagttggctaatttttgtatttttagtagacacagggtttcaccatgttggccaggctggtctcaaactcctgacctcaagtgatccatccgccttggcttcccaaagtgctgggattacaggcgtaagccaccgtgccctggccctcacctacattggttactttctctaagtcagactgggggtctgtctctgcagagtgctgggggagcgtgctccatgtgatgcacaggagccccccacattgcccccaaaggtgtgacttaaagttatctatcacaagggatgggaggttacttggccaacccagaaaccctaaataggtaaaatagctcattgagtgcctgtggccagcggggagcaacttcgtccctgcaccgcacaaaacttcacctcttcctactccgtccctgcaccgcacgaaacttcacctcttcctactccgtccctgcaccgcacgaaacttcacctcttcctactccgtccctgcaccgcacgaaacttcacctcttcctactccgtccctgtactgcacgaaacttcacctcttcctactccgtccctgtactgcacgaaacttcacctcttcctacttcgtccctgtactgcaagaaacttcacctcttccgaatctcaccaatgaaaatgtcctcaagtttatataaaatatctaacagaggcaaacaaaacaattcccttccttttctgatggtaaaatactgcaatacaatttgtttgcaatgcagtagttaaaattagtaacattcctgttccttttttttgattgagtttcactcctgttgcccagactccatctcaaaaaaaataaaagaagtcactattacattattgatactcagctgataatcagtttaatgcgaaattgactaggctgagcacagtagaatcacaccgctcta

SEQ ID NO: 675 - DNA, 732 bp, Homo sapiens
ccgcggccatggccaggggcacctgcgcgggacaggcacggggccagcatcctgagccccacctgcaggccctgggcgctttcctcctggcagctgtgcccccacccgaccggaccgctccctgcaaccagagagccctcacaccagcaacaccccccagcctgctccctcctcgtgtgcgcgaaactcatggcactggcttgacggctttctctgaaaccctctgattccgcctggcccatccacactgtcccttcccggccagggctcatctcctatgcctggaccaaacagcgtagtctccagtctccctgatctccccacacgtggccccacccatcctctgaagcagccccaggaggcagcagtgacttcacacttctagtgcccggccctcccggccctcctctctgggcttgcttgccagggtcctcccaacctgactgctgcctcccacctcctctccgcccctggagctctccagccgcagccgcggggcctgcttgggattctcctctgctggcatcatccctgcctgcctcagccttcccaggcccaatcctgcccgatctcacctcttcccgcccagccacctggtcgggtcccgaccagcatctgccttcaaacctggagtccttccctgagtgcttgcggtgcactgtgaggaaggaaatcaatgtaaaggattatgacccacattttttaaaaataaaaagattaaggagaacagca

SEQ ID NO: 676 - DNA, 12734 bp, Homo sapiens
ccccgcccgagccgggcggagcggagcgcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggagttcttgctgtcgacatctttgacaagttcaacttcacgggagccagagtcccatggttcgacgccattcatgaagaattccccagggagctggagtcctccatctccttcccagccaacttcttcaaaccacctgaagaaaaagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcgctttgaacgaagcaaatcaaccaattaaaaaaatatattccaggattggccagagtctgtgaagatttccataacaaatccccgttacaagggttttcagagagccctggttgtgcattaaaccccgcgatggcaaacccaaagctcaggctctgaggagctcttggagtctgcccctcgcttcagagatggtctgtgcgagggtgccgctctcctcccgctttgatcataaggaaggtgacagctgctggggacggtaggcactctccctcagggccacaagctgggctgcaggataaaagactgggcggctaatgtttaacctctggcattttaagcggcctgggagtgtgagccggccattgtgggcctgcagatgaactggggagtggcccgagtgctgtcctcggcaggacagtgctatccagccaggaagtgggtggcagccagcctgggagtggcctatgtgggaccctcctgtctaggagtcagagccagaggcctgggtggcctcccctggcccctccccagggctgcgctgtagctcaagggcccaggccaccatccttcccgagggctttctgatgtgaagtggccctggtttctgtcacagtcttggaagggtgagtcagccctggggcagggctggaggagggctgtggcttcctgtacaatgtgcgggggaagctgtcccacctgtgcccccatctcatgggcaaatggcactccccagcaggacccagcctggagaggggttcagtgattagtggactttgttcatagaagggcagggttgggggttgtctcgtggccaggacgccgggcaacatgtgggccaaggaagctgaaattgaggcggaaggaaggaggctggagtgggagtccgaggctcccatggcctgggtgccccaaagttagcggtctctgaacagccctgaaccagtggagggagactggggtgctgctcctggccccagggatgtccagggcccgggcattgaagggacctcagaaggggcagttccaggcccagggctgtgagcactcggcctccccaacccagccaggtcttggcttcccagctcctagttccacatggtaagcaacgccttccagaagttaccagagaaccagagcttgttgttccccaaatgcagaaactccccagggacctgggtcctgggcaagtgtcctggtttgtaaaagcacaggaaacacagcaatgtgaacctacacactgctgaactgtacgcttcaaagtgtccaagatgatatgttttatgtcatgtatattttagcacaattttcctttttttgttttttgacacagttttgctcttttcgcccaggctggagtgcagtggtgaaaccttggctcactgcaacctctgcctcctgtattcaagtgattctcttgtcttagccttccaagcagctgggattacaggctgcaaccaccatgccgagctaatttttggatctttagtagagacggggtctcaccatgttggccaggctggtctcaaactcctgacctcaggtgattgacctgcttcggcctcacaaagtgctgggattacaggtgtgagccactgtgcccagcctgttttttaaagacatgttcactgcctgtaagaaatgcataataaggtggggtgtggtggctcacacttgtaatcccggcactttgggaggccgaggtgggcagatcatttgagctcacaagttcgagaccagcctgggcaacatggcgaaaccctgtctctaccaaaaatacaaaacttagccaggcatggtggtgcatgcctgtagtgccagctacttggcaggctgaggtaggaggatgacttgagcctaggaggcagaggctgcagtgagccaagattgtgcctctgcaacagagccagaccctgtctcaaaaaaaaaaaaagcataataagggatctggaatttaaaaaataggtccatataacaagctataatagagacgtgcagctggcacaggacatccatccactggtgataatgatagaacacgtcatattgcacgatagtaggaaaaacaggacagatgggaagggtgcggatgaccagcgccgtagcaatctgaagcatcgagcctgccagtccacataactgaaacctgaagctctgcccctgcccagctctgtgacttccagcaagttgtttagcttctttaagcattgattttctcacctggaagatgagggttgcattcacactctcttcatagctgtgacctaaggatgatatgaaacgacgcccttggcagatctatcagaacccctaccacataataagtgctcagtaaaaggttttgctgaacaaaggaaattacattcatgttgtattaccacaattacccactttctttataaagcggtagtaagtctttcagccaaaagaataagtccatgatgggattaagtgaaagtccaagaggtactgcatgcacctaaggtggagatgtgtttatcttttgcataagctggggatgtatttggaaggtttctgctagcccagaatttgggtggacaggctgagcccctcccaacagcaggattcacctatggggttggttttgggtagacaggctgagcctgccccatggaactgtaggggcttacgaaggcatttcgtttggggaaggagctcatccaggaggactgggatctctggttatatgtgacttctgacctctgggcatggaggtctctctccagaggcccaggcctggacacgaagggagagaggcctccattgtcccacaggggccgaaatgcagacggtgcatccccggtgccctggggaacccttctctgatcatcaggattctcttggactccggggtccttgtcctgctcaggcatccctgccctgctgtccttcagggccctcaacacgatcttctctggacacgagtctggggatagccgggtgttgtgggctccaaagggttgactccttgctcctgggccccacagagagtccttgtgctcagtgcactggctgtgctgcaagatatcctggaattcgaagcacacagtgctggcttgctgtggtacctgtgcaatcaaattgaaggcaagatcaccaggaaggaacacagggcttgcaagatcacggaaaaccttcttggagttgttttgacacaccactcatgtcaagtgtctgggtacttgtaggatggcccgccactccacccaggggcaggagcaacagggagatcccacaagcaaagtgaactgggggatggggtgagtgggctccaggcaacagagccctactggcaggtcctcaccccctgggccggaactggagtgaggggcacagagtgcccaggtaaccgctcctgggaacagtggggaactgtcagatgctcgaactttcgagagctgggctctgagcgtcctcgtggagctgccaactcggccaaaggagaagcgagcagtttcttctgttgccgggcaacacgccttttaaacctgagcgagtgggtgcgcatgcaaagaacgggcgcgagtgacagagcgaccttaacggattagcaccttaacggattagcaccttaacggattagcgtggcaaggtatgcaagcaagtcacctgctggcaatttgggggtggggagggggaggtgcgcaatacatactggaaggagaggcacccacacaaaggacgcaggaagaacaggtgcgcacaaaggcacaatggcggcagatctgcccgtggatcactgaagattcctgctctcctgctgaggtggagattgcagtgaactaagatcacaccattgcgctagagcccgggcgacagagcaagacttggtctcaaaaaataaataaaataaaataagtacaataaaataacaaaacaaaacaaagtaagaggagatgatatctggtcgtgttttatggccatctggtaagctagattctttcctttggttttattgccaatcaatgattagaaagaagcagtttgctgttggcttgtttttcccctcaactaaatgtaagaaaaaaaaagagtcaaaaataccgaagctaattttaaaatgtatgtatagagagagacttggtcttaccttgtcatccaggctggagtgctgtggtgccatcacggctcagggcagcttcgacctcatgggctcaggcaatcctttcacatcagtcgaccagatagctgagattacaaatgtgggaaaccacaccctgctaatttcttgtattttttgtagagtcggggtttcaccttgttgccgaggctggtcttgaactcctgggctcaagcaatctttctgcttctgcctcccaaagtgttgggattataggcatgagccaccattcccgccgaaatatttttgagattcatagagatgagtaggtcataataagagtgcacaacttgtagttatatttaatatcttttgaaattactcggcacccccattgtaatttaaatgatttgttcctgacctggttttactttgttcctgagggttgcagatcccttgaacaatattccacgaatgaagcagtgataataaacctgcagctgccccgagggggcgctgtgcggaggttcacaaagggacctgggtctccctggtgcggatgcgggggccgcctccattctgctttctgacactgccaccgcggggccaggcttgatgtgaccccatcactgctcagttcactacacagtttcatcttttgatatggaagatttgactccatccacgttccttaggaggttactggaaatgacagcgctgtaaatttctgggtaaatgagcagccaacatttttgggagctgtcacacaaccacactgcccttccctctgcctgaaaacctttaggcctgattgactcggagaaagcccattaaactcagcccccactgacttgttcatttccactcaaacgtttgtgatagtcccaacacaaggcttgtcctccaagggacaacttgtaaacacttctaagagaaagggttgactgggcccggtgcctcacacctgtaatcccggcactttgggaggccgaggtgggcagatcacttgaggtcaagagtttgagaccagtccatgatcttggcttgaagaggcaagaccctatagtttattgaacattttaagcccactccttgatccatgagccgcagaatggatgttgtattagcaaaaatgaaaacaacattaatctccttgtatcatcattagagctcctggctgactggttacattgtcaatcaacagtaatattttgaaaggaacagtgggcttaaaatgttcaatatgctgtcaacagatgtgctgtcatccaggctttgttattccgtttatagagcacaggcagagtagatgtagcgtaactcttaagggccctaggattgtgggactggtgaatgagcactggcttccacttaaagtcaccagctgcttaggccctaatgagagagacagcctgtcctttgaagctttgaagccaggcattgacttctcctctgtagctatgaaagtcctagatgtcatcttttaatagaaggctgttctatccacattgaaaattgtcatttagtgtggccaccttcatcagtgatcttagctagatcttctgggtaacttgctgcagcttctgtatcagcacttgctagcttcgccttgcacttatatgttatggagatggcttctttccttcaatatcgtgagccaacctctgctagcttcaaacttttcttctgcagcttcatcaccaatctcagcattcatagaattgaagacagttagggccttgctgtggattcagctttggcttaagggaatgttgtagctggtttgatcttttattcaaggcaggaaaactttctccatatcagcaataaggctgttttgctatctatcatttgcgtattcactggtgtagcacttttaatttccttcaagaacttttcttctgcattcacaacttggctaactggcctagctttcagccttttggcttttgccgtgcctttctcaattcgcttaagcatttctagattttgatttaaagtgaaagatgtgggagtcttcgttttacttgaatacttagaggccattgtagggttactaattggcctaattttaatattgttatgtctcaaggaatagggaagcccaaggagagggagagagacagaatggctagtcagtggatctttcagaacacacacaactttatagattaagctcactgtcttatatgggcacagttcatggcaccccaaaacaattactatagtagcatcaaagaccactggtaatacatcaccataacagttataataataatgagaaagtttaaaatattgcaagaattaccaaacttgacctagagacattgaagtgagcacatgctattggcaaaatagtactaacagacttgtttgttacagggtagccacaaacccccaatttgtaaaaaacgcagtatctgtgaagcacaagaaggtgaagtacaatctgaggtgtatctgtattttcttccacgttgttaggtgtcttcttataacctaagttttagattttcctagacaataacttaaataattttagaacattataaattacttctcccttgaaggattgcttgtggtcaggagtttgagaccagcctggacaacatagtgagatcttctctctactaaaatttaaaaaaatatatagccaggcatggtggcgatcctcccacctcagcccagctacttggagggctgaagcagggggatgacttgagccaggaagttgaggctgctgtgagccattatcacgccactgcactcctgcctggacaacagagcaagaccctgtctccaaaaaaaaaaattacttcccctttgattatagaactttgtcacatatcaagttgattaaatgaagataattcaagcattaagtaattatttaatgctttttgtgttcttctagtttgagttctatgattctatgatcttaagatatttaccttaatatatagagagacatatatattaattattatataacacaaatcaattatttcaattaataatttgaagtttttttccatttacttggtacttagaatgcagggggaaatatgatataggatggttagtcatacataaggaaaattctttttgtacacttgacagtcttggctacatacccaattctctgcttttttatttcctatggacacttctttgatgatatatatgtatggcttgggggaggcggttggcttttgtttcctgtgagacagatatctaagttccatagatatctgttccttccctttagaagcaaagaggatactggttcttttatttcaagatctgtaagttaaaattggacagtctgaaatgcataatctttttcttttttgagacggagtctcactgtcacccaggctggagtgcaatggtgcaatctcggctcactgcagcctccacctccctcccagtttcaagtgattctcctgcctcagcctccagagtaactgggattacaggtgcctaccatcatgcctggctaatttttgtatttttagtagagacggggtttctccatgttggccaggctggtctcgaactcctgacctcaagtgatccgcctgcctcagcctcccaaagtgctgggattacaggcgtgagccactgcacctggtctgaaatgcataatcttttaaaactgaaagccatttctaatagtgttcttaatttgtcaagaatcgtatgagaagtgccagtgccctttgcctgtctagctataagtggattatcatgcccaccctttggagccagcagttttggttcagtcctttggtctctgactactcacagtctgcaggaaagagcaggttgtgacacttgactagtttatgagagcagaagctgttacgtgacacttagcacatactgctctcagaggccccagatggatcattaatgctcggaacgtgcgtgctttatggagaaaccgcctaatcaacggaggtagattccctaatacccatatcatctttcgttaactctcttaagagtcaccctaaaattactgtgctgacgatcactgtatttcattaagtatccattacaaaacaagcccttatgagtttagcttttatttaacaaatacattgttctcttctaacttgtgccttttatcatccgttgaagctttagaatagtagaatgttcatgctgaaaacgtcttggcattctggtttattatcaggtttacagatctgggactgaaacccgcacaaggataaatggctgcctcaaggctatcttcaggcccattctgaaagaaaaaggaagttctcgtcgcagaaagaaaataataccaaagggaaacaaaatttcaagaaggaataaagaacagtggaagagtaaatatgaagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaac

SEQ ID NO: 677 - DNA, 19778 bp, Homo sapiens
gcggagcggagcgcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacaggtatgggtgacattcagtctgagacttcaactgcttttttgtttgaataggcaggatgcattggtgtttacagtgttccatctcattataggaaattgtagacatacaaaagtagatggattgatatttcagcccaatacgctcatcacgctcatcaccattatcagctcacagccagttgtaactctgtgatacccaccctcccctcttattattttgaagcagattctggacatcatatcatttcatccataaatattttattatcttggaaagagaaggattcttttaaaaatataatcctaataccattatcagtccttaaaataattgataatcattccttaaatcataccttattcaatgagtatttaaatttctaacagtcttataaatatttttgttttatttactatctatttttatgtttggatcaggactcccataggtccatatataattggctgatgtgtctcttaaatcttcttttttaaatctatgggtttaacccaattcttgcagtttaatttttgtggaagctggtcacgtgacctatagagtttctgagcatgtggatttttatatcacaatatccccatgacgtttttgcccatcaccctttgttgtgtgtatttattgtaaatggcattggagacttatgggacagattcaggtcccctgtccccccaatttgaaaaaaaaaaaaaaaaacaaccaaaacaccatgttgaccaggctgatgtcgaacttctgacctcaggtgatccgcctgccttggcctcccaaagtgctgggattacaggcatgagccaccgcatcatttaaatgtactgaaagtccaggcatggtggttcagagctataaccctagtactttgagaggatgaggcaggcagatcacctgaggtcaggagttcaagaccagcctggccaacatggcaaaatcttgtctctacaaaaaaaaaaaaaaaaaaaaaattagccctgcgtggcggcgcacggctctagtcccagttacttgggaggttggggcatgagaatcctttgaaccccggaggcagaggctgcatgcagtgagttgagatggcaccactgcactccagcctgggcgacagagcaagaccctgtctctaaataagtaaatgttgccggtaatcctagcactttgggaggctgaggcgggtggatcacctgaagtcaggagttcgagaccagcctgactactatggtgaaaccccgtctctactaaaaatacaaaaattagctgggcattatggcatgtgtctgtagtcccagctactcaggaggctgagacaggagaatcgcttgaacccaggacgtggagggtgcagtgagccgagattgagccactgcacttcagcctgggtgacagagtgagactccatctcaaaaaaaattaaataaaataaaaaataaaaataacagctccctaacagctccggaaagataaacagaaaacagaaaatgacatgctcagcccttgaggccaaaatgcccttccccagagcagctgccagaagacagggagcaggatcgggttggaggtcacttctgggtgagggggagaatggtcagacccgtggcaggggtgttggagcctggtcggcctcactggaacagaagagagctgcttcatgatgctcaactgacaggcagagcctcgcataacccaagttctcatggttcagagaggccagccagtgcggggacaaagacaggcacgcactgaaatggtttcctggaagacggcccggttgcatctctcaaacgggaccagattggaagggagaccagctgctttgggcaaccgaggctgcttctgggtgaactcccaaactagatggtgccgagagccctggacctggcagctgggctggacatcacatggctctgtattccaggaaacggcatctcagtgcttgtctggccagttctccaaaagaaccatccacaggccatttttccattcccttcctatgcacagactgggctgggcctgatcagaaaactctcccttagggttttcagtcactggcgaaacttgagcccggcactgaggataggatgttaaaatgtgactctgggccaggcggcggctcatgcttgtcaacccagtgcttttgggaggctgagctgggagggtcacttgaggtcagcagttcaagaccaacctgaggaaaatagatctctacaaaaaaataaaaataaaaattagccagctctggtgacatgcacctgtagtcccagctacttgaaaggctgaggtggcttgagcccatgagttcaaagctacagctatgatggtgtcactgcactccagcatgaaaaacagagtgagaccatgtcttgaaaaaaggaacaaactaggcatagaagaaacatacctgaaaatggccaggcccagtggctcatgcgtgtaatcccagcactttgggaggctgaggtgagtggatcacctgaggtcaggagttcgagaccggcctggccaacatggtgaaaccccatctctaccaaaagtacaaaaattagccgggcgtggtggcgggcgcctcccagctactccggaggctgaggcaggagaatcacttgaacctgggaggcagagtttgctgtgagctgagattgcaccattgcactacagcctgggtgacaagagccagaatccatctcaaaaaaaaaaacctagaaataataaaagctgtatacgacaaagccatagctaacctactacagaatggggaaaagtgaaaagcgtttcctctgtaaacaggaacaagacgaggatgcccgttctcaccacttttattagacatcacacaaatatgcaagagaaaaaaataaaagccacccacactggaaaagaggacatcaaattatccttgtctgatgaagatgtgatcttggatttacaaacatgtaaagcctccaccagaaaactctagacttgataaataaattaatacagtcatttgcaggatacaaaatcaacatacaaaaatcagcagcattttatacaccaataatggtctaggaaagaaattaaggaggcaatcccatttacaatagcaacaaaatgaaaaatgatatgccacagaggaaattttaccaaggaggtgaacgatttctacaaggaaaactacaaaacactgatgacaaagtttaagaggacggaaagaaatggacagtcatttcatgctcatggaaggaattcatagcattaaaatgaccacactgcccagagcagtctagagattcaatacaacccctaccaaaataccagtgtcatctctcacagaactggaaaatcgtaaaactcatatgaaaccaaaaaagagctcaaagagccaaagtcatcctcagcaaaaacaacaaaactagaagcaccccatttcactgcaaattagaatgacaaaatttttgacaagtgcatggtaaccaaaacagcatggtcctagcataaaactagacacatagatcaatgggacggatgacagagcccagaaagacagccacatagtcttggggcttgtgtctctcctgctgtgcatccatgctgggtgctttacatacaacaggcagacaagaagtccctgttgcaagtgaggacaaagtgtgggaaggccgtgagggtctgcagtcccagatggccttggcctcaccccgcagtgcgcttttgcaccagagtgccaccttcttctccaggtccaggtcttcagcagtgaccccagaccccagctgtaagggaggtggcagcatcagaggctccccttgcctgagtggcagcagaggaaacttgcatctatggggcctagaggcctgggatgtgggggagccattcctgggggcaagtgtctgccctggtgctgcatctgctgccttttcacactgggtgagaccccaagagacagcctgaggccggtcctcactcactgtctttgaggacctgaggggcagctgacagtgggatgaggctggccccctcctctttggtgacaggaagcctcccatggaactgtaggagctcacgatggcattttgtttggtgcacgaactcatccaggaggtctgggatctctggttttatccgacttctgacctctgggcatggaggtctctctgcagaggcccaggcctgggcacgaagggagagaggcctccattgtcccacaggggcctaaatgcagactgtgcatccccggtgccctcaggaacccttctctgatcatcaggattctcttggactctggggtccttgtcctgctcaggcatccctgcccccctcttcaggagggccctcaacacgatcttctctggacaggagtctggggcacaactggatgttgtgggccccaaaggggtgactccctgctcctgggccccacagagagtccttgtgctcagtgcactggctgagctgcaagacatcctggaattgggagcacacagcaccggcttgctgtggtacctgtgcattcaaattgaaggcaggatcgccagcaaggaacacagggcttgcaggatcacagaaaacccttggagttgttttgacacaccactgatgccaagtgtctgggtacttgtaggatggccctgccattccatccaggggcagtggcaacagggagattccacaaacaaagtgaactgggggatgggatgagcaggctccaggcaactgagccctactggcaggcccttggcccccggggccgggacaggggtgacagacacagagtgcccaggtaaccactcctgggagcagtggggaaccgtcggatgcttcaactcttgagagctgggctctaagcatccgccttagctgccaacttggccaaaggctatgcgagcagtttcccgttgacgggcaatgcatctttccaacctgagcgagtgggtgtgtgtgcaaagatggtgcgagtcacggatctgcgcaggaagggtgactttaagggattagcatggccaggtatgcacacaaggcacctgctggcaatgccttggtggggagcgggcagtgcacacaagaggtactggagggagaggcgcgcgggaagaacaggcgcgcacaatggctgcagatccacctgtggatcgctgaagattcctgctgagggttgaggctgctgggctggaggactgtatggtccatgcattgtaatgtccccttctctccctggcccggagccccaagagctatccggactctctccaagacctggttctggcccagcaaagaggtctcggcaggggagcaggattcccggcccagcagctggctcaggaggtgacagctttgggattcgcatctgagcatcctcctactcttctcctgggaactctgttggggagggttgctcagaacagaagtgcctgggacgcccagatcctgctggagtggcagctggggtgatggccagggcaggctgggagggacatactttccataggacccagtgctttcatctccgtgcaactgaccaagagaaaccaaacccaaactccttcctttacacagacctatttgagggaggctgggtattgtttgtgtatttcaacctaacaagattttgagatagttggaatgcagaaggagacaggaggactcaagtgtcctgtcttttgcaaaaatgtcaaacgtagctactcagtctcttttttgtttttttgtttgttttgaagactatggttattttgcaaaatatatattatttgagtttctctaggtgctatttttagataaattaatatacttttttcatcagcacatgaaacgttcttcaaaacagatcctttgttagtccacaaaagctgtccctacacattttaggaaatcataatcataatcattccaaagatcagacaacagaggaataaacctagaaatggacatcaaggcaaactacagaacctatacgcatacatgaaaattaaaccccaccctcctgaatgagcactgattcaatgaagaaattaaaatgaaaatccgaaaatgttttcaaacaaatgaaaatggaaacatcatataccaaaagcctttggattcagcaaaatcagtgctgtgagggaaggttgtagcaataaatacctacatccaaaaagtagaaagatgaaaaattaataaacttatgatgcaccttaaagaactagaaaagcaagaacaaagcaaaaccaaaattagcccatgaaaaaaataataaagatcagaggagaactaaataaaatagggtctcaaaaacaacacagaaatcaagaaaaggaattactggttcttagcaagaaaaacacactttgggtatttcctttttttttttttttttttttttgagaaagcttttttttttgagaaagcgttttgctcttgttgcccaggctggagtgcagtggcaagatctccactcaatgcaagctccaccttccaggttcaagtgattctccttcctcagtctcctgagtagctgggttacaggtgctaaccaccatgcccagctaatttttgtatttttagtagagacggggtttcaccatgttggtcaggctagtctcaaactcctgacctcgtgatctgcccgtgtcgtctcccaaagtgctgggattataggtgtgagccaccgtgcctggcctcaaaatattcttttgagggactcttgcatacaagccccaagaggcaggtgcaaaaatgtccatagaaacacagtaatagaaaaaaagaaaatccagactgattcaaatgtccattaacaggagaatgaataaattagttggaatcttcttttcttttcttttcttttcttttttttttttttgagacggagtttcgctcttgttgcccaggctggagtgcaatggcacaatctcagtttgtggcaacctccgcctccggggttcaagccattctcctgcctcagcttcctgagcagcagggattacaggcatgcgccaccacacctggctaattttgtatttttagtagagacggggtttctccgtgtttgtcaggctggtctcaaactccggacctcaggtgatccgcccgcctcggcctcccaaagtgctgggattacaggcgtgagccaccactcctggccattagttggagtcttcttatacagtggtgagactgaatcagccacagttgcacaacagaatggatgaagcttagaagtaatgttgggtttaaatggccagtcccaggctgttacatttaccatttgcaataacaataggaactaaggtaactgaagaatctaacaaaaactatgcaagacctgtatagaaaaattataaaacttgattgaaagacatttaaaaaatctaaataagagagataatacataatctactctttgtggattgggagattcagtattataaagttgtcgattctccccaaattgttctacagatttaatgcaaatccagtaaaaaattcaacaagaggctgggcgcggtggctcaagcctgtaatcccagcactttgggaggctgaggcaggcagatcacaaggtcaggagatcgagaccatcctggctaacatggtgaaatcccgtctctactaaaaaaaaaaaaaaaaaaaaaaatgagccaggcgtggtggcgggtgcctgtagtcccagctactcaggaggctgaggcagggaatggtgtcaacccaggaggcagagcttgcagtgagccgagatcgagacactgcactccagcctgggcgacagagcgagactctgtctcaaaaaaaaaaaaaaattcagcaaggggtgtgtgtgtgtgcctgtgtgtgtgtgtgtgtgtgtgtgtatgcaagccatagacagaatactttttttttctttttgagacagagtctcactctgtcgcccaggctggagtgcagtggctcgatcttggctcactgcaacctccgcctcccaggttcaagtgattctcctgtccctgcctcctgtgtagctgggattacaggtgtgcaccaccacatctggctaatttttgtatttttagtagacacagggtctcaccatgttggccaggctagtctccaactcctggccgcaagtaatctgcccacttcagcctcccaaagtgttgggattataggcgtgagccaccgagcccagctagtacacagaataccattttttacttaagtatattaatctagaagagttttttttaaaatacagtataccatttttatctataacacttaaagacaatcaaagccaaattatgctgtttcaagataccatatacttagaaaaacatctataaaaagcaagagaaacatacaaatcaggcccatctggagagaagggagtgaagcattgcgctgatacggggataaatatgctggttgggtagacaggcagtccttatgcttttggctgacgtagatgttacgtactatttcatgtgttatcacactctccagtaaacacgtaacataagagaataattaaccactatcaagcgttctcatcttgagacaggaagatgtagaggaaagaccttgatgtgtgtgtcagttacaaggatgtacaccagtgactgacatgacttggtgcaaatcttgggtagagacctatacttaagctcctcacccccacctgccgaggcgtaagggctcagagggggttccatggggtgggcgggagtggtaagggtcgaggtgcagccacagcctggctctgtgcacaccccctccctccccctggtcccatgtgcacaccctctccctgccccctgccccttgtgcacaccctctgtaccccccttcccgccccagcctgtgtttgcagtgctacagggtggctgcagcctttgcctcccacagctcctcaaggtcagagggctgggaacccctgggatgtggctgggatgaggaccctgcccctcctcaggcatttccaggcaaggggcacagagacacagccagcccagcagctgagcccctcctatcaggccaggtgggaaactgaagcatgaacacaaccccagactggaaataaaaagccgtcatgtactgtgtgcctactgaatgccaagccctatgccctattctttaatgtcatctttaatgagatgtcttcactcagttcaccacatgatagtagacaggtatttatgatgcgcctactgcatgctgggcacttttctgggccatgaggactcagggaggtccctgctctggtagaagtcaaacccgacaggagacagagactaggggcccacacaccaggaggaagaacccagtgcagagagtgccagcaggaagccacaggggcagggaaggcgctcctgggagggtgggtggctgcgtcctgaggctgagcagggggagctggcctcgggacaggatgtgcgcaggcgtggagcaggaagttcctggaatgatgggcaagagggagcaggtcactgggggcaggtctaaatactgggggctgcattgggatagcagaggcctcggacaggcccgctcagcatgtagactcccctccctggccccttccctaggatgacagtggaggtccatccccaggtggtggtgagggcaatcctgacacagagaccccagcccagctggcaggggaaggggagcccccaaggacccctgtatgttggggcgtgtcccgccaggcggccctccatggtgcccagcagcagccctgcttgcggaccctctttagtccccactgttaaaaaaataattcagtgaaaattgacactagctgggcatggtggtaggtgcctataatcccagctactcgggaggctgagacgggagaatcgcttgaaccagggagtcgggaggttgcagtgagccgagatggcgccactgcactccagcctgggtgacagagtgagactccgtctcaaaaaaaaaaaaaagaaaaaaggaaaaatgacacttgccaaagcgctgtagggaagactgtccaggaccgtgtcactaggcataagggaccacggtgatgagattctgcagtgggtaagagactgggctcagcctcgaatacagcatgggcaagtgggatcggaccgtcaaggagcagggggaagactatccaggaccgtgtcactaggcataagggaccacggcgatgagattctgcagtgggtaagagactgggctcagcctcgaagacagcatgggcaagtgcgatcggacagtcaaggagcagggtggggggcagcgcatggaaagtgactaagaggaagcatcagcagccagggattctggcttaactcccctaacagaattcttgctgaaggccggccaggatggccagaccgcacctgggggacagagggggaacccgatcagatgtcaaggacggggggcttctcgctaaactgactttgcaggattcttgctaaaactagagtttataaggaagtgctcagatgtgcctaggagaaggctcaggagcctaaataaagcttgaccaagcagagaatctttgtcaccagctgtggtgagagtgaggcccagagtgggtcagggcttacctgctcaggttgtgcaattgggaggggtccatcaggagcccggagtcttcccactgggggctgagtctgggccctcagggcacatataggtagatgctgtcagacccgacaccccatgcagtgcagactgggatgctggtgcctgtggcacagactggtcagacccaccccaggctagacattccttgcagggagagctgaggctgctgacaccaggaacagacaaacaaggtcatcaccaggtaatgagcttgttacccacatcaggcaaggccattgctgggtaatgagttggcctcctgcagagccacctgcgctgggatggttcccagagatctggctagccagtgccacaggaggccggggcacagttccagggcctagtgggcaaggcaggggtattcagggacaaggtgcacctgagtccccacaggaagccccagaccctgcagtaagacctggaacaagtcattctcctctctaagctctcaaagaagaggtcagctcaggggtctgggaggcaaggtctcctagagtagactaagctggccgctgccatgctaacacacaccctcccagccagccgctggtcctgacagatgaggaaactgaggctaggtgttttcatgaggcctctgaacccagaacccagtacccagtgtcctgagcaaagcccaagccagacctgccagcttatgtgtacagaggccccactatgcagcctgcactcctggggcctaaaaggaccatcacctccccttctaagaggctgggcacaggggctgggtcccagccaggccacccttcctcctcctccaaaggcccagcagcagctgctcccagagcaagcagcacagtcgcagcaaaggctggacaagtgtcctgtgctctgtggtctgagcagagggccaggggccgtgacccacatggcccctccaggagcagctccaagatgagccttcctgtccccaccagtgtgtccgggacctcagggtggatcagccgcacctgccggctgctcctgttccttgctcttcctggggctccccaccacctttgggaggcagctccaagaccctgctgcctcccttgcttaccctcaggcccctgctgggtgtgccccctccccacacagacccctgagccagcttcgaggactctgcctgcatctccacgtccactctgatgactgtgaagctacagtcacactctccgcctccacccccgccctgccgggtccctgcagcagctctcagaggcccccacagcccctcccacacacagagctcgcctggccctgccgtctgagcgctcccctggctcccaaccgcccttgggctctgggacataaaacctccagccaaggtggctgccaagttttatttaatagccatagagcacaaaagggatgacaattaagtcacacggagagactgccccatcgggacccctggccaagctaagcagaggagccctggggtttcctctgaccccccactgtgaatgcattactgacgggcaaggtggccagttgcccacccagcctgcacgtctgcatgcacagagctacagcctgggcccagggacagccccgggagccggtggcttcccacaggcacagccagcctccccacccccaccatgcctggcccccggcccagggcacactgaggggaacaggaggggaaggagcaggccctgcactggagcctcagtcagctcctctgtgccaggggcagctggagctggctgaatttgaggaacttcccggaggaactggagagcagacctgtgtgcgcgccccgctctgccacgttccctgagggacacactgctttgaccagcccccaccccatctcctctccgccagtccccggtgtccaccccagccccgctaccgatgaagctcaagccagggtccccatcacctgcttcacggccatccctgcacttgagctcaggggctcagggttgtgctgacacgcctgcctgtccacccctcaccgacacctctgcagtcctcctcagggcccaacaggacccccaggaccccgctcccattctgcccttgctcctgccaacctgtcttctctatgcccatgactttggaaccctctgccacaagtgccagcccccacatctgtagcccctgcaggaacaagccctaatctggactcattgcaatggctcagcttctcttccaacctgtccataaacctccaggcagagatcacaaaactaacagctctttctgcaaatctggactctctcctgcaccttcttcaccgtccaggcctccctgtcatccgtcctggggacctcagagatctcttcatttcacaggtgaagacttggctcagagagggcagagcccctgggtcacacagcccgtctccagtagggctggggaaaagaacccagggcgctcttgttggcagtgttttaatgactggggggagggagagaatggctaatgaggctctagggatcagcacagccagctgctggaggtcccagaggacgggtgactcagcaggaatgggggagtctgaggggttgacagagtgcccaattctcacctcctcctgcaccttccagagagacgggctgcagggagtgattgagtggatgaacatgactagagggacccagtcttctcctcagcagctgcttgaggacagtattagcggtcccctcaatcccccccccaacacatgcacacatgcactgacctgcaggggccagatcccggtggacccggggacacagcttccaggggctgtcttgccatgtcccttcccagatctgcctggattcatgccaggccaccctccacaatttgctgagggaggccccagagtccagggcacccagagtgctaactagcccctgggggtacagggagaacagcatgctgtgtgggggatactactctctgcccatacctagggccctgtggcggccacaggcagcactgcttatgcagaggcactggggtgagaaggagtagggtgcagtagtgagggctccacagagggtggaagggctgcaggggaaggcagaccagcagggatgccatgagggcctcagatgccaggctgcagaggtggacgggctggccagctcctctccccagcctcctactgtaaaatgggagaggatcccagccctgctgattcatccactcactccatggcaagacagccactgacagctctgtcctggggcccacccgggcctggcctctgtgcaggctagcactcagtatgcttagtgccacactcggcccaggagaaatgacccagccctgggctcagagaccccacagtgggtggatggaaaacagtcatttaaatacaactgtgaagggtgctgtggaggaggggctcgaggtccccagtgtgggatggggtggtcatggaacgtttccctatctaagtgggaaaagtgagagccaccaggaaaatggcgggggtggggggggagaggaattatgcaaagacccagaaggatgaagaagactgttggattagaggaggttaaagacacagacaggcttggacatggtggctcatgcctgtaatcccagcactttgggaggccaagacaggaggatcacttgaggccaggagttcaagaccaacctgggaaacacagtgagaccctatctctacaaaaaaaaaaaaaattaaaaaaaattagccgggcatggtggtgcacagttgtagtcccatctactcaggagactgaggtgggaggatcgcttgagcccaggaggtggaggctgcagtgagctatgattgcaccactgcactccagcctgggcaacacagcaagatcctgtttgtaaaaacaaaacaaaacaaaacaaaaaacccagcttgagatggccagggatttccagaggccctaggcagaccgccttggagagtaagggagaccctgaagagctcccatggaagggccagcagcctggggctggagatgccacctggatggattcctccagctgtgtggactaggggacagggtgaggagataatggcctggactacatggaaggacgtcgccctgagccattgaaaagggctgtggggtccatgaccactcctggctttcccttgactatgatggagacagtagcttccagtgtaaaatgtgagctcagttcctgactcgtgtctagcgggtggtgcctggtctttggctggcgatgctccatgtcacctatgcccagaaactgggccatgccctttgtgaggacctgcccacaacgtcgtcgttcccgcagggtcccctgggaaccgggctgcccgagacccggccctgccggggttccctgcgccccagaccggaacccccagggctttggtcgttcccacagccgtcccgcgggccccctccacggtgcgtcgcctgggccccagcggtcgctaggctgcagcctggggctcccggccatcccgggcgctggcggcggtggaggcagcagggcggatggcggagcccggccgcccgtgggcccaggcgcgtagtgcgtacagagccagcgaggtgctgcggcgcggcacgggccgccggcgggatccggggccgcaatccaatgggccgggccaggaagacgcccgagccccgggccggatggctcgcctgcgcggccagctccgggccgaagcggcttcgcggtccgaggtgccgcggctgctgaagctggtggagcgtgcgggggccggggcggccgggcgcgggcgagaggaccggcgcgcacagccgcgggctccgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagccccgcgccgtcccccgcgccgcgccccgcggcccgaccctgccgcggacgctcggcaccgtgagcgccctggtcgccgcctccaggcccgcagacgacgccccggacggcccagcagaatgcggagcgcaccgagccccggccaggaagaaccacaagaagatgccagtgccgcctggggccccgcaaggtggcggggactgagggcggccgcacaagggcagcctaggcgagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaac

SEQ ID NO: 678 - DNA, 19778 bp, Homo sapiens; identical to SEQ ID NO: 677

SEQ ID NO: 679 - DNA, 6204 bp, Homo sapiens
cgagccccgcccgagccgggcggagcggagcgcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggagttcttgctgtcgacatctttgacaagttcaacttcacgggagccagagtcccatggttcgacgccattcatgaagaattccccagggagctggagtcctccatctccttcccagccaacttcttcaaaccacctgaagaaaaagtgcttaggtagaggttgagcatcctaatcctgaaatctgaaatgctccagaatctgaaccttcttgagcaccaacctgacacttaaaggaagtgctcattggaggatctgtgacaattactaaaaacttccccaaataaaaaggacatgaaaagaatctcacgctatcgcccaggctggagtacagtggcgcgatctccgctcactgcaagctccgcctcccgggttcacgccattctcctgcctcagcctcccgagagtagctgggactacaggcgcccgccaccacgcccagctaattttttgtatttttagtagagacggggtttcaccgtgttagccagaatggtttcgatctcctcacctcgcgatccatccgcctcagcctcccaaagtgctgggattacaggcgtgagccaccgtgcctggccctcatgtgtcttaaaaagaggggtgactctgatgtggggtcatgcttgaaactgagaggacgaggtccccgaccctccattgcagccagctctctctggaactaacagagtgagaactcgctcattaccaaggggaggacaccaagccattcatgggggacccacccccatgacccaaacaaccccgaccacgcccacctccaaccctgatcacatttcaacatgagatttggaggggccagacctcaaaactgcatcagatacattcatgtttaagcagtccatctccagaactcttttcatcctgcagatctgaaactctagcccacaaaacaccaactccactccccagccactggtgcccaccgttgtttctgtctctgaatttgactcctctagggacctcccataagtggaatcatacaatatttgtccttttgtgcttggcttatttcactgagcgtaatgttctctaggttcacctgtgttgtagcaaacgtcagactttccctccttttgaaggctgagtaatattctgttgtgtggatggagcacgcattgtttatccactcacctgttgacgcatgcctgggtcgtttccacctttcggcctgtgtgaatggtgctgctctgaacaggggtgaagacgtatctgggcgtctgctttcagttcttttgggtgtatacccagaagtgggcttgctgggtcacgtggtaaatcctgtggttgattttttgaggacgcaccatactgttttcggtgggacatctgttgggttttgagaagcacctgctggcactgagagctgtcttggggaacacaggtgctcctgccggagtcctcacgctctgctcacgttgcagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcgctttgaacgaagcaaatcaaccaattaaaaaaatatattccaggattggccagagtctgtgaagatttccataacaaatccccgttacaagggttttcagagagccctggttgtgcattaaaccccgcgatggcaaacccaaagctcaggctctgaggagctcttggagtctgcccctcgcttcagagatggtctgtgcgagggtgccgctctcctcccgctttgatcataaggaaggtgacagctgctggggacggtaggcactctccctcagggccacaagctgggctgcaggataaaagactgggcggctaatgtttaacctctggcattttaagcggcctgggagtgtgagccggccattgtgggcctgcagatgaactggggagtggcccgagtgctgtcctcggcaggacagtgctatccagccaggaagtgggtggcagccagcctgggagtggcctatgtgggaccctcctgtctaggagtcagagccagaggcctgggtggcctcccctggcccctccccagggctgcgctgtagctcaagggcccaggccaccatccttcccgagggctttctgatgtgaagtggccctggtttctgtcacagtcttggaaggaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaac

SEQ ID NO: 680 - DNA, 6204 bp, Homo sapiens; identical to SEQ ID NO: 679

SEQ ID NO: 681 - DNA, 6204 bp, Homo sapiens; identical to SEQ ID NO: 679

SEQ ID NO: 682 - DNA, 1170 bp, Homo sapiens
cgagccccgcccgagccgggcggagcggagcgcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaac

SEQ ID NO: 683 - DNA, 1170 bp, Homo sapiens; identical to SEQ ID NO: 682

SEQ ID NO: 684 - DNA, 18135 bp, Homo sapiens
ctgggccggagcggcggcgcctggatgccggcccggggctgggccggagactggcgcccgccccgaagcgactttcggtccccgacccgctccgcctgacccctatgatgaagagggcgtccactggagaacatcatccactcgggcagtgccctcctggccccggccaccagggcagcgtgggagcagatccagcggagcgagggtggcacggcacagctgctccggcgcctcgagggctacttcagcaatgtggcacgcaacgtgcagtggacgtacctgcagccctttgtcatcgtcaccaccaacatgattcttgctgtcgacatctttgacaagttcaacttcacgggagccagagtcccatggttcgacgccattcatgaagaattccccagggagctggagtcctccatctccttcccagccaacttcttcaaaccacctgaagaaaaagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcgctttgaacgaagcaaatcaaccaattaaaaaaatatattccaggattggccagagtctgtgaagatttccataacaaatccccgttacaagggttttcagagagccctggttgtgcattaaaccccgcgatggcaaacccaaagctcaggctctgaggagctcttggagtctgcccctcgcttcagagatggtctgtgcgagggtgccgctctcctcccgctttgatcataaggaaggtgacagctgctggggacggtaggcactctccctcagggccacaagctgggctgcaggataaaagactgggcggctaatgtttaacctctggcattttaagcggcctgggagtgtgagccggccattgtgggcctgcagatgaactggggagtggcccgagtgctgtcctcggcaggacagtgctatccagccaggaagtgggtggcagccagcctgggagtggcctatgtgggaccctcctgtctaggagtcagagccagaggcctgggtggcctcccctggcccctccccagggctgcgctgtagctcaagggcccaggccaccatccttcccgagggctttctgatgtgaagtggccctggtttctgtcacagtcttggaaggaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacaggaacaagacgaggatgcccgttctcaccacttttattagacatcacacaaatatgcaagagaaaaaaataaaagccacccacactggaaaagaggacatcaaattatccttgtctgatgaagatgtgatcttggatttacaaacatgtaaagcctccaccagaaaactctagacttgataaataaattaatacagtcatttgcaggatacaaaatcaacatacaaaaatcagcagcattttatacaccaataatggtctaggaaagaaattaaggaggcaatcccatttacaatagcaacaaaatgaaaaatgatatgccacagaggaaattttaccaaggaggtgaacgatttctacaaggaaaactacaaaacactgatgacaaagtttaagaggacggaaagaaatggacagtcatttcatgctcatggaaggaattcatagcattaaaatgaccacactgcccagagcagtctagagattcaatacaacccctaccaaaataccagtgtcatctctcacagaactggaaaatcgtaaaactcatatgaaaccaaaaaagagctcaaagagccaaagtcatcctcagcaaaaacaacaaaactagaagcaccccatttcactgcaaattagaatgacaaaatttttgacaagtgcatggtaaccaaaacagcatggtcctagcataaaactagacacatagatcaatgggacggatgacagagcccagaaagacagccacatagtcttggggcttgtgtctctcctgctgtgcatccatgctgggtgctttacatacaacaggcagacaagaagtccctgttgcaagtgaggacaaagtgtgggaaggccgtgagggtctgcagtcccagatggccttggcctcaccccgcagtgcgcttttgcaccagagtgccaccttcttctccaggtccaggtcttcagcagtgaccccagaccccagctgtaagggaggtggcagcatcagaggctccccttgcctgagtggcagcagaggaaacttgcatctatggggcctagaggcctgggatgtgggggagccattcctgggggcaagtgtctgccctggtgctgcatctgctgccttttcacactgggtgagaccccaagagacagcctgaggccggtcctcactcactgtctttgaggacctgaggggcagctgacagtgggatgaggctggccccctcctctttggtgacaggaagcctcccatggaactgtaggagctcacgatggcattttgtttggtgcacgaactcatccaggaggtctgggatctctggttttatccgacttctgacctctgggcatggaggtctctctgcagaggcccaggcctgggcacgaagggagagaggcctccattgtcccacaggggcctaaatgcagactgtgcatccccggtgccctcaggaacccttctctgatcatcaggattctcttggactctggggtccttgtcctgctcaggcatccctgcccccctcttcaggagggccctcaacacgatcttctctggacaggagtctggggcacaactggatgttgtgggccccaaaggggtgactccctgctcctgggccccacagagagtccttgtgctcagtgcactggctgagctgcaagacatcctggaattgggagcacacagcaccggcttgctgtggtacctgtgcattcaaattgaaggcaggatcgccagcaaggaacacagggcttgcaggatcacagaaaacccttggagttgttttgacacaccactgatgccaagtgtctgggtacttgtaggatggccctgccattccatccaggggcagtggcaacagggagattccacaaacaaagtgaactgggggatgggatgagcaggctccaggcaactgagccctactggcaggcccttggcccccggggccgggacaggggtgacagacacagagtgcccaggtaaccactcctgggagcagtggggaaccgtcggatgcttcaactcttgagagctgggctctaagcatccgccttagctgccaacttggccaaaggctatgcgagcagtttcccgttgacgggcaatgcatctttccaacctgagcgagtgggtgtgtgtgcaaagatggtgcgagtcacggatctgcgcaggaagggtgactttaagggattagcatggccaggtatgcacacaaggcacctgctggcaatgccttggtggggagcgggcagtgcacacaagaggtactggagggagaggcgcgcgggaagaacaggcgcgcacaatggctgcagatccacctgtggatcgctgaagattcctgctgagggttgaggctgctgggctggaggactgtatggtccatgcattgtaatgtccccttctctccctggcccggagccccaagagctatccggactctctccaagacctggttctggcccagcaaagaggtctcggcaggggagcaggattcccggcccagcagctggctcaggaggtgacagctttgggattcgcatctgagcatcctcctactcttctcctgggaactctgttggggagggttgctcagaacagaagtgcctgggacgcccagatcctgctggagtggcagctggggtgatggccagggcaggctgggagggacatactttccataggacccagtgctttcatctccgtgcaactgaccaagagaaaccaaacccaaactccttcctttacacagacctatttgagggaggctgggtattgtttgtgtatttcaacctaacaagattttgagatagttggaatgcagaaggagacaggaggactcaagtgtcctgtcttttgcaaaaatgtcaaacgtagctactcagtctcttttttgtttttttgtttgttttgaagactatggttattttgcaaaatatatattatttgagtttctctaggtgctatttttagataaattaatatacttttttcatcagcacatgaaacgttcttcaaaacagatcctttgttagtccacaaaagctgtccctacacattttaggaaatcataatcataatcattccaaagatcagacaacagaggaataaacctagaaatggacatcaaggcaaactacagaacctatacgcatacatgaaaattaaaccccaccctcctgaatgagcactgattcaatgaagaaattaaaatgaaaatccgaaaatgttttcaaacaaatgaaaatggaaacatcatataccaaaagcctttggattcagcaaaatcagtgctgtgagggaaggttgtagcaataaatacctacatccaaaaagtagaaagatgaaaaattaataaacttatgatgcaccttaaagaactagaaaagcaagaacaaagcaaaaccaaaattagcccatgaaaaaaataataaagatcagaggagaactaaataaaatagggtctcaaaaacaacacagaaatcaagaaaaggaattactggttcttagcaagaaaaacacactttgggtatttcctttttttttttttttttttttttgagaaagcttttttttttgagaaagcgttttgctcttgttgcccaggctggagtgcagtggcaagatctccactcaatgcaagctccaccttccaggttcaagtgattctccttcctcagtctcctgagtagctgggttacaggtgctaaccaccatgcccagctaatttttgtatttttagtagagacggggtttcaccatgttggtcaggctagtctcaaactcctgacctcgtgatctgcccgtgtcgtctcccaaagtgctgggattataggtgtgagccaccgtgcctggcctcaaaatattcttttgagggactcttgcatacaagccccaagaggcaggtgcaaaaatgtccatagaaacacagtaatagaaaaaaagaaaatccagactgattcaaatgtccattaacaggagaatgaataaattagttggaatcttcttttcttttcttttcttttcttttttttttttttgagacggagtttcgctcttgttgcccaggctggagtgcaatggcacaatctcagtttgtggcaacctccgcctccggggttcaagccattctcctgcctcagcttcctgagcagcagggattacaggcatgcgccaccacacctggctaattttgtatttttagtagagacggggtttctccgtgtttgtcaggctggtctcaaactccggacctcaggtgatccgcccgcctcggcctcccaaagtgctgggattacaggcgtgagccaccactcctggccattagttggagtcttcttatacagtggtgagactgaatcagccacagttgcacaacagaatggatgaagcttagaagtaatgttgggtttaaatggccagtcccaggctgttacatttaccatttgcaataacaataggaactaaggtaactgaagaatctaacaaaaactatgcaagacctgtatagaaaaattataaaacttgattgaaagacatttaaaaaatctaaataagagagataatacataatctactctttgtggattgggagattcagtattataaagttgtcgattctccccaaattgttctacagatttaatgcaaatccagtaaaaaattcaacaagaggctgggcgcggtggctcaagcctgtaatcccagcactttgggaggctgaggcaggcagatcacaaggtcaggagatcgagaccatcctggctaacatggtgaaatcccgtctctactaaaaaaaaaaaaaaaaaaaaaaatgagccaggcgtggtggcgggtgcctgtagtcccagctactcaggaggctgaggcagggaatggtgtcaacccaggaggcagagcttgcagtgagccgagatcgagacactgcactccagcctgggcgacagagcgagactctgtctcaaaaaaaaaaaaaaattcagcaaggggtgtgtgtgtgtgcctgtgtgtgtgtgtgtgtgtgtgtgtatgcaagccatagacagaatactttttttttctttttgagacagagtctcactctgtcgcccaggctggagtgcagtggctcgatcttggctcactgcaacctccgcctcccaggttcaagtgattctcctgtccctgcctcctgtgtagctgggattacaggtgtgcaccaccacatctggctaatttttgtatttttagtagacacagggtctcaccatgttggccaggctagtctccaactcctggccgcaagtaatctgcccacttcagcctcccaaagtgttgggattataggcgtgagccaccgagcccagctagtacacagaataccattttttacttaagtatattaatctagaagagttttttttaaaatacagtataccatttttatctataacacttaaagacaatcaaagccaaattatgctgtttcaagataccatatacttagaaaaacatctataaaaagcaagagaaacatacaaatcaggcccatctggagagaagggagtgaagcattgcgctgatacggggataaatatgctggttgggtagacaggcagtccttatgcttttggctgacgtagatgttacgtactatttcatgtgttatcacactctccagtaaacacgtaacataagagaataattaaccactatcaagcgttctcatcttgagacaggaagatgtagaggaaagaccttgatgtgtgtgtcagttacaaggatgtacaccagtgactgacatgacttggtgcaaatcttgggtagagacctatacttaagctcctcacccccacctgccgaggcgtaagggctcagagggggttccatggggtgggcgggagtggtaagggtcgaggtgcagccacagcctggctctgtgcacaccccctccctccccctggtcccatgtgcacaccctctccctgccccctgccccttgtgcacaccctctgtaccccccttcccgccccagcctgtgtttgcagtgctacagggtggctgcagcctttgcctcccacagctcctcaaggtcagagggctgggaacccctgggatgtggctgggatgaggaccctgcccctcctcaggcatttccaggcaaggggcacagagacacagccagcccagcagctgagcccctcctatcaggccaggtgggaaactgaagcatgaacacaaccccagactggaaataaaaagccgtcatgtactgtgtgcctactgaatgccaagccctatgccctattctttaatgtcatctttaatgagatgtcttcactcagttcaccacatgatagtagacaggtatttatgatgcgcctactgcatgctgggcacttttctgggccatgaggactcagggaggtccctgctctggtagaagtcaaacccgacaggagacagagactaggggcccacacaccaggaggaagaacccagtgcagagagtgccagcaggaagccacaggggcagggaaggcgctcctgggagggtgggtggctgcgtcctgaggctgagcagggggagctggcctcgggacaggatgtgcgcaggcgtggagcaggaagttcctggaatgatgggcaagagggagcaggtcactgggggcaggtctaaatactgggggctgcattgggatagcagaggcctcggacaggcccgctcagcatgtagactcccctccctggccccttccctaggatgacagtggaggtccatccccaggtggtggtgagggcaatcctgacacagagaccccagcccagctggcaggggaaggggagcccccaaggacccctgtatgttggggcgtgtcccgccaggcggccctccatggtgcccagcagcagccctgcttgcggaccctctttagtccccactgttaaaaaaataattcagtgaaaattgacactagctgggcatggtggtaggtgcctataatcccagctactcgggaggctgagacgggagaatcgcttgaaccagggagtcgggaggttgcagtgagccgagatggcgccactgcactccagcctgggtgacagagtgagactccgtctcaaaaaaaaaaaaaagaaaaaaggaaaaatgacacttgccaaagcgctgtagggaagactgtccaggaccgtgtcactaggcataagggaccacggtgatgagattctgcagtgggtaagagactgggctcagcctcgaatacagcatgggcaagtgggatcggaccgtcaaggagcagggggaagactatccaggaccgtgtcactaggcataagggaccacggcgatgagattctgcagtgggtaagagactgggctcagcctcgaagacagcatgggcaagtgcgatcggacagtcaaggagcagggtggggggcagcgcatggaaagtgactaagaggaagcatcagcagccagggattctggcttaactcccctaacagaattcttgctgaaggccggccaggatggccagaccgcacctgggggacagagggggaacccgatcagatgtcaaggacggggggcttctcgctaaactgactttgcaggattcttgctaaaactagagtttataaggaagtgctcagatgtgcctaggagaaggctcaggagcctaaataaagcttgaccaagcagagaatctttgtcaccagctgtggtgagagtgaggcccagagtgggtcagggcttacctgctcaggttgtgcaattgggaggggtccatcaggagcccggagtcttcccactgggggctgagtctgggccctcagggcacatataggtagatgctgtcagacccgacaccccatgcagtgcagactgggatgctggtgcctgtggcacagactggtcagacccaccccaggctagacattccttgcagggagagctgaggctgctgacaccaggaacagacaaacaaggtcatcaccaggtaatgagcttgttacccacatcaggcaaggccattgctgggtaatgagttggcctcctgcagagccacctgcgctgggatggttcccagagatctggctagccagtgccacaggaggccggggcacagttccagggcctagtgggcaaggcaggggtattcagggacaaggtgcacctgagtccccacaggaagccccagaccctgcagtaagacctggaacaagtcattctcctctctaagctctcaaagaagaggtcagctcaggggtctgggaggcaaggtctcctagagtagactaagctggccgctgccatgctaacacacaccctcccagccagccgctggtcctgacagatgaggaaactgaggctaggtgttttcatgaggcctctgaacccagaacccagtacccagtgtcctgagcaaagcccaagccagacctgccagcttatgtgtacagaggccccactatgcagcctgcactcctggggcctaaaaggaccatcacctccccttctaagaggctgggcacaggggctgggtcccagccaggccacccttcctcctcctccaaaggcccagcagcagctgctcccagagcaagcagcacagtcgcagcaaaggctggacaagtgtcctgtgctctgtggtctgagcagagggccaggggccgtgacccacatggcccctccaggagcagctccaagatgagccttcctgtccccaccagtgtgtccgggacctcagggtggatcagccgcacctgccggctgctcctgttccttgctcttcctggggctccccaccacctttgggaggcagctccaagaccctgctgcctcccttgcttaccctcaggcccctgctgggtgtgccccctccccacacagacccctgagccagcttcgaggactctgcctgcatctccacgtccactctgatgactgtgaagctacagtcacactctccgcctccacccccgccctgccgggtccctgcagcagctctcagaggcccccacagcccctcccacacacagagctcgcctggccctgccgtctgagcgctcccctggctcccaaccgcccttgggctctgggacataaaacctccagccaaggtggctgccaagttttatttaatagccatagagcacaaaagggatgacaattaagtcacacggagagactgccccatcgggacccctggccaagctaagcagaggagccctggggtttcctctgaccccccactgtgaatgcattactgacgggcaaggtggccagttgcccacccagcctgcacgtctgcatgcacagagctacagcctgggcccagggacagccccgggagccggtggcttcccacaggcacagccagcctccccacccccaccatgcctggcccccggcccagggcacactgaggggaacaggaggggaaggagcaggccctgcactggagcctcagtcagctcctctgtgccaggggcagctggagctggctgaatttgaggaacttcccggaggaactggagagcagacctgtgtgcgcgccccgctctgccacgttccctgagggacacactgctttgaccagcccccaccccatctcctctccgccagtccccggtgtccaccccagccccgctaccgatgaagctcaagccagggtccccatcacctgcttcacggccatccctgcacttgagctcaggggctcagggttgtgctgacacgcctgcctgtccacccctcaccgacacctctgcagtcctcctcagggcccaacaggacccccaggaccccgctcccattctgcccttgctcctgccaacctgtcttctctatgcccatgactttggaaccctctgccacaagtgccagcccccacatctgtagcccctgcaggaacaagccctaatctggactcattgcaatggctcagcttctcttccaacctgtccataaacctccaggcagagatcacaaaactaacagctctttctgcaaatctggactctctcctgcaccttcttcaccgtccaggcctccctgtcatccgtcctggggacctcagagatctcttcatttcacaggtgaagacttggctcagagagggcagagcccctgggtcacacagcccgtctccagtagggctggggaaaagaacccagggcgctcttgttggcagtgttttaatgactggggggagggagagaatggctaatgaggctctagggatcagcacagccagctgctggaggtcccagaggacgggtgactcagcaggaatgggggagtctgaggggttgacagagtgcccaattctcacctcctcctgcaccttccagagagacgggctgcagggagtgattgagtggatgaacatgactagagggacccagtcttctcctcagcagctgcttgaggacagtattagcggtcccctcaatcccccccccaacacatgcacacatgcactgacctgcaggggccagatcccggtggacccggggacacagcttccaggggctgtcttgccatgtcccttcccagatctgcctggattcatgccaggccaccctccacaatttgctgagggaggccccagagtccagggcacccagagtgctaactagcccctgggggtacagggagaacagcatgctgtgtgggggatactactctctgcccatacctagggccctgtggcggccacaggcagcactgcttatgcagaggcactggggtgagaaggagtagggtgcagtagtgagggctccacagagggtggaagggctgcaggggaaggcagaccagcagggatgccatgagggcctcagatgccaggctgcagaggtggacgggctggccagctcctctccccagcctcctactgtaaaatgggagaggatcccagccctgctgattcatccactcactccatggcaagacagccactgacagctctgtcctggggcccacccgggcctggcctctgtgcaggctagcactcagtatgcttagtgccacactcggcccaggagaaatgacccagccctgggctcagagaccccacagtgggtggatggaaaacagtcatttaaatacaactgtgaagggtgctgtggaggaggggctcgaggtccccagtgtgggatggggtggtcatggaacgtttccctatctaagtgggaaaagtgagagccaccaggaaaatggcgggggtggggggggagaggaattatgcaaagacccagaaggatgaagaagactgttggattagaggaggttaaagacacagacaggcttggacatggtggctcatgcctgtaatcccagcactttgggaggccaagacaggaggatcacttgaggccaggagttcaagaccaacctgggaaacacagtgagaccctatctctacaaaaaaaaaaaaaattaaaaaaaattagccgggcatggtggtgcacagttgtagtcccatctactcaggagactgaggtgggaggatcgcttgagcccaggaggtggaggctgcagtgagctatgattgcaccactgcactccagcctgggcaacacagcaagatcctgtttgtaaaaacaaaacaaaacaaaacaaaaaacccagcttgagatggccagggatttccagaggccctaggcagaccgccttggagagtaagggagaccctgaagagctcccatggaagggccagcagcctggggctggagatgccacctggatggattcctccagctgtgtggactaggggacagggtgaggagataatggcctggactacatggaaggacgtcgccctgagccattgaaaagggctgtggggtccatgaccactcctggctttcccttgactatgatggagacagtagcttccagtgtaaaatgtgagctcagttcctgactcgtgtctagcgggtggtgcctggtctttggctggcgatgctccatgtcacctatgcccagaaactgggccatgccctttgtgaggacctgcccacaacgtcgtcgttcccgcagggtcccctgggaaccgggctgcccgagacccggccctgccggggttccctgcgccccagaccggaacccccagggctttggtcgttcccacagccgtcccgcgggccccctccacggtgcgtcgcctgggccccagcggtcgctaggctgcagcctggggctcccggccatcccgggcgctggcggcggtggaggcagcagggcggatggcggagcccggccgcccgtgggcccaggcgcgtagtgcgtacagagccagcgaggtgctgcggcgcggcacgggccgccggcgggatccggggccgcaatccaatgggccgggccaggaagacgcccgagccccgggccggatggctcgcctgcgcggccagctccgggccgaagcggcttcgcggtccgaggtgccgcggctgctgaagctggtggagcgtgcgggggccggggcggccgggcgcgggcgagaggaccggcgcgcacagccgcgggctccgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagccccgcgccgtcccccgcgccgcgccccgcggcccgaccctgccgcggacgctcggcaccgtgagcgccctggtcgccgcctccaggcccgcagacgacgccccggacggcccagcagaatgcggagcgcaccgagccccggccaggaagaaccacaagaagatgccagtgccgcctggggccccgcaaggtggcggggactgagggcggccgcacaagggcagcctaggcgaggtctcagtgaggaggcagggtctccacgcactggaatagtgtcaaaccacacacaagagcacagaacccagggacacagggcggctgagacactcagctggtgatggtcctcaggatggtgtcaaccagtatgtaatcacattccacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaac

SEQ ID NO: 685 - DNA, 2794 bp, Homo sapiens
gccgggccggggctgggccggagcggcggcgcctggatgccggcccggggctgggccggagactggcgcccgccccgaagcgactttcggtccccgacccgctccgcctgacccctatgatgaagagggcgtccactggagaacatcatccactcgggcagtgccctcctggccccggccaccagggcagcgtgggagcagatccagcggagcgagggtggcacggcacagctgctccggcgcctcgagggctacttcagcaatgtggcacgcaacgtgcagtggacgtacctgcagccctttgtcatcgtcaccaccaacatgattcttgctgtcgacatctttgacaagttcaacttcacgggagccagagtcccatggttcgacgccattcatgaagaattccccagggagctggagtcctccatctccttcccagccaacttcttcaaaccacctgaagaaaaagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcattgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcgctttgaacgaagcaaatcaaccaattaaaaaaatatattccaggattggccagagtctgtgaagatttccataacaaatccccgttacaagggttttcagagagccctggttgtgcattaaaccccgcgatggcaaacccaaagctcaggctctgaggagctcttggagtctgcccctcgcttcagagatggtctgtgcgagggtgccgctctcctcccgctttgatcataaggaaggtgacagctgctggggacggtaggcactctccctcagggccacaagctgggctgcaggataaaagactgggcggctaatgtttaacctctggcattttaagcggcctgggagtgtgagccggccattgtgggcctgcagatgaactggggagtggcccgagtgctgtcctcggcaggacagtgctatccagccaggaagtgggtggcagccagcctgggagtggcctatgtgggaccctcctgtctaggagtcagagccagaggcctgggtggcctcccctggcccctccccagggctgcgctgtagctcaagggcccaggccaccatccttcccgagggctttctgatgtgaagtggccctggtttctgtcacagtcttggaagggcccattctgaaagaaaaaggaagttctcgtcgcagaaagaaaataataccaaagggaaacaaaatttcaagaaggaataaagaacagtggaagagtaaatatgaagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaac

SEQ ID NO: 686 - DNA, 2794 bp, Homo sapiens; identical to SEQ ID NO: 685

SEQ ID NO: 687 - DNA, 13853 bp, Homo sapiens
ctgggccggagcggcggcgcctggatgccggcccggggctgggccggagactggcgcccgccccgaagcgactttcggtccccgacccgctccgcctgacccctatgatgaagagggcgtccactggagaacatcatccactcgggcagtgccctcctggccccggccaccagggcagcgtgggagcagatccagcggagcgagggtggcacggcacagctgctccggcgcctcgagggctacttcagcaatgtggcacgcaacgtgcagtggacgtacctgcagccctttgtcatcgtcaccaccaacatgattcttgctgtcgacatctttgacaagttcaacttcacgggagccagagtcccatggttcgacgccattcatgaagaattccccagggagctggagtcctccatctccttcccagccaacttcttcaaaccacctgaagaaaaagtgcttaggtagaggttgagcatcctaatcctgaaatctgaaatgctccagaatctgaaccttcttgagcaccaacctgacacttaaaggaagtgctcattggaggatctgtgacaattactaaaaacttccccaaataaaaaggacatgaaaagaatctcacgctatcgcccaggctggagtacagtggcgcgatctccgctcactgcaagctccgcctcccgggttcacgccattctcctgcctcagcctcccgagagtagctgggactacaggcgcccgccaccacgcccagctaattttttgtatttttagtagagacggggtttcaccgtgttagccagaatggtttcgatctcctcacctcgcgatccatccgcctcagcctcccaaagtgctgggattacaggcgtgagccaccgtgcctggccctcatgtgtcttaaaaagaggggtgactctgatgtggggtcatgcttgaaactgagaggacgaggtccccgaccctccattgcagccagctctctctggaactaacagagtgagaactcgctcattaccaaggggaggacaccaagccattcatgggggacccacccccatgacccaaacaaccccgaccacgcccacctccaaccctgatcacatttcaacatgagatttggaggggccagacctcaaaactgcatcagatacattcatgtttaagcagtccatctccagaactcttttcatcctgcagatctgaaactctagcccacaaaacaccaactccactccccagccactggtgcccaccgttgtttctgtctctgaatttgactcctctagggacctcccataagtggaatcatacaatatttgtccttttgtgcttggcttatttcactgagcgtaatgttctctaggttcacctgtgttgtagcaaacgtcagactttccctccttttgaaggctgagtaatattctgttgtgtggatggagcacgcattgtttatccactcacctgttgacgcatgcctgggtcgtttccacctttcggcctgtgtgaatggtgctgctctgaacaggggtgaagacgtatctgggcgtctgctttcagttcttttgggtgtatacccagaagtgggcttgctgggtcacgtggtaaatcctgtggttgattttttgaggacgcaccatactgttttcggtgggacatctgttgggttttgagaagcacctgctggcactgagagctgtcttggggaacacaggtgctcctgccggagtcctcacgctctgctcacgttgcagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcgctttgaacgaagcaaatcaaccaattaaaaaaatatattccaggattggccagagtctgtgaagatttccataacaaatccccgttacaagggttttcagagagccctggttgtgcattaaaccccgcgatggcaaacccaaagctcaggctctgaggagctcttggagtctgcccctcgcttcagagatggtctgtgcgagggtgccgctctcctcccgctttgatcataaggaaggtgacagctgctggggacggtaggcactctccctcagggccacaagctgggctgcaggataaaagactgggcggctaatgtttaacctctggcattttaagcggcctgggagtgtgagccggccattgtgggcctgcagatgaactggggagtggcccgagtgctgtcctcggcaggacagtgctatccagccaggaagtgggtggcagccagcctgggagtggcctatgtgggaccctcctgtctaggagtcagagccagaggcctgggtggcctcccctggcccctccccagggctgcgctgtagctcaagggcccaggccaccatccttcccgagggctttctgatgtgaagtggccctggtttctgtcacagtcttggaagggtgagtcagccctggggcagggctggaggagggctgtggcttcctgtacaatgtgcgggggaagctgtcccacctgtgcccccatctcatgggcaaatggcactccccagcaggacccagcctggagaggggttcagtgattagtggactttgttcatagaagggcagggttgggggttgtctcgtggccaggacgccgggcaacatgtgggccaaggaagctgaaattgaggcggaaggaaggaggctggagtgggagtccgaggctcccatggcctgggtgccccaaagttagcggtctctgaacagccctgaaccagtggagggagactggggtgctgctcctggccccagggatgtccagggcccgggcattgaagggacctcagaaggggcagttccaggcccagggctgtgagcactcggcctccccaacccagccaggtcttggcttcccagctcctagttccacatggtaagcaacgccttccagaagttaccagagaaccagagcttgttgttccccaaatgcagaaactccccagggacctgggtcctgggcaagtgtcctggtttgtaaaagcacaggaaacacagcaatgtgaacctacacactgctgaactgtacgcttcaaagtgtccaagatgatatgttttatgtcatgtatattttagcacaattttcctttttttgttttttgacacagttttgctcttttcgcccaggctggagtgcagtggtgaaaccttggctcactgcaacctctgcctcctgtattcaagtgattctcttgtcttagccttccaagcagctgggattacaggctgcaaccaccatgccgagctaatttttggatctttagtagagacggggtctcaccatgttggccaggctggtctcaaactcctgacctcaggtgattgacctgcttcggcctcacaaagtgctgggattacaggtgtgagccactgtgcccagcctgttttttaaagacatgttcactgcctgtaagaaatgcataataaggtggggtgtggtggctcacacttgtaatcccggcactttgggaggccgaggtgggcagatcatttgagctcacaagttcgagaccagcctgggcaacatggcgaaaccctgtctctaccaaaaatacaaaacttagccaggcatggtggtgcatgcctgtagtgccagctacttggcaggctgaggtaggaggatgacttgagcctaggaggcagaggctgcagtgagccaagattgtgcctctgcaacagagccagaccctgtctcaaaaaaaaaaaaagcataataagggatctggaatttaaaaaataggtccatataacaagctataatagagacgtgcagctggcacaggacatccatccactggtgataatgatagaacacgtcatattgcacgatagtaggaaaaacaggacagatgggaagggtgcggatgaccagcgccgtagcaatctgaagcatcgagcctgccagtccacataactgaaacctgaagctctgcccctgcccagctctgtgacttccagcaagttgtttagcttctttaagcattgattttctcacctggaagatgagggttgcattcacactctcttcatagctgtgacctaaggatgatatgaaacgacgcccttggcagatctatcagaacccctaccacataataagtgctcagtaaaaggttttgctgaacaaaggaaattacattcatgttgtattaccacaattacccactttctttataaagcggtagtaagtctttcagccaaaagaataagtccatgatgggattaagtgaaagtccaagaggtactgcatgcacctaaggtggagatgtgtttatcttttgcataagctggggatgtatttggaaggtttctgctagcccagaatttgggtggacaggctgagcccctcccaacagcaggattcacctatggggttggttttgggtagacaggctgagcctgccccatggaactgtaggggcttacgaaggcatttcgtttggggaaggagctcatccaggaggactgggatctctggttatatgtgacttctgacctctgggcatggaggtctctctccagaggcccaggcctggacacgaagggagagaggcctccattgtcccacaggggccgaaatgcagacggtgcatccccggtgccctggggaacccttctctgatcatcaggattctcttggactccggggtccttgtcctgctcaggcatccctgccctgctgtccttcagggccctcaacacgatcttctctggacacgagtctggggatagccgggtgttgtgggctccaaagggttgactccttgctcctgggccccacagagagtccttgtgctcagtgcactggctgtgctgcaagatatcctggaattcgaagcacacagtgctggcttgctgtggtacctgtgcaatcaaattgaaggcaagatcaccaggaaggaacacagggcttgcaagatcacggaaaaccttcttggagttgttttgacacaccactcatgtcaagtgtctgggtacttgtaggatggcccgccactccacccaggggcaggagcaacagggagatcccacaagcaaagtgaactgggggatggggtgagtgggctccaggcaacagagccctactggcaggtcctcaccccctgggccggaactggagtgaggggcacagagtgcccaggtaaccgctcctgggaacagtggggaactgtcagatgctcgaactttcgagagctgggctctgagcgtcctcgtggagctgccaactcggccaaaggagaagcgagcagtttcttctgttgccgggcaacacgccttttaaacctgagcgagtgggtgcgcatgcaaagaacgggcgcgagtgacagagcgaccttaacggattagcaccttaacggattagcaccttaacggattagcgtggcaaggtatgcaagcaagtcacctgctggcaatttgggggtggggagggggaggtgcgcaatacatactggaaggagaggcacccacacaaaggacgcaggaagaacaggtgcgcacaaaggcacaatggcggcagatctgcccgtggatcactgaagattcctgctctcctgctgaggtggagattgcagtgaactaagatcacaccattgcgctagagcccgggcgacagagcaagacttggtctcaaaaaataaataaaataaaataagtacaataaaataacaaaacaaaacaaagtaagaggagatgatatctggtcgtgttttatggccatctggtaagctagattctttcctttggttttattgccaatcaatgattagaaagaagcagtttgctgttggcttgtttttcccctcaactaaatgtaagaaaaaaaaagagtcaaaaataccgaagctaattttaaaatgtatgtatagagagagacttggtcttaccttgtcatccaggctggagtgctgtggtgccatcacggctcagggcagcttcgacctcatgggctcaggcaatcctttcacatcagtcgaccagatagctgagattacaaatgtgggaaaccacaccctgctaatttcttgtattttttgtagagtcggggtttcaccttgttgccgaggctggtcttgaactcctgggctcaagcaatctttctgcttctgcctcccaaagtgttgggattataggcatgagccaccattcccgccgaaatatttttgagattcatagagatgagtaggtcataataagagtgcacaacttgtagttatatttaatatcttttgaaattactcggcacccccattgtaatttaaatgatttgttcctgacctggttttactttgttcctgagggttgcagatcccttgaacaatattccacgaatgaagcagtgataataaacctgcagctgccccgagggggcgctgtgcggaggttcacaaagggacctgggtctccctggtgcggatgcgggggccgcctccattctgctttctgacactgccaccgcggggccaggcttgatgtgaccccatcactgctcagttcactacacagtttcatcttttgatatggaagatttgactccatccacgttccttaggaggttactggaaatgacagcgctgtaaatttctgggtaaatgagcagccaacatttttgggagctgtcacacaaccacactgcccttccctctgcctgaaaacctttaggcctgattgactcggagaaagcccattaaactcagcccccactgacttgttcatttccactcaaacgtttgtgatagtcccaacacaaggcttgtcctccaagggacaacttgtaaacacttctaagagaaagggttgactgggcccggtgcctcacacctgtaatcccggcactttgggaggccgaggtgggcagatcacttgaggtcaagagtttgagaccagtccatgatcttggcttgaagaggcaagaccctatagtttattgaacattttaagcccactccttgatccatgagccgcagaatggatgttgtattagcaaaaatgaaaacaacattaatctccttgtatcatcattagagctcctggctgactggttacattgtcaatcaacagtaatattttgaaaggaacagtgggcttaaaatgttcaatatgctgtcaacagatgtgctgtcatccaggctttgttattccgtttatagagcacaggcagagtagatgtagcgtaactcttaagggccctaggattgtgggactggtgaatgagcactggcttccacttaaagtcaccagctgcttaggccctaatgagagagacagcctgtcctttgaagctttgaagccaggcattgacttctcctctgtagctatgaaagtcctagatgtcatcttttaatagaaggctgttctatccacattgaaaattgtcatttagtgtggccaccttcatcagtgatcttagctagatcttctgggtaacttgctgcagcttctgtatcagcacttgctagcttcgccttgcacttatatgttatggagatggcttctttccttcaatatcgtgagccaacctctgctagcttcaaacttttcttctgcagcttcatcaccaatctcagcattcatagaattgaagacagttagggccttgctgtggattcagctttggcttaagggaatgttgtagctggtttgatcttttattcaaggcaggaaaactttctccatatcagcaataaggctgttttgctatctatcatttgcgtattcactggtgtagcacttttaatttccttcaagaacttttcttctgcattcacaacttggctaactggcctagctttcagccttttggcttttgccgtgcctttctcaattcgcttaagcatttctagattttgatttaaagtgaaagatgtgggagtcttcgttttacttgaatacttagaggccattgtagggttactaattggcctaattttaatattgttatgtctcaaggaatagggaagcccaaggagagggagagagacagaatggctagtcagtggatctttcagaacacacacaactttatagattaagctcactgtcttatatgggcacagttcatggcaccccaaaacaattactatagtagcatcaaagaccactggtaatacatcaccataacagttataataataatgagaaagtttaaaatattgcaagaattaccaaacttgacctagagacattgaagtgagcacatgctattggcaaaatagtactaacagacttgtttgttacagggtagccacaaacccccaatttgtaaaaaacgcagtatctgtgaagcacaagaaggtgaagtacaatctgaggtgtatctgtattttcttccacgttgttaggtgtcttcttataacctaagttttagattttcctagacaataacttaaataattttagaacattataaattacttctcccttgaaggattgcttgtggtcaggagtttgagaccagcctggacaacatagtgagatcttctctctactaaaatttaaaaaaatatatagccaggcatggtggcgatcctcccacctcagcccagctacttggagggctgaagcagggggatgacttgagccaggaagttgaggctgctgtgagccattatcacgccactgcactcctgcctggacaacagagcaagaccctgtctccaaaaaaaaaaattacttcccctttgattatagaactttgtcacatatcaagttgattaaatgaagataattcaagcattaagtaattatttaatgctttttgtgttcttctagtttgagttctatgattctatgatcttaagatatttaccttaatatatagagagacatatatattaattattatataacacaaatcaattatttcaattaataatttgaagtttttttccatttacttggtacttagaatgcagggggaaatatgatataggatggttagtcatacataaggaaaattctttttgtacacttgacagtcttggctacatacccaattctctgcttttttatttcctatggacacttctttgatgatatatatgtatggcttgggggaggcggttggcttttgtttcctgtgagacagatatctaagttccatagatatctgttccttccctttagaagcaaagaggatactggttcttttatttcaagatctgtaagttaaaattggacagtctgaaatgcataatctttttcttttttgagacggagtctcactgtcacccaggctggagtgcaatggtgcaatctcggctcactgcagcctccacctccctcccagtttcaagtgattctcctgcctcagcctccagagtaactgggattacaggtgcctaccatcatgcctggctaatttttgtatttttagtagagacggggtttctccatgttggccaggctggtctcgaactcctgacctcaagtgatccgcctgcctcagcctcccaaagtgctgggattacaggcgtgagccactgcacctggtctgaaatgcataatcttttaaaactgaaagccatttctaatagtgttcttaatttgtcaagaatcgtatgagaagtgccagtgccctttgcctgtctagctataagtggattatcatgcccaccctttggagccagcagttttggttcagtcctttggtctctgactactcacagtctgcaggaaagagcaggttgtgacacttgactagtttatgagagcagaagctgttacgtgacacttagcacatactgctctcagaggccccagatggatcattaatgctcggaacgtgcgtgctttatggagaaaccgcctaatcaacggagcaggcccattctgaaagaaaaaggaagttctcgtcgcagaaagaaaataataccaaagggaaacaaaatttcaagaaggaataaagaacagtggaagagtaaatatgaagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaac

SEQ ID NO: 688 - DNA, 13853 bp, Homo sapiens; identical to SEQ ID NO: 687

SEQ ID NO: 689 - DNA, 1384 bp, Homo sapiens
aaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcataccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaac

SEQ ID NO: 690 - DNA, 1384 bp, Homo sapiens; identical to SEQ ID NO: 689

SEQ ID NO: 691 - DNA, 6446 bp, Homo sapiens
actcttgccaggcactcttccatgcaccaggagacattgaacagcaaagccaagttccagctttttcaaggctgaccttctgggaaagagacaaagaaccaggaaaccaacgctaggatccagggagcaagtctctcgttccacctgaggagaaatgcccacagctgtggaggcgcaggccactccatctggtgcccaacgtggatgcttttctctagggtgaagggactctcgagtgtggtcattgaggacaagtcaacgagagattcccgagtacgtctacagtgagccttgtgggtgaaggtactctacagtgtggtcattgaggacaagttgacgagagagtcccaagtacgtccacggtcagccttgcgaaacgagagacaaattaattgaccgttacacatttctgcagacagaggttgccaacgcgggactgacaataacatctgataagattcaaacctctactcctttccgttacttgggaatgcaggtagaggaaaggaaaattaaaccacaaaaaatagaaataagaaaagacacattaaaagcattaaatgagtttcaaaagttgctaggagatactaattggatttggagatattaattggatttggccaactctaggcattcctacttatgccatgtcaaatttgttctctttcttaagaggggactcggaattaaatagtgaaagaacgttaactccagaggcaactaaagaaattaaattaattgaagaaaaaattcggtcagcacaagtaaatagaatagatcacttggccccactccaaattttgatttttgctactgcacattccctaacaggcatcattgttcaaaatacagatcttgtggagtggtccttccttcctcacagtacaattaagacttttacattgtacttggatcaaatggctacattaattggtcagggaagattatgaataataacattgtgtggaaatgacccagataaaatcactgttcctttcaacaagcaacaggttagacaagcctttatcaattctggtgcatggcagattggtcttgccgattttgtgggaattattgacaatcgttaccccaaaacaaaaatcttccagtttttaaaattgactacttggattttacctaaagttaccaaacataagcctttaaaaaatgctctggcagtgtttactgatggttccagcaatggaaaagtggcttacaccgggccaaaagaatgagtcatcaaaactcagtatcacttgactcaaagagcagagttggttgccgtcattacagtgttaacaagattttaatcagtctattaacattgtatcagattctgcatatgtagtacaggctacaaaggatattgagagagccctaatcaaatacattatggatgatcagttaaacccgctgtttaatttgttacaacaaaatgtaagaaaaagaaatttcccattttatattactcatattcgagcacacactaatttaccagggcctttaactaaagcaaatgaacaagctgacttgctagtatcatctgcattcatggaagcacaagaacttcatgccttgactcatgtaaatgcaataggattaaaaaataaatttgatatcacatggaaacagacaaaaaatattgtacaacattgcacccagtgtcagattctacacctggccactcaggaggcaagagttaatcccagaggtctatgtcctaatgtgttatggcaaatggatgtcatgcacgtaccttcatttggaaaattgtcatttgtccatgtgacagttgatacttattcacatttcatatgggcaacctgccagacaggagaaagtacttcccatgttaaaagacatttattatcttgttttcctgtcatgggagttccagaaaaagttaaaacagacaatgggccaggttactgtagtaaagcagttcaaaaattcttaaatcagtggaaaattacacatacaataggaattctctataattcccaaggacaggccataattgaaagaactaatagaacactcaaagctcaattggttaaacaaaaaaaaggaaaagacaggagtataacactccccagatgcaacttaatctagcactctatactttaaatgttttaaacatttatagaaatcagaccactacctctgcagaacaacatcttactggtaaaaggaacagcccacatgaaggaaaactgatttggtggaaagataataaaaataaaacatgggaaatggggaaggtgataacgtgggggagaggttttgcttgtgtttcaccaggagaaaatcagcttcctgtttggatacccactagacatttaaagttctacaatgaactcactggagatgcaaagaaaagtgtggagatggagacaccccaatcgactcgccaggtaaacaaaatggtgatatcagaagaacagaaaaagttgccttccatcaaggaagcagagttgccaatataggcacaattaaagaagctgacacagttagctaaaaaaaaaagcctagagaatacaaaggtgacaccaactccagagaatatgctgcttgcagctctgatgattgtatcaacggtggtaagtcttcccaagtctgcaggagcagctgcagctaattatacttactgggcctatgtgcctttcccacccttaattcgggcagttacatagatggataatcctattgaagtagatgttaataatagtgcatgggtgcctggccccacagatgactgttgccctgcccaacctgaagaaggaatgatgatgaatatttccattgggtatccttatcctcctgtttgcctagggaaggcaccaggatgcttaatgcctacaacccaaaattggttggtagaagtacctacagtcagtgctaccagtagatttacttatcacatggtaagtggaatgtcacagataaataatttacaggacccttcttatcaaagatcattacaatgtaggcctaaggggaaggcttgccccaaggaaattcccaaagaatcaaaaagcccagaagtcttagtctgcggagaatgtgtggctgatactgcagtgtagtacaaaacaatgaattttgaactatgatagactgggtcccttgaggccaattatatcataactgtacaggccagactcattcatgttcacaggccccatccatctggcccattaatccagcctatgacggtgatgtaactgaaaggctggaccaggtttatagaaggttagaatcactctgtccaaggaaatggggtgaaaagggaatttcatcaccttgaccaaagttagtcctgttactggtcctgaacatccagaattaggaagcttactgtggcctcacaccacattagaatttgttctggaaatcaagctataggaacaagagatcgtaagtcatattatactatcaacctaaattccagtctgacaattcctttgcaaaattgtgtaaaactcccttatattgctagttgtaggaaaaacatagttattaaacctgattcccaaaccataatctgtgaaaattgtggaatgtttacttgcattgatttgacttttaattggcagcaccgtattctactaggaagagcaagagagggtgtgtggatccttgtgtccatggaccgaccatgggaggcttcgctatccatccatattttaacggaagtattaaaaggaattctaactagatccaaaagattcatttttactttgatggcagtgattatgggcctcattgcagtcacagctactgctgcggctgctggaattgctttacactcctctgttcaaactgcagaatacgtaaatgattggcaaaagaattcctcaaaattgtggaattctcagatccaaatagatcaaaaattggcaaaccaaattaatgatcttagacaaactgtcatttggatgggagaggctcatgagcttggaatatctttttcagttacgatgtgactggaatacatcagatttttgtgttacaccacaagcctataatgagtctgagcatcactgggacatggttagatgccatctgcaaggaggagaagataatcttactttagacatttcaaaattaaaagaattttttttttctttgagacagagtctcgctctgtcgcccaggctggagtgcagtggcgtgatctcagctcactgcaagttccgcctcctgggtttacaccattctcctgcctcagcctcccaagtagttgggactacaggagcccaccaccatgcctggctaattttttttgggtttttaatagagatggagtttcaccgtgttagccaggatggtctcgatctcctgaccttgtgatctgcccaccttggcctcccaaagtgctgggattacagtcgtgagccaccgtgcccagccaagaaaaaatttttgaggcatcaaaagcccatttaaatttggtgccaggaacggagacaatcgtgaaagctgctgatagcctcacaaatcttaagccagtcacttgggttaaaagcatcagaagtttcactattgtaaatttcatattaatccttgtatgcctgttctgtctgttgttagtctacaggtgtatccagcagctccaaagagacagcaaccagcaagaatgggccatagtgacgatggtggttttgtcaaaaagaaaagggggggatatgtaaggaaaagagagatcagactttcactgtgtctatgtagaaaaggaagacataagaaactccattttgatctgtactaagaaaaattgttttgccttgagatgctgttaatctgtaactttagccccaaccctgtgctcacggaaacatgtgctgtaaggtttaagggatctagggctgtgcaggatgtaccttgttaacaatatgtttgcaggcagtatgtttggtaaaagtcatcgccattctccattctcgattaaccaggggctcaatgcactgtggaaagccacaggaacctctgcccaagaaagcctggctgttgtgggaagtcagggaccccgaatggagggaccagctggtgctgcatcaggaaacataaattgtgaagatttcttggacatttatcagtttccaaaattaatacttttataatttcttacacctgtcttactttaatctcttaatcctgttatctttgtaagctgaggatatacgtcacctcaggaccactattgtacaaattgattgtaaaacatgttcacatgtgtttgaacaatatgaaatcagtgcaccttgaaaatgaacagaataacagtgattttagggaacaaaggaagacaaccataaggtctgactgcctgaggggtcgggcaaaaagccatatttttcttcttgcagagagcctataaatggacgtgcaagtaggagagatattgctaaattcttttcctagcaaggaatataatactaagaccctagggaaagaattgcattcctggggggaggtctataaacggccgctctgggagtgtctgtcctatgtggttgagataaggactgagatacgccctggtctcctgcagtaccctcaggcttactaggattgggaaaccccagtcctggtaaatttgaggtcaggccggttctttgctctgaaccctgttttctgttaagatgtttatcaagacaatacatgcaccgctgaacatagacccttatcaggagtttctgattttgctctggtcctgtttcttcagaagcatgtcatctttgctctgccttctgccctttgaagcatgtgatctttgtgacctactccctgttcatacacccctccccttttaaaatccctaataaaaacttgctggttttgtggctcaggggggcatcatggacctaccaatacgtgatgtcacccccggtggcccagctgtaaaattcctttctttatactcttatttctcagaccagctgacacttagggaaaatagaaagaacctatgttgaaatattggaggcgggttcccccgatacctgggtattgtccaaggtttcctttgctgaggaggattagtaaaaggaatgcctccatctcctgcatgtccctgggaacagaatgttcccaccaaccaccctgtggctggaggcgggatatgctggcagcaatgctgctctattactctttgctacactgagatgtttgggtggagagaagcataaatctggcctatgtgcacatctgggcacagcaccttcctttgaacttatttgtgacacagattcctttgctcacgttttcctgttgactttctcaccactcaccctattctcctgtggcattcgccttgcggagatagtgaaaatagtaataaatactgagggaactcagactgagggaactcagactgggcagaccggggccagtgtgggtcctccatatgctgagcgccggttccctgggcccactgttctttc

SEQ ID NO: 692 - DNA, 6446 bp, Homo sapiens; identical to SEQ ID NO: 691

SEQ ID NO: 693 - DNA, 11062 bp, Homo sapiens
actcttgccaggcactcttccatgcaccaggagacattgaacagcaaagccaagttccagctttttcaaggctgaccttctgggaaagagacaaagaaccaggaaaccaacgctaggatccagggagcaagtctctcgttccacctgaggagaaatgcccacagctgtggaggcgcaggccactccatctggtgcccaacgtggatgcttttctctagggtgaagggactctcgagtgtggtcattgaggacaagtcaacgagagattcccgagtacgtctacagtgagccttgtggtaagcttgggcgctcggaagaagccagggttaatggggcaaactaaaagtaaagtctctcattccacctgatgagaaacacccagaggtgtggaggggcaggccaccccttcagggtagggtcccctccatgcagaccatagagcacaggtgtgccccaaagaggagcagagagaaggagggagagggcccacgagagacttggaaatgaatggcaggattttaggcgctggacttgggttcggggcacctggcctttccttgtgtatttctcctactgtctgcctaactatttaatacaataaaagaaaaccagcccctggttcttgtggtgtttccaccctcccgggtccccgctggctgcctggcttcctcccgcagctcctgctgtgtgtgtatgtgtgtgtgtgtgcacatctgtggggcgtatgtgtgttcgtctttgtaattgaggctgcagagtggagagagcaggggttttctctggggacccagagagaaggaggcgttttcaccacagccgaacagggcaggaccccagcacccgggacccagcgggactttgccaaggggatggacctggctgggccacgcggctgtttgtgtagggaaaagaaagagagatcacactgttactgtgtctatgtagaaaaggaagacataaactccattttgagctgtactaagaaaaattattttgccttgacctgctgttaacctgtaactgtagccccaaccctgtgctcaaagaaacatgtgctgtatggaatcaaggtttaagggatcaagggctgtacaggatgtgccttgttaacaatgtgtttacaggcagtatgcttggtaaaagtcatcgccattctccattctccattaatcaggggcacgatgcactgcggaaagccacagggacctctgcccgagaaagcctgggtattgtccaaggcttccccccactgagacagcctgagatacggcctcgtgggaagggaaagacctgaccgtcccccagcccgacacccgtaaagggtctgtgctgaggaggattagtaaaaggggaaggcctcttgcagttgagataagaggaaggcctccgtctcctgcatgtccttgggaatggaatgtcttggtgtaaaacccgatagtacattccttctattctgagagaagaaaaccaccctgtggctggagggtgaaggtactctacagtgtggtcattgaggacaagttgacgagagagtcccaagtacgtccacggtcagccttgcggtaagcttgtgtgcttagaggaacccagggtaacgatggggcaaactgaaagtaaatatgcctcttatctcagctttattaaaattcttttaagaagagggggagttagagcttctacagaaaatctaattacgctatttcaaacaatagaacaattctgcccatggtttccagaacagggaactttagatctaaaagattgggaaaaaattggcaaagaattaaaacaagcaaatagggaaggtaaaatcatcccacttacagtatggaatgattgggccattattaaagcaactttagaaccatttcaaacaggagaagatattgtttcagtttctgatgcccctaaaagctgtgtaacagattgtgaagaagaggcagggacagaatcccagcaaggaacggaaagttcacattgtaaatatgtagcagagtctgtaatggctcagtcaacgcaaaatgttgactacagtcaattacaggagataatataccctgaatcatcaaaattgggggaaggaggtccagaatcattggggccatcagagcctaaaccacgatcgccatcaactcctcctcccgtggttcagatgcctgtaacattacaacctcaaacgcaggttagacaagcacaaaccccaagagaaaatcaagtagaaagggacagagtctctatcccggcaatgccaactcagatacagtatccacaatatcagccggtagaaaataagacccaaccgctggtagtttatcaataccggctgccaaccgagcttcagtatcggcctccttcagaggttcaatacagacctcaagcggtgtgtcctgtgccaaatagcacggcaccataccagcaacccacagcgatggcgtctaattcaccagcaacacaggacgcggcgctgtatcctcagccgcccactgtgagacttaatcctacagcatcacgtagtggacagggtggtgcactgcatgcagtcattgatgaagccagaaaacagggcgatcttgaggcatggcggttcctggtaattttacaactggtacaggccggggaagagactcaagtaggagcgcctgcccgagctgagactagatgtgaacctttcaccatgaaaatgttaaaagatataaaggaaggagttaaacaatatggatccaactccccttatataagaacattattagattccattgctcatggaaatagacttactccttatgactgggaaattttggccaaatcttccctttcatcctctcagtatctacagtttaaaacctggtggattgatggagtacaagaacaggtacgaaaaaatcaggctactaagcccactgttaatatagacgcagaccaattgttaggaacaggtccaaattggagcaccattaaccaacaatcagtgatgcagaatgaggctattgaacaagtaagggctatttgcctcagggcctggggaaaaattcaggacccaggaacagctttccctattaattcaattagacaaggctctaaagagccatatcctgactttgtggcaagattacaagatgctgctcaaaagtctattacagatgacaatgcccgaaaagttattgtagaattaatggcctatgaaaatgcaaatccagaatgtcagtcggccataaagccattaaaaggaaaagttccagcaggagttgatgtaattacagaatatgtgaaggcttgtgatgggattggaggagctatgcataaggcaatgctaatggctcaagcaatgagggggctcactctaggaggacaagttagaacatttgggaaaaaatgttataattgtggtcaaatcggtcatctgaaaaggagttgcccaggcttaaataaacagaatataataaatcaagctattaacagcaaaaaataaaaagccatctggcctgtgtccaaaatgtggaaaagcaaaacattgggccaatcaatgtcattctaaatttgataaagatgggcaaccattgtctggaaacaggaagaggggccagcctcaggccccccaacaaactggggcattcccagttaaactgtttgttcctcagggttttcaaggacaacaacccctacagaaaataccaccacttcagggagtcagccaattacaacaatccaacagctgtcccgcgccacagcaggcagcaccgcagtagatttatgttccacccaaatggtctttttactccctggaaagcccccacaaaagattcctagaggggtatatggcccgctgccagaagggagggtaggcctttgagggagatcaagtctaaatttgaagggagtccaaattcatactggggtaatttattcagattataaagggggaattcagttagtgatcagctccactgttccccggagtgccaatccaggtgatagaattgctcaattactgcttttgccttatgttaaaattggggaaaacaaaaaggaaagaacaggagggtttggaagtaccaaccctgcaggaaaagctgcttattgggctaatcaggtctcagaggatagacccgtgtgtacagtcactattcagggaaagagtttgaaggattagtggatacccaggctgatgtttctgtcatcggcataggtactgcctcagaagtgtatcaaagtgccatgattttacattgtccaggatctgataatcaagaaagtacggttcagcctgtgatcacttcattccaatcaatttatggggccgagacttgttacaacaatggcatgcagagattactatcccagcctccctatacagccccaggaataaaaaaatcatgactaaaatgggatagctccctaaaaagggactaggaaagaagtcccaattgaggctgaaaaaaatcaaaaaagaaaaggaatagggcatcctttttaggagcggtcactgtagagcctccaaaacccattccattaacttgggggaaaaaaaaacaactgtatggtaaatcagcagcgcttccaaaacaaaaactggaggctttacatttattagcaaagaaacaattagaaaaaggacattgagccttcattttcgccttggaattctgtttgtaattcagaaaaaatccggcagatggcgtataatgccgtaattcaacccatgggggctctcccaccccggttgccctctccagccatggtcccctttaattataattgatctgaaggattgcttttttaccattcctctggcaaaacaggattttgaaaaatttgcttttaccacaccagcctaaataataaagaaccagccaccaggtttcagtggaaagtattgcctcagggaatgcttaatagttcaactatttgtcagctcaagctctgcaaccagttagagacaagttttcagactgttacatcgttcactatgttgatattttgtgtgctgcagaaacgagagacaaattaattgaccgttacacatttctgcagacagaggttgccaacgcgggactgacaataacatctgataagattcaaacctctactcctttccgttacttgggaatgcaggtagaggaaaggaaaattaaaccacaaaaaatagaaataagaaaagacacattaaaagcattaaatgagtttcaaaagttgctaggagatactaattggatttggagatattaattggatttggccaactctaggcattcctacttatgccatgtcaaatttgttctctttcttaagaggggactcggaattaaatagtgaaagaacgttaactccagaggcaactaaagaaattaaattaattgaagaaaaaattcggtcagcacaagtaaatagaatagatcacttggccccactccaaattttgatttttgctactgcacattccctaacaggcatcattgttcaaaatacagatcttgtggagtggtccttccttcctcacagtacaattaagacttttacattgtacttggatcaaatggctacattaattggtcagggaagattatgaataataacattgtgtggaaatgacccagataaaatcactgttcctttcaacaagcaacaggttagacaagcctttatcaattctggtgcatggcagattggtcttgccgattttgtgggaattattgacaatcgttaccccaaaacaaaaatcttccagtttttaaaattgactacttggattttacctaaagttaccaaacataagcctttaaaaaatgctctggcagtgtttactgatggttccagcaatggaaaagtggcttacaccgggccaaaagaatgagtcatcaaaactcagtatcacttgactcaaagagcagagttggttgccgtcattacagtgttaacaagattttaatcagtctattaacattgtatcagattctgcatatgtagtacaggctacaaaggatattgagagagccctaatcaaatacattatggatgatcagttaaacccgctgtttaatttgttacaacaaaatgtaagaaaaagaaatttcccattttatattactcatattcgagcacacactaatttaccagggcctttaactaaagcaaatgaacaagctgacttgctagtatcatctgcattcatggaagcacaagaacttcatgccttgactcatgtaaatgcaataggattaaaaaataaatttgatatcacatggaaacagacaaaaaatattgtacaacattgcacccagtgtcagattctacacctggccactcaggaggcaagagttaatcccagaggtctatgtcctaatgtgttatggcaaatggatgtcatgcacgtaccttcatttggaaaattgtcatttgtccatgtgacagttgatacttattcacatttcatatgggcaacctgccagacaggagaaagtacttcccatgttaaaagacatttattatcttgttttcctgtcatgggagttccagaaaaagttaaaacagacaatgggccaggttactgtagtaaagcagttcaaaaattcttaaatcagtggaaaattacacatacaataggaattctctataattcccaaggacaggccataattgaaagaactaatagaacactcaaagctcaattggttaaacaaaaaaaaggaaaagacaggagtataacactccccagatgcaacttaatctagcactctatactttaaatgttttaaacatttatagaaatcagaccactacctctgcagaacaacatcttactggtaaaaggaacagcccacatgaaggaaaactgatttggtggaaagataataaaaataaaacatgggaaatggggaaggtgataacgtgggggagaggttttgcttgtgtttcaccaggagaaaatcagcttcctgtttggatacccactagacatttaaagttctacaatgaactcactggagatgcaaagaaaagtgtggagatggagacaccccaatcgactcgccaggtaaacaaaatggtgatatcagaagaacagaaaaagttgccttccatcaaggaagcagagttgccaatataggcacaattaaagaagctgacacagttagctaaaaaaaaaagcctagagaatacaaaggtgacaccaactccagagaatatgctgcttgcagctctgatgattgtatcaacggtggtaagtcttcccaagtctgcaggagcagctgcagctaattatacttactgggcctatgtgcctttcccacccttaattcgggcagttacatagatggataatcctattgaagtagatgttaataatagtgcatgggtgcctggccccacagatgactgttgccctgcccaacctgaagaaggaatgatgatgaatatttccattgggtatccttatcctcctgtttgcctagggaaggcaccaggatgcttaatgcctacaacccaaaattggttggtagaagtacctacagtcagtgctaccagtagatttacttatcacatggtaagtggaatgtcacagataaataatttacaggacccttcttatcaaagatcattacaatgtaggcctaaggggaaggcttgccccaaggaaattcccaaagaatcaaaaagcccagaagtcttagtctgcggagaatgtgtggctgatactgcagtgtagtacaaaacaatgaattttgaactatgatagactgggtcccttgaggccaattatatcataactgtacaggccagactcattcatgttcacaggccccatccatctggcccattaatccagcctatgacggtgatgtaactgaaaggctggaccaggtttatagaaggttagaatcactctgtccaaggaaatggggtgaaaagggaatttcatcaccttgaccaaagttagtcctgttactggtcctgaacatccagaattaggaagcttactgtggcctcacaccacattagaatttgttctggaaatcaagctataggaacaagagatcgtaagtcatattatactatcaacctaaattccagtctgacaattcctttgcaaaattgtgtaaaactcccttatattgctagttgtaggaaaaacatagttattaaacctgattcccaaaccataatctgtgaaaattgtggaatgtttacttgcattgatttgacttttaattggcagcaccgtattctactaggaagagcaagagagggtgtgtggatccttgtgtccatggaccgaccatgggaggcttcgctatccatccatattttaacggaagtattaaaaggaattctaactagatccaaaagattcatttttactttgatggcagtgattatgggcctcattgcagtcacagctactgctgcggctgctggaattgctttacactcctctgttcaaactgcagaatacgtaaatgattggcaaaagaattcctcaaaattgtggaattctcagatccaaatagatcaaaaattggcaaaccaaattaatgatcttagacaaactgtcatttggatgggagaggctcatgagcttggaatatctttttcagttacgatgtgactggaatacatcagatttttgtgttacaccacaagcctataatgagtctgagcatcactgggacatggttagatgccatctgcaaggaggagaagataatcttactttagacatttcaaaattaaaagaattttttttttctttgagacagagtctcgctctgtcgcccaggctggagtgcagtggcgtgatctcagctcactgcaagttccgcctcctgggtttacaccattctcctgcctcagcctcccaagtagttgggactacaggagcccaccaccatgcctggctaattttttttgggtttttaatagagatggagtttcaccgtgttagccaggatggtctcgatctcctgaccttgtgatctgcccaccttggcctcccaaagtgctgggattacagtcgtgagccaccgtgcccagccaagaaaaaatttttgaggcatcaaaagcccatttaaatttggtgccaggaacggagacaatcgtgaaagctgctgatagcctcacaaatcttaagccagtcacttgggttaaaagcatcagaagtttcactattgtaaatttcatattaatccttgtatgcctgttctgtctgttgttagtctacaggtgtatccagcagctccaaagagacagcaaccagcaagaatgggccatagtgacgatggtggttttgtcaaaaagaaaagggggggatatgtaaggaaaagagagatcagactttcactgtgtctatgtagaaaaggaagacataagaaactccattttgatctgtactaagaaaaattgttttgccttgagatgctgttaatctgtaactttagccccaaccctgtgctcacggaaacatgtgctgtaaggtttaagggatctagggctgtgcaggatgtaccttgttaacaatatgtttgcaggcagtatgtttggtaaaagtcatcgccattctccattctcgattaaccaggggctcaatgcactgtggaaagccacaggaacctctgcccaagaaagcctggctgttgtgggaagtcagggaccccgaatggagggaccagctggtgctgcatcaggaaacataaattgtgaagatttcttggacatttatcagtttccaaaattaatacttttataatttcttacacctgtcttactttaatctcttaatcctgttatctttgtaagctgaggatatacgtcacctcaggaccactattgtacaaattgattgtaaaacatgttcacatgtgtttgaacaatatgaaatcagtgcaccttgaaaatgaacagaataacagtgattttagggaacaaaggaagacaaccataaggtctgactgcctgaggggtcgggcaaaaagccatatttttcttcttgcagagagcctataaatggacgtgcaagtaggagagatattgctaaattcttttcctagcaaggaatataatactaagaccctagggaaagaattgcattcctggggggaggtctataaacggccgctctgggagtgtctgtcctatgtggttgagataaggactgagatacgccctggtctcctgcagtaccctcaggcttactaggattgggaaaccccagtcctggtaaatttgaggtcaggccggttctttgctctgaaccctgttttctgttaagatgtttatcaagacaatacatgcaccgctgaacatagacccttatcaggagtttctgattttgctctggtcctgtttcttcagaagcatgtcatctttgctctgccttctgccctttgaagcatgtgatctttgtgacctactccctgttcatacacccctccccttttaaaatccctaataaaaacttgctggttttgtggctcaggggggcatcatggacctaccaatacgtgatgtcacccccggtggcccagctgtaaaattcctttctttatactcttatttctcagaccagctgacacttagggaaaatagaaagaacctatgttgaaatattggaggcgggttcccccgatacctgggtattgtccaaggtttcctttgctgaggaggattagtaaaaggaatgcctccatctcctgcatgtccctgggaacagaatgttcccaccaaccaccctgtggctggaggcgggatatgctggcagcaatgctgctctattactctttgctacactgagatgtttgggtggagagaagcataaatctggcctatgtgcacatctgggcacagcaccttcctttgaacttatttgtgacacagattcctttgctcacgttttcctgttgactttctcaccactcaccctattctcctgtggcattcgccttgcggagatagtgaaaatagtaataaatactgagggaactcagactgagggaactcagactgggcagaccggggccagtgtgggtcctccatatgctgagcgccggttccctgggcccactgttctttc

SEQ ID NO: 694 - DNA, 11062 bp, Homo sapiens; identical to SEQ ID NO: 693

SEQ ID NO: 695 - DNA, 2283 bp, Homo sapiens
actcttgccaggcactcttccatgcaccaggagacattgaacagcaaagccaagttccagctttttcaaggctgaccttctgggaaagagacaaagaaccaggaaaccaacgctaggatccagggagcaagtctctcgttccacctgaggagaaatgcccacagctgtggaggcgcaggccactccatctggtgcccaacgtggatgcttttctctagggtgaagggactctcgagtgtggtcattgaggacaagtcaacgagagattcccgaggtgaaggtactctacagtgtggtcattgaggacaagttgacgagagagtcccaagtacgtccacggtcagccttgcgacatttaaagttctacaatgaactcactggagatgcaaagaaaagtgtggagatggagacaccccaatcgactcgccagtctacaggtgtatccagcagctccaaagagacagcaaccagcaagaatgggccatagtgacgatggtggttttgtcaaaaagaaaagggggggatatgtaaggaaaagagagatcagactttcactgtgtctatgtagaaaaggaagacataagaaactccattttgatctgtactaagaaaaattgttttgccttgagatgctgttaatctgtaactttagccccaaccctgtgctcacggaaacatgtgctgtaaggtttaagggatctagggctgtgcaggatgtaccttgttaacaatatgtttgcaggcagtatgtttggtaaaagtcatcgccattctccattctcgattaaccaggggctcaatgcactgtggaaagccacaggaacctctgcccaagaaagcctggctgttgtgggaagtcagggaccccgaatggagggaccagctggtgctgcatcaggaaacataaattgtgaagatttcttggacatttatcagtttccaaaattaatacttttataatttcttacacctgtcttactttaatctcttaatcctgttatctttgtaagctgaggatatacgtcacctcaggaccactattgtacaaattgattgtaaaacatgttcacatgtgtttgaacaatatgaaatcagtgcaccttgaaaatgaacagaataacagtgattttagggaacaaaggaagacaaccataaggtctgactgcctgaggggtcgggcaaaaagccatatttttcttcttgcagagagcctataaatggacgtgcaagtaggagagatattgctaaattcttttcctagcaaggaatataatactaagaccctagggaaagaattgcattcctggggggaggtctataaacggccgctctgggagtgtctgtcctatgtggttgagataaggactgagatacgccctggtctcctgcagtaccctcaggcttactaggattgggaaaccccagtcctggtaaatttgaggtcaggccggttctttgctctgaaccctgttttctgttaagatgtttatcaagacaatacatgcaccgctgaacatagacccttatcaggagtttctgattttgctctggtcctgtttcttcagaagcatgtcatctttgctctgccttctgccctttgaagcatgtgatctttgtgacctactccctgttcatacacccctccccttttaaaatccctaataaaaacttgctggttttgtggctcaggggggcatcatggacctaccaatacgtgatgtcacccccggtggcccagctgtaaaattcctttctttatactcttatttctcagaccagctgacacttagggaaaatagaaagaacctatgttgaaatattggaggcgggttcccccgatacctgggtattgtccaaggtttcctttgctgaggaggattagtaaaaggaatgcctccatctcctgcatgtccctgggaacagaatgttcccaccaaccaccctgtggctggaggcgggatatgctggcagcaatgctgctctattactctttgctacactgagatgtttgggtggagagaagcataaatctggcctatgtgcacatctgggcacagcaccttcctttgaacttatttgtgacacagattcctttgctcacgttttcctgttgactttctcaccactcaccctattctcctgtggcattcgccttgcggagatagtgaaaatagtaataaatactgagggaactcagactgagggaactcagactgggcagaccggggccagtgtgggtcctccatatgctgagcgccggttccctgggcccactgttctttc

SEQ ID NO: 696 - DNA, 2283 bp, Homo sapiens; identical to SEQ ID NO: 695

SEQ ID NO: 697 - DNA, 8722 bp, Homo sapiens
atggtcctgaaggagatggtccttgagtgggtggtttatgactgctccatcttcatgttcttccagccttttttggttccccgaaatttcctgtcaggaaatttaccaacgcggaaatttacccacttctgtcagaaaactgatcagccatgtcttcgccacacgtgatgccaggattcttaaacaggcccaagaccggagaccaagatgtcgacggagtgttatatggcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctaggctgtgtggttggtggtgaataggcttctttttacatggtgctgccagcccagctaattaatggtgcacgtggacttttagcaagcgggctcactggaagagactgaacctggcatggaattcctgaagatgtttggggtttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgatagcagactccttgaaagcagggtccttgtttagtgcatctttgcccacatacaccacaacatatcaagatgcatttattaggaaggaggagtttagagagcaggctatcagaataaccactcatcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaagttactttgagttgggtttctgttacttgaaattgaatccacactaatatatctaccaacattgagacttgacagatccaagtatttattaagctagaggtcatggtcactgaaattactttccaaagtggaagacaaaatgaaacaggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatgatacattaggtgaaacaagttattaatagaaaagtgtacagtgtgaactcattttaaaatgtgtgtgcttatgtttataaatgcatagaaaggtctattcacagctttctttgaacagtgtagatcacatgaaactttcaactttatacatttctgtattaatattttacactacccacattatttttaaactttattttaaataaagaatttttaaaattaaatttagtgcttactgtttgaccttggcaagttattcaacactgagcctgttttatcaaatgattta

SEQ ID NO: 698 - DNA, 8736 bp, Homo sapiens
atggtcctgaaggagatggtccttgagtgggtggtttatgactgctccatcttcatgttcttccagccttttttggttccccgaaatttcctgtcaggaaatttaccaacgcggaaatttacccacttctgtcagaaaactgatcagccatgtcttcgccacacgtgatgccaggattcttaaacaggcccaagaccggagaccaagatgtcgacggagtgttatatggcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctaggctgtgtggttggtggtgaataggcttctttttacatggtgctgccagcccagctaattaatggtgcacgtggacttttagcaagcgggctcactggaagagactgaacctggcatggaattcctgaagatgtttggggtttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgatagcagactccttgaaagcagggtccttgtttagtgcatctttgcccacatacaccacaacatatcaagatgcatttattaggaaggaggagtttagagagcaggctatcagaataaccactcatcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatgcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaagttactttgagttgggtttctgttacttgaaattgaatccacactaatatatctaccaacattgagacttgacagatccaagtatttattaagctagaggtcatggtcactgaaattactttccaaagtggaagacaaaatgaaacaggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatgatacattaggtgaaacaagttattaatagaaaagtgtacagtgtgaactcattttaaaatgtgtgtgcttatgtttataaatgcatagaaaggtctattcacagctttctttgaacagtgtagatcacatgaaactttcaactttatacatttctgtattaatattttacactacccacattatttttaaactttattttaaataaagaatttttaaaattaaatttagtgcttactgtttgaccttggcaagttattcaacactgagcctgttttatcaaatgattta

SEQ ID NO: 699 - DNA, 8597 bp, Homo sapiens
atggtcctgaaggagatggtccttgagtgggtggtttatgactgctccatcttcatgttcttccagccttttttggttccccgaaatttcctgtcaggaaatttaccaacgcggaaatttacccacttctgtcagaaaactgatcagccatgtcttcgccacacgtgatgccaggattcttaaacaggcccaagaccggagaccaagatgtcgacggagtgttatatggcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctaggctgtgtggttggtggtgaataggcttctttttacatggtgctgccagcccagctaattaatggtgcacgtggacttttagcaagcgggctcactggaagagactgaacctggcatggaattcctgaagatgtttggggtttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaagttactttgagttgggtttctgttacttgaaattgaatccacactaatatatctaccaacattgagacttgacagatccaagtatttattaagctagaggtcatggtcactgaaattactttccaaagtggaagacaaaatgaaacaggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatgatacattaggtgaaacaagttattaatagaaaagtgtacagtgtgaactcattttaaaatgtgtgtgcttatgtttataaatgcatagaaaggtctattcacagctttctttgaacagtgtagatcacatgaaactttcaactttatacatttctgtattaatattttacactacccacattatttttaaactttattttaaataaagaatttttaaaattaaatttagtgcttactgtttgaccttggcaagttattcaacactgagcctgttttatcaaatgattta

SEQ ID NO: 700 - DNA, 4229 bp, Homo sapiens
ccctgctcaccatgccttgtctcaccatccagtcactgaggcttttcccgcagccgcctcccatctgggtgagagagagtcacgctgatggcggagggacggcagcgccagggccactggagggcgcggcttctaacaggggtgcgcctttcgggtcaggaggcctgctgccactttgggaggcgtgtgtgtgtaggggtgtgtgtaggtgtgtaagggtgtgtatgtaggtgtatgagtgtaggtgtgtgtgtaggtgtatgagtgtaggtttgtatgtgtaggtgtaggttgtgtaggtatagatgtatgtggtgtgtgtaggtggtgtgtgtagatgtgtgtggtgtgtgtaggggtgtgtgtgcaggtgtgtaggtgtatgagtgtgtaggggtggtatatgcaggggtgtgtatgtaggtgtatgaatgtaggtgtgtatgtgtaggtgtaggtgtgggtaggtgtaggtgtgtggtgtgtgtaggtgtgtatgtgtaggtgtaggggtgtgtgtgtaggtgtggtgggtgtagatgtgtgtgtggtgtgtgtgtaggtgtatgagtgtgtaggtgtggtgtgtgtaagggtgtgtgtaggtgtatgagtataggtgtggtgtgtgtaggtgtgggtgtagatgtgtgtgtggtgtgtgtaggggtgtgtgtaggtgtatgagtgtaggtgtggtgtgtgtaggtgtgtgtggtgggtgtagatgtgtgtgtggtgtgtgtaggtgtatgagtgtgtaggtgtgatgtgtgtaggggtgtgtgtaggtgtatgaatgtgtgtgtgtaggtgtgtgtggtgggtgtagatatgtgtgtgtggtgtgtgtagggctgtgtgtgtaggtttatgagtggaggtgtgtgtggaggtgtgtggtgggtgtagatgtgtgtggtgtgtgtgtgggggtgtgtaggtgtatgggtgtgtaggtgtggtgtgtgtagggctgtgtgtaggtgtatgagtggaggtgtggtgtgtggaggtgtgtgtggtgggtgtagatgtgtgtgtggtgtgggggtgtgtaggtgtatgagtgtgtaggtgtggtgtgtgtaggggtgtgtgtaggtgtatgagtggaggtatgacgtgtggaggtgtgtgtggtgggtgtagatgtgtgtgtggtgtgtgtaggggtgtgtgtaggtgcatgagtgtgtaggtgtggtgtgtgtgtaggggtgtctgtgtaggtgtatgagtgtaggtgtgtgtggaggtgtgtgtggtgggtgtagatgtgtgtgtggtgtgtgtgtaggtctatgggtggaggtgtggtgtgtggaggtgtgtgtggtggatgtggcggctggtgtagagggatgaggcaggtattgtggtacccaccggggggtgagccacaacagctctgggatgccagcgccctgggtaggctgaggcagagctgacagcaaactaaacaaagcttctcaactctctccacaaggatcccagaggctgggcctcagcaaccccaggatagcagggcaggcggctgtcagatggtctgggggctcccagtagggtctgacaggcacccaggttttagaaacatcagtttatccaaccttctcacattcatccatggcacacatgcagtttcctagggccccagagtggagggagacgagagtcctgctcccagcccgtcaccctgtgcctggctggttcaccctactcagaccagcatggggcctggcacatggcacagggcacacagcaggcatgtcagggagtgaaggaactaaaacctggcacacagcatgcaataccacctcgtcacacgacttgtgagtcctgctctgaatcccagggcgcaaacctgggctgcgcacaattggcacttgattctgtttctttttttttgagatacagtcttactatgttgcccaggctggagtgcagtggtacagtcatagctcacgataacctcaaactcctgggtttaagtgatcctcccgcttcagcctcccaagtagctggcactacaggtacctgccaccgcgcctggttttgatgctgttttgtactctgctcttgggaatcatgttctcacggtttagtgggtgaaggccttaccaccagccaaactccagcaccccaggagcaggcatttgctcacagagttttaagaaatcataccctgatttggcagaagtggcttaaatctcccaggttatcggagataaatcagtgataaccggtttatcagcttctctttgctgccagtggagttgtgtggtgcgtttcctccctgtgggcgggctgcaaggtagtgtgggagccaggacacctgggctctagttttagtcacgcctgaattgctgtgtgcccctagggaagtgaaccctgtctctgggctgcagcaggagcagattggctgggattgctgcccactgggtggtggagtcaacctctgaccacgagaggccaggtggcctgagaggggagctcctacagcaggctcgcggtgtgttggttccgatgaatcccgacacactggaagcctgaggctgaggagggagacacacacctccactcactctcctttgcaccttagggcttttcacagctctaaggttaccagcatggcttagaagccaggcagaacaatacctacgagaccctaggcagggtatctccctgtcctcagcctcagttttctcatctgtaaatgggatgaggacatggcggtactgcgaagcgtaagtgccgtaataccgtagtgtgtgccaggcaccataccgaggacagtacacctgtggtttcacttaagctcttcctggaactcagttttctcatctgtaaaacgggataataacataccctaagggtttctgtgatgactcactaagagaggggatgcaaagtgcttagtgcaggcctggcccggagcacaggctcagcaaatgatggcttacacccgaaaaaggactggagtctctgactggtgtgtgcggtggatgtgacacgggtgtgcaatgtgctgtgcttggtggcaggtcacacaccacacatgggaggtactggattctcttgttgcccactgggtggtagagtcaacctctgtccacgagaggcccagatggcccaccccagcgtcctccaccttgccctgttctgacttgggaatggctcctgagatgctgggagacccaggagcggagagagtgcccttgggggtcacgaagactttgcccacagtggactggcctggacggtttccacaactcgtccctccctgctttccttcttttcttgagacagggtcttactccattgcccaggctggagtgtcgtagtgcaatctcagctcaccacaacctccacctcctgtgctcaagcgatcctcccacctcagcctcctgagtagctgggactaaaggtgtgcgccaccatgcccggataatttttaaatattttgtagagatggggtttccccatgttgcccaggttggtcttgaactcctgacctcaagtgatctgcccacctcggcctcctaaagtgctgggattccaggtgtgagccactgtgcccggccctccctgctttcctagctccatcctgatctttcagattggaagtcaagtccctcctgtgctcaagacttccccgcggcctccacctcacttaggatgcaatctgcagcgctcctagccgcgctgaggtcctctggtccctgctatatacccatagagcttcacttcctacccccaaccccatgctagcctcagaagtccccatgctgccttgagcctcctctagcctcctcggccccaggtccaccaccctcactcccccggactccctggactcccaggtccggctgtttctaactgtctcccatgggacctgctctgtctgctcacttgctggagcagaaattctcacactgcctgaaaagcatccagatacacgttgacatgcatgagagaatggtgcttggaggtcttgccaaagcgtgtgggggtcacccacaaaatgtgctcggtgctggacaagtggctgtcactcaacacacagtcaaggaactaaacggaattcaaagagcaccctcgcatttctccccgctgctttagggtccgctcttttttttttttttgagacggagtctcgctctgtcgcccaggttggagtgcagtggcgggatctcggctcactgcaagctccgcctcctgggttcacg

SEQ ID NO: 701 - DNA, 4310 bp, Homo sapiens
gctcaccatgccttgtctcaccatccagtcactgaggcttttcccgcagccgcctcccatctgggtgagagagagtcacgctgatggcggagggacggcagcgccagggccactggagggcgcggcttctaacaggggtgcgcctttcgggtcaggaggcctgctgccactttgggaggcgtgtgtgtgtaggggtgtgtgtaggtgtgtaagggtgtgtatgtaggtgtatgagtgtaggtgtgtgtgtaggtgtatgagtgtaggtttgtatgtgtaggtgtaggttgtgtaggtatagatgtatgtggtgtgtgtaggtggtgtgtgtagatgtgtgtggtgtgtgtaggggtgtgtgtgcaggtgtgtaggtgtatgagtgtgtaggggtggtatatgcaggggtgtgtatgtaggtgtatgaatgtaggtgtgtatgtgtaggtgtaggtgtgggtaggtgtaggtgtgtggtgtgtgtaggtgtgtatgtgtaggtgtaggggtgtgtgtgtaggtgtggtgggtgtagatgtgtgtgtggtgtgtgtgtaggtgtggtgtgtgtaggtgtgtgtggtgggtgtagatgtgtgtgtggtgtgtgtaggtgtatgagtgtgtaggtgtgatgtgtgtaggggtgtgtgtaggtgtatgaatgtgtgtgtgtaggtgtgtgtggtgggtgtagatatgtgtgtgtggtgtgtgtagggctgtgtgtgtaggtttatgagtggaggtgtgtgtggaggtgtgtggtgggtgtagatgtgtgtggtgtgtgtgtgggggtgtgtaggtgtatgggtgtgtaggtgtggtgtgtagggctgtgtgtgtaggtgtatgagtggaggtgtgtggaggtgtgtgtggtgggtgtagatgtgtgtgtggtgtgtgtaggggtgtgtgtgtaggcgtatgagtggaggtgtggtgtgtgtaggtgtggtgtgtggaggtgtgtgtggtgggtgtagatgtgtgtgtgtggtgtgtgtgggtgtgtgtggtgtatgggtgtgtaggtgtggtgtgtgtagggctgtgtgtaggtgtatgagtggaggtgtggtgtgtggaggtgtgtgtggtgggtgtagatgtgtgtgtggtgtgggggtgtgtaggtgtatgagtgtgtaggtgtggtgtgtgtaggggtgtgtgtaggtgtatgagtggaggtatgacgtgtggaggtgtgtgtggtgggtgtagatgtgtgtgtggtgtgtgtaggggtgtgtgtaggtgcatgagtgtgtaggtgtggtgtgtgtgtaggggtgtctgtgtaggtgtatgagtgtaggtgtgtgtggaggtgtgtgtggtgggtgtagatgtgtgtgtggtgtgtgtgtaggtctatgggtggaggtgtggtgtgtggaggtgtgtgtggtggatgtggcggctggtgtagagggatgaggcaggtattgtggtacccaccggggggtgagccacaacagctctgggatgccagcgccctgggtaggctgaggcagagctgacagcaaactaaacaaagcttctcaactctctccacaaggatcccagaggctgggcctcagcaaccccaggatagcagggcaggcggctgtcagatggtctgggggctcccagtagggtctgacaggcacccaggttttagaaacatcagtttatccaaccttctcacattcatccatggcacacatgcagtttcctagggccccagagtggagggagacgagagtcctgctcccagcccgtcaccctgtgcctggctggttcaccctactcagaccagcatggggcctggcacatggcacagggcacacagcaggcatgtcagggagtgaaggaactaaaacctggcacacagcatgcaataccacctcgtcacacgacttgtgagtcctgctctgaatcccagggcgcaaacctgggctgcgcacaattggcacttgattctgtttctttttttttgagatacagtcttactatgttgcccaggctggagtgcagtggtacagtcatagctcacgataacctcaaactcctgggtttaagtgatcctcccgcttcagcctcccaagtagctggcactacaggtacctgccaccgcgcctggttttgatgctgttttgtactctgctcttgggaatcatgttctcacggtttagtgggtgaaggccttaccaccagccaaactccagcaccccaggagcaggcatttgctcacagagttttaagaaatcataccctgatttggcagaagtggcttaaatctcccaggttatcggagataaatcagtgataaccggtttatcagcttctctttgctgccagtggagttgtgtggtgcgtttcctccctgtgggcgggctgcaaggtagtgtgggagccaggacacctgggctctagttttagtcacgcctgaattgctgtgtgcccctagggaagtgaaccctgtctctgggctgcagcaggagcagattggctgggattgctgcccactgggtggtggagtcaacctctgaccacgagaggccaggtggcctgagaggggagctcctacagcaggctcgcggtgtgttggttccgatgaatcccgacacactggaagcctgaggctgaggagggagacacacacctccactcactctcctttgcaccttagggcttttcacagctctaaggttaccagcatggcttagaagccaggcagaacaatacctacgagaccctaggcagggtatctccctgtcctcagcctcagttttctcatctgtaaatgggatgaggacatggcggtactgcgaagcgtaagtgccgtaataccgtagtgtgtgccaggcaccataccgaggacagtacacctgtggtttcacttaagctcttcctggaactcagttttctcatctgtaaaacgggataataacataccctaagggtttctgtgatgactcactaagagaggggatgcaaagtgcttagtgcaggcctggcccggagcacaggctcagcaaatgatggcttacacccgaaaaaggactggagtctctgactggtgtgtgcggtggatgtgacacgggtgtgcaatgtgctgtgcttggtggcaggtcacacaccacacatgggaggtactggattctcttgttgcccactgggtggtagagtcaacctctgtccacgagaggcccagatggcccaccccagcgtcctccaccttgccctgttctgacttgggaatggctcctgagatgctgggagacccaggagcggagagagtgcccttgggggtcacgaagactttgcccacagtggactggcctggacggtttccacaactcgtccctccctgctttccttcttttcttgagacagggtcttactccattgcccaggctggagtgtcgtagtgcaatctcagctcaccacaacctccacctcctgtgctcaagcgatcctcccacctcagcctcctgagtagctgggactaaaggtgtgcgccaccatgcccggataatttttaaatattttgtagagatggggtttccccatgttgcccaggttggtcttgaactcctgacctcaagtgatctgcccacctcggcctcctaaagtgctgggattccaggtgtgagccactgtgcccggccctccctgctttcctagctccatcctgatctttcagattggaagtcaagtccctcctgtgctcaagacttccccgcggcctccacctcacttaggatgcaatctgcagcgctcctagccgcgctgaggtcctctggtccctgctatatacccatagagcttcacttcctacccccaaccccatgctagcctcagaagtccccatgctgccttgagcctcctctagcctcctcggccccaggtccaccaccctcactcccccggactccctggactcccaggtccggctgtttctaactgtctcccatgggacctgctctgtctgctcacttgctggagcagaaattctcacactgcctgaaaagcatccagatacacgttgacatgcatgagagaatggtgcttggaggtcttgccaaagcgtgtgggggtcacccacaaaatgtgctcggtgctggacaagtggctgtcactcaacacacagtcaaggaactaaacggaattcaaagagcaccctcgcatttctccccgctgctttagggtccgctcttttttttttttttgagacggagtctcgctctgtcgcccaggttggagtgcagtggcgggatctcggctcactgcaagctccgcctcctgggttcacg

SEQ ID NO: 702 - DNA, 908 bp, Homo sapiens
atttttaaaagccggccggcagaatgtctccttagccttaacggacccgcttcctggtccctcagctgcttctgatgtttcttcttgcctaagaaaaaataaaatgtggtgtacagtaaacttttaatgaaaacacagcatcccaggagactgaacgcctgccgctgtgtgtttccactgttcaacagctgacacagggattctgatgccgctgctgtgctgcttagtttctctgaacactttttttttttaactgtactaatggtatgtcattttttctattgttaagcactcatgtgtgaataagtgtaagaaaatgatggcttatcaggagcatataaattcagagtcaggagctaggcacggtggttcacgcctataatcccagcactttgggaggccgaggtgggtggatcacctgaggtcagcagttcaagaccagcctggccaacatggtgaaaccccgtctctactaaaaatacaaaagtcagctgggcatagtggcaggcgcctgtaatcccagctacttgggaggctgagacaggagaatcgcttaaacttgggaggcagtggttacagtgagccgagttcgcaccattgccctccagcctgggtgacaagagaggacgacgtgttagatcactttcaaatccacaccaagtggagactctgctggatgggcggagcgcaggctggctccaggccttcctgttcctggctccgccaccaccgggcacgctcaatttcttcccctcacattcacccagaatgggtctatgtccagcctggtggggaccctgcctgggctgggggcttgtctccccaccaaagaggagatatagcaggtacaggcaccagcacatggcggggctcagaatatccccgctggattgaatatgtgacttcag

SEQ ID NO: 703 - DNA, 1515 bp, Homo sapiens
tgacactttatttcttgttaagggtgacagcctgcaaggtagccatccagcagcctgggaagagcagcctctggttaacaccagagacagacatttaggagcaggaggggtttgggcaggagctttatgctgaagaggttggctaaacatacatattcaacaggctacaggaggagctatgaatattcatgtaggtggttgcagtccatgcttattgaacaaacatgtgtggaacatatgatcccagccgggcatagtggctgatgcctgtaatcccagcacttggagaggctgagacaggcggatcacctgaggtcaggagttcgagaccagtctggccaacatggtgagaccccatctctactaaaactacaaaattaaccaggtgtggtgatgcatgccttttactcgggaggctgaagcagaagaatcgcttaaactcgggaggcggaggttgcagtgagtccagattgtgccattgcattccagcctggacaagaggagcaacactctgtctcaaaaaaaaaaaaaaaaaaaaaaaagatgatatttggaggcagagagatcccagaggtgcgtgtgcatagaggaaaggccacagaggacacggctggaagagactccctgccagccagaaggagcggcctcagaggaaacaaccccacccacccctcgaagttggacctgcagcttccagatctgtgagaaaataaatgcctgccatgtgggcacctggcctgggacatcttctatggaggccacagcatgaaagggtcatttttatggagaatctcattctctaaaacttacatctgctttgaaaatgtcaaatcaaatttaaagtgtttagaagagcctctaaatttcatatttcatttgcaaagaaagaattgtaatttgagacatacacggagtccggatggtgttcaccatgttgagagagcaaagagatggcaattatagaaggagaaatgttctcttgccctatgtaaagcccatgggcactaggaagggctgggagctgggaggttctattgctgagtcgctgcgtttggagcaaggagtccaagacttacagccatttatcgcagaagctatggataaagctggtttcagggtacaatgcacagtctcaggagtcaggcttgcagagaagtccatttcggaaacaatgttgtgtggcctgactgcttttcctccctggctcctggcctctgttttagctgggtaggacatgaatgacccaattcataggatgaaatttacaaaggatgtttctcaaaacttcgggttttcaacttacatatattcacacctgtttaggttgagtttatttatcgatttattttcaggcagggtctctatctgttgcccagacccgagttcagtggcgcgatctctgttcactccagcctccacctctcgggctcaagtaatcctcccacttcagcctcccaagtagcttggactacagatgcatgccaccacatctggctttttttttttttttttttt

SEQ ID NO: 704 - DNA, 1515 bp, Homo sapiens; identical to SEQ ID NO: 703

SEQ ID NO: 705 - DNA, 1515 bp, Homo sapiens; identical to SEQ ID NO: 703

SEQ ID NO: 706 - DNA, 1515 bp, Homo sapiens; identical to SEQ ID NO: 703

SEQ ID NO: 707 - DNA, 6597 bp, Homo sapiens
ccgtcgcccccagcgcgtgcccgcccggcgccctctagggtggaaggctgcgggcgtcctaccagtgccaggactgccagagcgggaggagcgcggcgcgggccagccgggactgctggacagcggggtccaggctagaggcgagcgagcggtcagtgacggctgtggaggagggaggcgctgggcgtcagcgcgggacccgagcctctggaccactgagctggggggctggctgaggtccacctcctaacaaattattggaaggaatatgagaaaaatggagtttcactcttgtcacccaggctggagtgcaatagagcgatcatggctcactgcaacctctgccccccgggttcaagcgattctcctgcctcagcctctcaagtagctgggattacaagtgcccaccaccacgcccagctaatttttgtatttttagtaaagatggggtttcaccacattggccaggctggtctctaactcctgacctcacgtgattcatccatctcagcctcccaaagtgctgggattacaggcatgagccactgtgcctggcctatacttatattttcttctgtgattttaatattttagtgtttatgttttggtctatgatccattttgagtaaatttttatatttggtataaggtaggggtccaactttatttatttttgagatggaggcttactctattgcccaggcaggcatgcaatggtgcgatccagctcactgcaacctctgtgtcccaggctcaagtgattctcccacctcagccatctgagtagctcggattacaggccccatcactatggtaatttttaaatttttagtagagacggggtttcaccatgttggccaggctggtctcgaactcatgacctcaagtgatctgcccgcctctgccctacaaagtgctgggattacaggcgtgagccaccgtgcctggcctccagctttattctttttttttttttttttttgagacagagtcttgttctgtcacccaggctggagtgctggagtgcagtggcgcgatctcggctcactgcaagctccgcctcctgggttcacgccattctcctgcctcagcctcccgagtagctgggactacaggcgcctgccaccacgcctggctaattttttgtatttttagtagagatggggtttctccatgttagccaggatggtctcgatctcctgacctcgtggtctgcctgcctcggcctcccaaaagtgctgggattacaggcgtgagcgaccatgcccggccaactttattcttttagatgtggatgtctagttgttccagaagtatctgttaaaaatgttactctttctccattggattattttggcaaccttataaacaatcaattgaccataaatgtatggatttatttctggattgtcagatctattccagtgatctaaatgtctgtccttatgccagtaccatagagtcttgattactatagcttcatggtaagttttcaaatcaagaagtgtgagtgctccaaatttgtttttatttttcaagattattttggctgttctggcttctttggattttcatatgtattttagggtcagcctttcagctgggcatggtggctcacgcttgtaatcccagcactttgggaggagttcaagattagcatgacaaaatcccatctctacaaaacaaaaaacaaaacaaaagaaacattagccaggcttggtggcatgtgcctgtggtcccagctactcaggaagctgagtagcttcccgaggcaggaagatcacttgagaccaggaggtggaggtttcagtgagctgagatcgtgccactgtactccagcctgggtaatggagacagaccctgtctgaaaacaaaaaaattttttaaataggcttttgttttttattttatttaatttttgacacagggtccactctgtagctcaggctggagtgcagtcgtgtgatctcagctccctgcatcctccgccttttgggttcaagcagtcctcccgtctcagcctcccgagtagctgggacttacaggcgtgtgtcaccacacccagctaatttttgtatttttagtagaggtgaccatattggccaggctggtcttgaactgacttcaggtgatcttcctgcctcagcctcccaaacccaaagtgctgggattacaggtgtgagccactgtgctcagcctgttaattttttttttttttttttttttgagacggagtctcactctgtcacctaggttggaatgcagtggtgccatcttggcctcactgcaacctccacctcccaggtccaagggattctcctgcctcagcctcccaagtagctggggttacaggcacgtgccaccatgcctggctaatcttttgtatttttagtagagatggggtttcaccgtgttagccaggacgatctcgatctcctgacctcatgatctgcctgcctcggcctcccaaagtgctggaattacaggcatgagccactgaccctggcccaggagtattgctttaacaatataaggttttctgatttataaacaagaatgtctttccatttatttaggtccttaatttcttccaacagtcttttctagttttcaatgtacaagttttttgcgcttctgttacatttattcctggccgggcacggtggctccgcctgtaatcccaacactttgggaggccaaggcaggcggatcacctgaggtcaggagtttgaaaccagactgaacaacatgcagaaaccccatctctactaaaaatgcaaaattagctgggcgtggtggtgcatgcctgtaattccagctacttgggaggctgaggcaagagaattgcttgaacccgggtggcagaggttgaggtgagctgagatcacgccattgcactccagcgtgggtaacgagtgaaacgtctcaaaaaaaaaattattcctaacattttattcttcctttttttttttttgagacagagtctcgctctgtcaccaggctggagtgcagtggcaagatctcggttcaagccattctcctgcctcagcctcttgtgtagctgcgactacaggtgcataccaccatgcccagctaatttttgtatttttagtagagacagggtttcatcatgttggccaggatggtctcgatgtcttgacctcgtgatctgcctgccttggcctcccaaagtgctgggattacaggcatgagccactgtgcccggccaatttttttctttttgatgccagcctttgtcctctgtctttaagtaggatgacctcatcatgaacataatactgtctggagatgtttccttggttgtaaaatgagaagcctagggagattatttttatgcttccttagttgtccccttcccctccacttttcagtgtttagtctgtattttgagtctgcttgagtgtccctatgacacatctgctggttaatttgcagccaccagtggggcttctctgctgtaaaggagataaaggacatggaaaggaatggctttggagtccaacaggccattgtcctggtaagccttttactggctatgtgatcttgaggaccttatttcacctgagcttgtttttcatttgttgagtggggctgttattgaggagtcagtaagcgaagtgaatgacagcacctggggcactgctagcacactggacccatttcatagattgatgtgctgtaacagcccaggagggtctcactcggccaccctagcagaaatgcagtgccacaatcatggcttatagcagcctcgacctcctgggctcaagcaattctcccccctcagcctcccaagtacctgagactacaggtgtgtgccaccatgttttttttttttttttttaattattttttgtagagatgagggtctcactctgttacccaggctggtctccccactcctggcctcaagtaatccttcctccctcagtctcccacagtgctgggattacaggtggaaacctgcacctggcctcttcctaacttttcattgtgaacatccaaaaaactacaaacgttgaaatcatcttattatattgctgactctggattaatccgtatcttctacctccataacactatttctgatctgggaaagggcagcttttccccccgcccttctttttttttttttttttttttttgagacggagttttgcttgtctcccaggctggagtgcaagggcgtgatctcggctcactgtaatctccgcctcctgggttcaagctattctcctgcctcagcctcctgagtagctgggattaccagtgcccgccaccacgcccagctgttttttttagtagagatggggtttctccatgttagccaagctggtatcgaactcctgaactcaggtcatctacccgcctcagcctcccaaagtgctaggattacaggtgtgggccaccgtgcccggggcctagttttgtatttttagcagagacggggtttcaccatgttggccaggctcgtcttgatccacccatcttggcttcccaaagtgttgcgattacaggtgttagtcaccgtgcccagcctccttcctatttaatgacttctgcccctacttcctgctttcatcattgcagtaagaatgcactggtctaacacttcaacccggctgtctttagccagaggcagagctttgaaacctgggaatttactgcttggaaatgggatggaattctaaacatttcccttttgagggtttattcacatgaatcctgggcccctagtcttagggagctggaaggccgtatttctggaacaggtgttcactacttccgtttatcgggtctcagccaagtagacctggagctgctccctagcagaatgtggtgcactcttctgggcgccgcctcctctcctcctcttcctatctctcctccaacatccagcttccatgctaccctttccagaaacatttccaattcccatcagctaggttttctttcatggattccctcttgcattccttgcatagatcacttggtgctttgtactttgtcatgctgtcttctagaccttaagctggttaggttgagggcagggctgcatgctgttcatgtgtgctctgcctggcctggcacagatgtagctgctccatggatatctgcggggtcactgagctgaagcaggtggatgctggatgcttgatactagatacattttctggggctggctctgattaatgctgagtgagttcacctcacattaagatgctggtaaggtggctcatgcctgtaatcccagcaatttgggaggccaaggtggaggatcacttgagtccaggagttcgagaccagactgggtaacatagcaagaccctgtctctataaaaattttaaaaagtcagccaggcatgatggtacacacctttgagtcccagctactagggaggctgaggtaagaggactgcttcagcccatgagtttgaggctacagtgaactacaattgtgccactgcattccagcctgggtgacgagactgtcttaaaaaaaaaagatgctggttgttttcagactaaaatagtagcaacaggtcaacgtatctgaaatcctttagcagtcatatatggttagtgtaaatctctgtgataaaagaaagatctggaattgataccaaagcagctcagtactttttagtgtactaacacatttgttttaacaacttgttcacagctactgcaatgttcagatggaggatcaataatctctccattctttgagcatctagcatattactggactcatgtgtaatctctctcagccttctaggttttatttccacacattttccttcccttcaacccgattccaactgacttctttgtattcagttagcaaacaggagtgttcccctagcttcatcttctctgtttttaaaagacggagtctttggagtgcagtggtgagatcctggctaactgcaacctccaccaggatctgattctcctgcctcagcctcccaagtagctgggacggcaggtgcccaccaccacgccctgctgatttttagtagagatgggggtttcaccatattggccaggctggtcttgaactcctgacctcgtgatctgcctgccttggcctcccaaaatgttgggattataggcgtgagccaccatgcctggcaagtcttgttttttccaagaagttacttgggacttaggcagatatgatccgtcttcttaggtcctccttctcatccctgtaagatgaaggtgattggaagaccatgaggtcatccttaaggggtcctgtatcaaggtgttaagtaggttatcacttccaccttgactgttagctggtacctgcagtactttttcccagaactttggataaattcaccaagatctacttgtgaatacattatacgtagtagattaaagaggctataagctaatgctttcactttttcctctgaatcctaagcattaggcacttaaaacgggtgtactccaagacaaagatgtgttatcaagtgaaacaaagtcagggtgtctgtctcacacagtttatttaacaataggtaataagaaatcaaatttaacagtctatacagtgatccaaag

SEQ ID NO: 708 - DNA, 546 bp, Homo sapiens
agagagctcagctcagagataaaagctatgggagggtgcactgatgtctgagtgatgtttaaccatgccggtccaggtacagtgcctgtctccggaatgatgcagggatcccaaagtggagagaattagacctatcgcatttgtgattagagtgggcaagaaaagcaacaaatgatcaggagaattgggggcttacccagtgagcgaagctttggcaaaaatgtaaagccgtgcagcacaatgcaagaggaggccaaggactccctgcaaaacctcaacttcaagcctaaaacagcctgaaggttgaaaaactggactgctggctccagatgaagtccaccctttcccaactgattctttctgaataatgcccacctgcacactcagaggatggggtggggccatgcaagctccctgccgggaacccagcctcttgagctcctatgtggtggggcaggagccagttcacaggcttccctctcactctgctgagagtttttctcttttccttttttttgcccaataaattccatttttctcaccctt

SEQ ID NO: 709 - DNA, 3826 bp, Homo sapiens
ccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggaaggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttaggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttggaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctcacgtaattgctgttagccacctatccccaccccctttttttaactgtg

SEQ ID NO: 710 - DNA, 3826 bp, Homo sapiens; identical to SEQ ID NO: 709

SEQ ID NO: 711 - DNA, 3826 bp, Homo sapiens; identical to SEQ ID NO: 709

SEQ ID NO: 712 - DNA, 3826 bp, Homo sapiens; identical to SEQ ID NO: 709

SEQ ID NO: 713 - DNA, 3826 bp, Homo sapiens; identical to SEQ ID NO: 709

SEQ ID NO: 714 - DNA, 3826 bp, Homo sapiens; identical to SEQ ID NO: 709

SEQ ID NO: 715 - DNA, 3840 bp, Homo sapiens
cgagaacgcgattggctgaggcgcgcgcgcgcaccggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggaaggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttaggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttggaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctcacgtaattgctgttagccacctatccccaccccctttttttaactgtg

SEQ ID NO: 716 - DNA, 3882 bp, Homo sapiens
ggtgccacaggccccggccctcctatctgggcgccaattagccagcccatccgtcgctcacgaggtcgcgcctcgcacccgccttcctccttttcttttaccctccccttcagaaaaaacggcggttgggctgcgacggccgccaaaggcggactagaagcggaggggtgaaaatcccggcagagaaggaagaagggactgcaggcgggaggaggaggaggataaggaggaagggagcccgcccagccggagccatctccgtcgagaacaaaatggcggcgctggcggagggccaactataaggcggggccgcggccattccccctccacccccacccttgcgccggccgggccggtcagggggaacccgctcgcttcgcccggccgcgggcggggaggggaggggagcggcccggcccactatgcaaagcgccgggcgccgccgccgccaccccgtggcaaagaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggaaggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttaggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttggaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctcacgtaattgctgttagccacctatccccaccccctttttttaactgtg

SEQ ID NO: 717 - DNA, 4522 bp, Homo sapiens
gccatggaaaaaccctcgtttatttgattaaacaaaaataaaataagctgcataggaacaattttaaagtccaaagagacaccaactttgttttaaggctgtagtagctgatacagcatctccttgctacctcctccagccttctctgtggaccacagtgatacattcagaagcctgttagctaacacaggagtttttgaacacttttccattggttcttcacctgctcattgcctgtcatgcctgcggcctgcaatagtaacatttaagatttaaaatgtgaaagccaaaagaggaggggggaaaaaaacccaaaatcaaccaaacaaaaactcacttttgcctaaaggtttggggggaaatcttcatttccccacccatctactgcattgatgggattcacattaccacggcagtgcccatttaaaagtggcaaatggcagtcagcaccccaccccggacaggcttgcagtgtggtttctgcggccaggggagttactacggtagtgcatattccttatatcatgtctgccttggacaaattcgaaatacagataaaatatttttctcttgaagagaaagagacctaaaggtctttatttgtagttaagtcctccaataggtcagattaaccagtagtttcataatactgaacaacagtaatggtatgcataattctttttgagggggaaaagccagattgctaagaactacttggatttatgactacatttgcctgacatttctctttcaaggtaagtagaacatttctcctgggagaaatcagttgtagatttatggtaacatttcttttagaggtagcttcccactcccacccactgcccactggattaatactattctttttgagacctgtcagatgctaacatgaggtagatgacttgccacaagtgaggtagaaactcagcaaaagcagtcagtgtggtctggaatgctgcgtcctgtgcccttggccctatagaaaaccagagaaagccgtagagctctggaggccctggccctgtgacaccatcacctgcaagtacaagagtgtgacttttatacagccccagactgttggaaactcattcagagtgatgttttaaatataccttaaacataccctaaatactttttggcaccactggattaaaaaaataagatcagaaaaacaagcctaaaactttggcatatctttcaccacctaccagaacagagcaatcgtagaatcttccaacgaggaaggtaacacatatataaacagtattttgctgcttcaagcctaaaagactttcctcctcaaataattaagctttggcttaactagaataaatcagactgagccgatctcaagctatctcttgcaactccatcacaaagtgcctcagttctggcaacatttttggcccaacacgtaatttggattcggtttatggtaccctttgttatgtgtttcccaaataagttagacttaaaagggcattgaggagttagtgcacttggggtacaacccaggtcactgtgctctagtcaacttgagtgccacttgcagccacaacagggcacatgttctgagacagcattagatcttgggaccaaaaataacacttttgaaatgttaagtcagtgtcaagcaaaagtagtttttacctatgggttagatgtcctttaaacatctcaatactcaaacctatatatccaaacccaatgggcatctccacacataaactgagcttacatcataccccacccaacccttgccacctgaccagatcagacctccatggggactagtaattgtcatacttactccccagaaacctttttattctcctacctcataatacccaggaccttattttttccatcaggatgacgactcccttctttgacccaactcctggctacctggcattacccgggcaggagattatgcatttaaacacaggtacttttcacagtttcacactagggactgccaaatgttggcttttatcatctttctttgatttagaacatttcacatcatacaataaacactctccaaagtgcttcgcaccaatccctatgggtcaggagtcaaccacgggcaggaaaaaccgccaatgttttaaaaacaaaagctttccaaatgtgaccatgtttctcaaataccagtcatgcaccattttgggtacagaaaggtaaggagatagatataccaccactgaggacaaagaggtagtatctctgacctacacacctatttcaggggatagttctagttgctctaagcctgcaaatttacaagtctgtaaattaagacctgataatttcagccatggagcgaaaatcttggcttttcgatcacatccatagtaaaatgtcaaataaggagctctagttactgttatgcaccaagaacatttctcattcaggtcccaaaattttcctacatctggggaaattagaaagaaaagagcagaatgaaaatgatgatgaaaagattttaatcaagatccatctcctcaataaaatttttttcaagcatttaaaaccagttgtctttggtgtttaaagggtggcttgttgggcagctggggaaagggaaggaagatcagcaccaagttactccaaaatagaaaacagtaaaaatgtttaattatattaactctttaccaaagaacttagagcttaacggccaaaaggcaactgaataggcattggggaaggattcactattaaattctacagtaaaaggagcttctaacaaacaacatttcctaacaccttcccaccctgtaacagcagctgggagccagcagcagtttgaagctactttccaacttttgaatcttttattgcatgcagttctcctctgtgagatgaggttttttttttccttcccattttggtcactcagaaaccctagaattaaagcaatgggaagagacagagtagcttgtagtagtagtaaattaaacgtccaaaagaggtgtacgggaaaagcaacttgattgacttgtcacactgtccccatcatctccttttctattgggataacagaaacaaattgctccatttgttaatctgttctgctcatttaaaacgatacccattttgcaatagaaatttctcttaaacagaggaacagaagttgatccataagtctttaaacaagaggtctcccttgtaagtcactgacgtttgtttgagagtccctcttttccctgaggagggctcctccagaatttggttcttatttcagtatttggggcattgcaggaacccactgggttctgacaagcagggtatcagctacatctgctttgcacttgaaagacagacaatgcccagaagcacaagttttgtacccaagtccagcttacaaccaaccaatcctgtaaagtgacacagattctaccccacagttctgcagtgggagccttaaattttcattctttggtaccgagttacaggtttaagaaaagacattacatcctacatttcaggttgggacaatttggtttctagatcctttatggtcaaaggccttggggggagagggggcggggggattcatgttaaccatgaggtcctaaagcatggcctgggtgcaaacaatcctataaaaagtgacccaagcagagggtgtgggactgggctgttggtattaatttgactttcaaaccttctatttccctgaactttcaaagcaggaaaaaattgtgcttgtaaaataaaagttctttcctttgcctactcttcttaggaaaagaaacccctagcactacagaacaacatgcactcgcgggtcagggcagaccctgccctttctgtggagttcctatagtttgggggtgccttgttctttaatgtgctccctgactccctcagcacacgcatgtccacccacattcatgtccacgtcagcccatgcctgaaaaccctctctctgagaacgaggttaatttcctttttccttccatttaaccctttataacctaacagcaaaataagaaagcataacttttgagaatatgtttaatcaaaaatcctgagctaccatctatatacttttttaagaaaccaaagtgtgaaaaggagaggttctttgggaggcagtgtgtcattttcagctttactacttgggtgcaagatggctttgaaacaaacatgcacacaccctcccttaaaagaaacaaagattatataccctaaaatatgaagggtctgcttttcttggctagcaagccacagccacaacgtctaagatcaagaaacgatgcagaagaggatgttaaacacactgaggtataaacagagaacagaggaaatttctctgttgcagcatttaaaaagagaagattttccaaaaagatcaaaacaacacaacataatctaaaccccatataaacagtattctcaagaacacaggtattctataattatgcatttcaaatcctattttttccatgttttatagttttttgtttttttacttagtagtttttttttgtgtttccttggctcaatctacaga

SEQ ID NO: 718 - DNA, 1849 bp, Homo sapiens
tgggcaacatagaaaactttgtctcttaaaaacaaattgtcaaaagttttctttatgaaaaatattaaatcatcaggctttttaaatgatatgatttttagattaagacaatcttgcctcactgttgatggctgctgaatgatcggtgtggtggttgctgaaggttagtgtggctctagagatttctttaaatgagacaacaaggaaggctgcaacatcaactgactcttcctttccgaaagatttatctgtagcatgtgttgctgttggatagccttttacccacagtggaacattcttcaaaattgaagtcaatcctctcaaactctgctgctgttttatcaactaagtttatgtaatattctaagtcctttgttgtcatttcaacaatggtcacaggatcttcaccaggagtagtttccatctcaagaaaccacttttgtggctcttatattagaagcaactcctcatttgttcacgttttatcatgagattgcagcaattcagtcacatatgcaggttccacttctaagtctagttatcttgctatttccaccacatctgcagttacttcgtccactgaagtcttgaacccctcaagatcatccatcagggttgaggtcaatgtcttctgaactcctgttaatgttgatattttgaccttctcccatgaatcacaaatgtccttaatggcatctagaatgatgaatcctttccagaaggttttcaagttactttgtacagaacaaccactatggcagccacagccttacaaaatgtattccttaaataatacttgaaagtcaaaattactccttgacccatggagtaatggatcctgcagaatggatgttgtttagcagacataaaaacattaatctctttgtacatctccatcagaactcttgggtgaccagacacattatcaacgagcagtaatatttggaactaaattttttttttttttgagacagtctcactctgttacccaggctgaagcacagtggtgcaacctcagctcactgcaacctctgcctctggattcaagcaattctcctgcctcagcctcccaagtagctgggattacaggcacacaccaccacatccagctaatttttgtatttttagtagagatagggtttctccatgttggtcaggctggtctcaaactcctgacctcaactgatccacctgccttggcctcccaaagtgttgggattacaagtgtgagccaccacacctgacagaattcttttttcctaatatttagtaggtctcaacagtgggcttaaaatattcagtaatccatgctgtaaacagatgtgctgtcatccaggctttgatcttccatttctagagcacaggcagagtggatttagcataattcttatgggccctaggattttctgaatggtaaatgagcattggcttcaacttaaagttaccagctgcatgaacccctaacaagagagacgagctgtcctttgatgcttttaagccagggattaacttctcttctccatgaaagtcctagatggtttcttcttccaaaagaaggctgtttggaatacactgaaaatctcgtggtgtagcaacttcatcaattaacttagctagatctggataaattgctacagcttctacaccagcacttgctgcttcaccttgcacttttatgataagatgacttcttaaacctcatgaaccaacctctgctagcttcaaactttcctgcagcttcctcacttctctcagccttcatacaatggcagttatggccttgctctggattaggttttggcttaagggaatttgtggttggtttgatccagacccctaaaactttctc

SEQ ID NO: 719 - DNA, 4629 bp, Homo sapiens
ctttgggaatgtcaggcctctgagcccaagccaagccatcgcatcccctatgacatgcacgtacacgcccagatggcctgaagtaactgaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgaccccccgctcctacccgccagagaacaaaccccctttgactgtaattttcctttacctaaccaaatcctataaaacggccccacccttatctcccttcgctgactctcttttcggactcagcccgcctgcacccaggtgaaataaacagcctcgttgctcacacaaagcctgtttggtggtctcttcacacggacgcgcatgaaatttggtgccgtgactcggatcgggggacctcccttgggagatcaatcccctgtcctcctgctctttgctccgtgagaaagatccacctacgacctcaggtcctcagaccaaccagcccaagaaacatctcaccaatttcaaatccggtaagcggcctctttttactctgttctccaacctccctcactatccctcaacctctttctcctttcaatcttggcgccacacttcaatctctcccttctcttaatttcaattcctttcattctctggtagagacaaaagagacatgttttatccgtgaacccaaaactccggcgccggtcacggactgggaaggcagtcttcccttggtgtttaatcattgcagggacgcctctctgatttcacgtttcagaccacgcagggatgcctgccttggtccttcacccttagcggcaagtcccgctttcctggggcaggggcaagtacccctcaaccccttctccttcacccttagcggcaagtcccgcttttctggggcaggggcaagtacccctcaaccccttctccttcacccttagcagcaagtcccgctttcctagggggcaagaaccccccaatcgcttattttcacgccccaacctcttatctctgtgccccaatcccttatttccacgccccaatctcttatctctgcgccccaatcccttatttccgcgccccaaccctttctctgcttttctggaggggaagaaacccccaccccttctccgtgtctctactcttttctctgggcttgcctccttcactatgggcaagcttccaccttccattcctttcttctcccttagcatgtattcttaagaacttaaaatctcttcaattctcacctgacctaaaatctaagcgtcttattttcttctgcaatgccacttgaccccaatacaaactcaacagtagttccaaatagccagaaaatggcactttcaatttttccaccctacaagatctaaataattcttggcgtaaaatgggcaaatggtgtgaggtgcctgacgtccaggcattcttttacacatcagtcccttcctagtctctgtgcccagtgcaactcgtcccaaatcttccttctttccctcccgcctgtcccctcagtaccaaccccaagcgtcactgagtctttctaatcttccttttctacagacccatctgacctctcccttcctccccaggctgctccttgccaggccgagctaggtcccaattcttcctcagcctctgctcctccaccctataatctttttatcacctcccctcctcacacctgctccggcttacagtttcattccgtgactagccctccccgacctgcccagcaatttattcttaaaaaggtggctggagctaaacgcatagtcaaggttaatgctcctttttctttatcccaaatcagatagtgtttaggctctttttcatcaaatataaaaatctagcccagttcatggctcgtttggcagcaaccctaagacactttacagccctagcccctaaaaggtcaaaaggccatcttattctcaatatacattttattacccaatctgctcccgacattaaataaaactccaaaaactggaatctggccctcaaaccccacaacaggacttaattaacctcaccttcaaggtgtgaaataacagaaaaaagttgcaattccttgcctccactgtgagacaaaccccagccacatctccagcacacaagaacttccaaacgcctgaactgtagcagccagacgtttctccagaacctcctcccccaggaacttgctacacatgccggaaatctggccactgggccaaggaacgcccgcagcccgggattcctcctaagccgcgtcccatctgtgtgggaccccactgaaaatcggactgttcaactcacctggcagccactcccagagctcctggaactctggcccaaggttctctgactgactccttcttggcttactggctgaagactgacgctgcctgatcgcctcagaagccccgcagaccatcatggacgccgagctttagcccgcctgcacccaggtgaaataaacagccttgttgctcacacaaagcctgtttggtggtctcttcacacagacgcgcatgaaagggaagacatacaaaaacaaggcctctgaggtaggtactactgagacagccaggtgggaaggactccttggcaaaactccaaccagcctgtacactgggaggaatgtgcactgggatggagccatagaagtttgtgtcgtttgcagtggggaggagcctggtccctcctcttcctgtgaggaacctggaattcaatctgtgaggttgttctggagatgttctggggagactgcattaaacacagcttcgcaccattgaataaactcagcaacaagccaatgcataaaagtaatctatgcttcaggtcacagaagcttcaaggggaaaaaaacagaatactctagggccattgttcacaaactcatctgaaaacatcctggaaaaattttcccaaacacatggaaagaaagagaggaaaaaagaagatatctgaataatgtggactagaataaagagctgccaggagctgtttatttaaaaacagtactttcttctctggctgagtccctggtattctctgctgcaatctgtagctgtagaattttgaagaatgcaattaaattcaaatggtttgatgagtaatatcttttctcttcatatttgtctaaaacttttctttattgaatagcgagagtgatgaaagtgttttccataataataacaatgacaagggcctgatgatgaactacaattagctcagtgattcatcagttagcagtgaaattttcaatgcatcctgacatttagagcatttggttgtgattaacagtctttgaaatgtcaccgaattttatttaattggctaagaaaaaattttaaaaggtaatcactgcaaagatcacattcatcgccaaaaatgataattgcagttgtcacatgacaaggtagatgctaactactgtagcaaacttgctctgtgttcttacagaatctaatgaatgcagcagagatcaagagcttgaaggggcttagaagtttatttgaatgctcctttcaaagccatttgtatcaagaactgcaagcctttaagtcatctgagcaaataccaaaactgaaatgcagtcatgacactggctcaggactgagatctaaacagtcatcttcgtggcaacaggtattattggtaaaagagagtctggaaattagggcctagcctttcttgagaggccagtatagctgagtagtaaaaagtcaagttttggagtcaggtgtaactaacccacaatccaagttatgaactgtggagtgaatgactcacctgcctgggcttctgcttgctcacctgcaaaatgacaacagcctgccctacagagctgcctgcagaccaacagcagcaaggccttgggagtctctgctggtctcccagctcctgcttgacacctcaagatgatgttgctccatttagtgcctgtttgttctcagactatcccatgccttcttcctgcaaaccacagctctcaagctccccaacagtttgacaaggatcatacaaaggggaaaggaagcaaggaaagaatcaaggtctttctaagcaatttctctacgctctcaggggataggcattttctggccgtgactgtgtctcctccatagttccaacttccacaggacaggtccttccctccatagtcacagttcttcttgggtagcctcctccacacttctgaatggcccatctgaatggccacagtgactcggcgctgatgtcacccctcctgcctgttgtaccccctgccctagagaggagatgcctcctgctgatgctaatctgtggattgcttcattctctggtttctcagcttttccatcccttatgccatcaattgcccgaattaaactcctactatttaaaatacctagagtggtttttatttttctgcttcttaacatcttcactgctatctccctagtccaagtcaccattatcttacccagataacttaatggcctccctgttattgtccttgccctcctagggttgcttctaaatacagcagccagaaaaatgctgttgagttcaag

SEQ ID NO: 720 - DNA, 4629 bp, Homo sapiens; identical to SEQ ID NO: 719

SEQ ID NO: 721 - DNA, 7300 bp, Homo sapiens
ctttgggaatgtcaggcctctgagcccaagccaagccatcgcatcccctatgacatgcacgtacacgcccagatggcctgaagtaactgaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgaccccccgctcctacccgccagagaacaaaccccctttgactgtaattttcctttacctaaccaaatcctataaaacggccccacccttatctcccttcgctgactctcttttcggactcagcccgcctgcacccaggtgaaataaacagcctcgttgctcacacaaagcctgtttggtggtctcttcacacggacgcgcatgaaatttggtgccgtgactcggatcgggggacctcccttgggagatcaatcccctgtcctcctgctctttgctccgtgagaaagatccacctacgacctcaggtcctcagaccaaccagcccaagaaacatctcaccaatttcaaatccggtaagcggcctctttttactctgttctccaacctccctcactatccctcaacctctttctcctttcaatcttggcgccacacttcaatctctcccttctcttaatttcaattcctttcattctctggtagagacaaaagagacatgttttatccgtgaacccaaaactccggcgccggtcacggactgggaaggcagtcttcccttggtgtttaatcattgcagggacgcctctctgatttcacgtttcagaccacgcagggatgcctgccttggtccttcacccttagcggcaagtcccgctttcctggggcaggggcaagtacccctcaaccccttctccttcacccttagcggcaagtcccgcttttctggggcaggggcaagtacccctcaaccccttctccttcacccttagcagcaagtcccgctttcctagggggcaagaaccccccaatcgcttattttcacgccccaacctcttatctctgtgccccaatcccttatttccacgccccaatctcttatctctgcgccccaatcccttatttccgcgccccaaccctttctctgcttttctggaggggaagaaacccccaccccttctccgtgtctctactcttttctctgggcttgcctccttcactatgggcaagcttccaccttccattcctttcttctcccttagcatgtattcttaagaacttaaaatctcttcaattctcacctgacctaaaatctaagcgtcttattttcttctgcaatgccacttgaccccaatacaaactcaacagtagttccaaatagccagaaaatggcactttcaatttttccaccctacaagatctaaataattcttggcgtaaaatgggcaaatggtgtgaggtgcctgacgtccaggcattcttttacacatcagtcccttcctagtctctgtgcccagtgcaactcgtcccaaatcttccttctttccctcccgcctgtcccctcagtaccaaccccaagcgtcactgagtctttctaatcttccttttctacagacccatctgacctctcccttcctccccaggctgctccttgccaggccgagctaggtcccaattcttcctcagcctctgctcctccaccctataatctttttatcacctcccctcctcacacctgctccggcttacagtttcattccgtgactagccctccccgacctgcccagcaatttattcttaaaaaggtggctggagctaaacgcatagtcaaggttaatgctcctttttctttatcccaaatcagatagtgtttaggctctttttcatcaaatataaaaatctagcccagttcatggctcgtttggcagcaaccctaagacactttacagccctagcccctaaaaggtcaaaaggccatcttattctcaatatacattttattacccaatctgctcccgacattaaataaaactccaaaaactggaatctggccctcaaaccccacaacaggacttaattaacctcaccttcaaggtgtgaaataacagaaaaaagttgcaattccttgcctccactgtgagacaaaccccagccacatctccagcacacaagaacttccaaacgcctgaactgtagcagccagacgtttctccagaacctcctcccccaggaacttgctacacatgccggaaatctggccactgggccaaggaacgcccgcagcccgggattcctcctaagccgcgtcccatctgtgtgggaccccactgaaaatcggactgttcaactcacctggcagccactcccagagctcctggaactctggcccaaggttctctgactgactccttcttggcttactggctgaagactgacgctgcctgatcgcctcagaagccccgcagaccatcatggacgccgagctttagcccgcctgcacccaggtgaaataaacagccttgttgctcacacaaagcctgtttggtggtctcttcacacagacgcgcatgaaagggaagacatacaaaaacaaggcctctgaggtaggtactactgagacagccaggtgggaaggactccttggcaaaactccaaccagcctgtacactgggaggaatgtgcactgggatggagccatagaagtttgtgtcgtttgcagtggggaggagcctggtccctcctcttcctgtgaggaacctggaattcaatctgtgaggtgggaagaagcatgtactagcaggactagtacctgtttcccttttttccctttttgcccaataaatccgatttttcttactcttcaaacttctgcaagcctaaactttcgtggccatgtgacgaggatcctgtctttagctgagctaaggaaaagtcttccaacgctcggaaataacctcattgcttattccaggaacttcttgaaagacccatcaattcttcaatagaaagcatcaaaggacaatttacaccctaagactgaacccctgacctcaaaatctttcccttgctatgttcaccaacctcaacagaaatattaggattcttacctgatcctagccaagccccctccctcatctcccattaaagggtccatcttcaaccaaacttaagtctcaataaatatctggacattgtccttccaactctgggaagctgctaagactctgtccttactgcagaagaaaaaacagccttgtaccctggtcttctcaacaggttgttctggagatgttctggggagactgcattaaacacagcttcgcaccattgaataaactcagcaacaagccaatgcataaaagtaatctatgcttcaggtcacagaagcttcaaggggaaaaaaacagaatactctagggccattgttcacaaactcatctgaaaacatcctggaaaaattttcccaaacacatggaaagaaagagaggaaaaaagaagatatctgaataatgtggactagaataaagagctgccaggagctgtttatttaaaaacagtactttcttctctggctgagtccctggtattctctgctgcaatctgtagctgtagaattttgaagaatgcaattaaattcaaatggtttgatgagtaatatcttttctcttcatatttgtctaaaacttttctttattgaatagcgagagtgatgaaagtgttttccataataataacaatgacaagggcctgatgatgaactacaattagctcagtgattcatcagttagcagtgaaattttcaatgcatcctgacatttagagcatttggttgtgattaacagtctttgaaatgtcaccgaattttatttaattggctaagaaaaaattttaaaaggtaatcactgcaaagatcacattcatcgccaaaaatgataattgcagttgtcacatgacaaggtagatgctaactactgtagcaaacttgctctgtgttcttacagaatctaatgaatgcagcagagatcaagagcttgaaggggcttagaagtttatttgaatgctcctttcaaagccatttgtatcaagaactgcaagcctttaagtcatctgagcaaataccaaaactgaaatgcaggtaactgtaaaacagaataaactccattcaattatagtaacctctgaaccattctaagctccagccacgatcacaattttaagcacgtgtgtgtgtgcgtgtatatgtgtgtgttcaagaaataactttttatttcatattgacttgtaaaggcaggcataatacacaggaagataataatatcacttaaaggtcatattgatgaagtagaaaatattaatagacaaagcttcattttcatgggagattaaccacctctgtgtttgtcaaagagtttagctatttaaaagctcactggcaatagatgatatgaaatgtttctccctatgagataaatgtgcactcaaacaaatatagtgttaatcgccaaccaatctcaagctgggacattttgtaacatttatctttgtgtgtgtgtgtgtgtgtgtgtgtgtgtgtgtttgatggagtctcgctctgtcacccaggctgaagtgcagtggtgcaatctcagctcactgcatcctctccctcctgggttcaagcgattctcctgcctcagcctcccgaatagctgggattacaggcgcctaccaccatgcctgactaatttttctgtatttttagtagagacgggatttcaccatgttggtcaggctggtctcgaaccccggacctctggtgatccgcccacctcgccctcccaaagtgctgggattacaggtgtgagccaccgtgcctggcctatcattgtgtttttttaaaaaacatttattcggctttttgctttccaagatctatattcagctcatgtggttatctgactgaccagactccagaggtatttttacaggggtatggagggttttcctgttcaaaaatgcttccctcacaaagattcaggataaaaaagtccaccatgtgttggtgatttctctgggtcttagtaggccctgtgaaagtgtgaatacaccttcttggagcatacaatattatgccccaaaatgtggttggtgagctgtaacttctacaagatgctaatacggagatgatggtatgatataaagtgttcctgggttagtaagtgtggttaaacacatttttaaaggtttgttcactgcaggacttctcaaggcctttgatatgcgcaagtaccttgtgagtctgcaagaggaggatggcatctcctcaccttgaccacaacccccatgtgggagtaccttggcaggccggcattaaactgcgcatgctatgggaaatagtgtcttaggagggtctgagaacaaaggtgacagatggaagggatggacagagaaagggtaccagggaaaggaacagaaaatagaggaaggggagcagacactcctaatgacttgggcaaagagaaccaaagcatttgtagtgggagctgtgtctagagacctgggttctcagtggtcacagaggtggcacttctcacccagcccagcactgctgaaagggagccaggtcctgcctcatcaggctgaatctcaaccccacgagaaagggaccaccaggaccacctcacgggtgtgtgacatgcacagctgcacaagattacactaagaaagctccgcacttggttcaaggctttgctaccattaccttaaaattctcaataactgtgaacaagaaaccctgtaaactctggctgagtcaggcttctcagccccaatctgccttactccaggggccacagacttaaccatacaacaatctcctaaccctttctccttcgccacttaggccagagaacagggaaagagaaattcactgcagggaagacttccaaacaagggactccacagctcagagaagtctccccctgctctggccactaggtttttgagataaaacgagagggaattttcaaactgtaacaggtcttttcaatatcaccacctggaaagagcctgctgagatgcagagacccaagccctaagaaggcacctgcccagcagcctagtcctctgtcctcgccggctgtgtcactaaaactattactttgctgtcaacagagatgtactgtccaaaacacggactcttacataaatgtttacatcctgtagccaacagccccttggagctcattaggtgaccggggctttggatttgtactgaggaagttgacttggcaccttctctccttatttttctcttctcctctgcagtcatgacactggctcaggactgagatctaaacagtcatcttcgtggcaacaggtattattggtaaaagagagtctggaaattagggcctagcctttcttgagaggccagtatagctgagtagtaaaaagtcaagttttggagtcaggtgtaactaacccacaatccaagttatgaactgtggagtgaatgactcacctgcctgggcttctgcttgctcacctgcaaaatgacaacagcctgccctacagagctgcctgcagaccaacagcagcaaggccttgggagtctctgctggtctcccagctcctgcttgacacctcaagatgatgttgctccatttagtgcctgtttgttctcagactatcccatgccttcttcctgcaaaccacagctctcaagctccccaacagtttgacaaggatcatacaaaggggaaaggaagcaaggaaagaatcaaggtctttctaagcaatttctctacgctctcaggggataggcattttctggccgtgactgtgtctcctccatagttccaacttccacaggacaggtccttccctccatagtcacagttcttcttgggtagcctcctccacacttctgaatggcccatctgaatggccacagtgactcggcgctgatgtcacccctcctgcctgttgtaccccctgccctagagaggagatgcctcctgctgatgctaatctgtggattgcttcattctctggtttctcagcttttccatcccttatgccatcaattgcccgaattaaactcctactatttaaaatacctagagtggtttttatttttctgcttcttaacatcttcactgctatctccctagtccaagtcaccattatcttacccagataacttaatggcctccctgttattgtccttgccctcctagggttgcttctaaatacagcagccagaaaaatgctgttgagttcaag

SEQ ID NO: 722 - DNA, 5685 bp, Homo sapiens
ctttgggaatgtcaggcctctgagcccaagccaagccatcgcatcccctatgacatgcacgtacacgcccagatggcctgaagtaactgaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgaccccccgctcctacccgccagagaacaaaccccctttgactgtaattttcctttacctaaccaaatcctataaaacggccccacccttatctcccttcgctgactctcttttcggactcagcccgcctgcacccaggtgaaataaacagcctcgttgctcacacaaagcctgtttggtggtctcttcacacggacgcgcatgaaatttggtgccgtgactcggatcgggggacctcccttgggagatcaatcccctgtcctcctgctctttgctccgtgagaaagatccacctacgacctcaggtcctcagaccaaccagcccaagaaacatctcaccaatttcaaatccggtaagcggcctctttttactctgttctccaacctccctcactatccctcaacctctttctcctttcaatcttggcgccacacttcaatctctcccttctcttaatttcaattcctttcattctctggtagagacaaaagagacatgttttatccgtgaacccaaaactccggcgccggtcacggactgggaaggcagtcttcccttggtgtttaatcattgcagggacgcctctctgatttcacgtttcagaccacgcagggatgcctgccttggtccttcacccttagcggcaagtcccgctttcctggggcaggggcaagtacccctcaaccccttctccttcacccttagcggcaagtcccgcttttctggggcaggggcaagtacccctcaaccccttctccttcacccttagcagcaagtcccgctttcctagggggcaagaaccccccaatcgcttattttcacgccccaacctcttatctctgtgccccaatcccttatttccacgccccaatctcttatctctgcgccccaatcccttatttccgcgccccaaccctttctctgcttttctggaggggaagaaacccccaccccttctccgtgtctctactcttttctctgggcttgcctccttcactatgggcaagcttccaccttccattcctttcttctcccttagcatgtattcttaagaacttaaaatctcttcaattctcacctgacctaaaatctaagcgtcttattttcttctgcaatgccacttgaccccaatacaaactcaacagtagttccaaatagccagaaaatggcactttcaatttttccaccctacaagatctaaataattcttggcgtaaaatgggcaaatggtgtgaggtgcctgacgtccaggcattcttttacacatcagtcccttcctagtctctgtgcccagtgcaactcgtcccaaatcttccttctttccctcccgcctgtcccctcagtaccaaccccaagcgtcactgagtctttctaatcttccttttctacagacccatctgacctctcccttcctccccaggctgctccttgccaggccgagctaggtcccaattcttcctcagcctctgctcctccaccctataatctttttatcacctcccctcctcacacctgctccggcttacagtttcattccgtgactagccctccccgacctgcccagcaatttattcttaaaaaggtggctggagctaaacgcatagtcaaggttaatgctcctttttctttatcccaaatcagatagtgtttaggctctttttcatcaaatataaaaatctagcccagttcatggctcgtttggcagcaaccctaagacactttacagccctagcccctaaaaggtcaaaaggccatcttattctcaatatacattttattacccaatctgctcccgacattaaataaaactccaaaaactggaatctggccctcaaaccccacaacaggacttaattaacctcaccttcaaggtgtgaaataacagaaaaaagttgcaattccttgcctccactgtgagacaaaccccagccacatctccagcacacaagaacttccaaacgcctgaactgtagcagccagacgtttctccagaacctcctcccccaggaacttgctacacatgccggaaatctggccactgggccaaggaacgcccgcagcccgggattcctcctaagccgcgtcccatctgtgtgggaccccactgaaaatcggactgttcaactcacctggcagccactcccagagctcctggaactctggcccaaggttctctgactgactccttcttggcttactggctgaagactgacgctgcctgatcgcctcagaagccccgcagaccatcatggacgccgagctttagcccgcctgcacccaggtgaaataaacagccttgttgctcacacaaagcctgtttggtggtctcttcacacagacgcgcatgaaagggaagacatacaaaaacaaggcctctgaggtaggtactactgagacagccaggtgggaaggactccttggcaaaactccaaccagcctgtacactgggaggaatgtgcactgggatggagccatagaagtttgtgtcgtttgcagtggggaggagcctggtccctcctcttcctgtgaggaacctggaattcaatctgtgaggtgggaagaagcatgtactagcaggactagtacctgtttcccttttttccctttttgcccaataaatccgatttttcttactcttcaaacttctgcaagcctaaactttcgtggccatgtgacgaggatcctgtctttagctgagctaaggaaaagtcttccaacgctatcattatctttattttacaggtaggaaactaaggcacagagagattagctaacttgccccaggtcacacagctactatctgacatagctgggatttgaatccagaccatcaagctctagaatctactctccaattgagcacacaatatggcctttcagtaattcaggaagatcagtaagcaaatggataggtggtagggctccaaaagtattaatctcctcctcctgcctctacttcctccatcccttttagggtttcagggtcacagggcagtcaccagggctgtgatcctgagggtgagtgctccttacatgtggtgccccagacactttcctcatcttagtcctggccctggcagccactcctgcaactccgactgcacatgtgcaactgagttaatgagcagacgcagcccctgacactgtcacgttagtaggtagaaacacctggaaactccgctatcacaccacaaagctttccacgcgaccactattctactgtctttatcaatataacttactattccagaaaatgcttgcccaggaaggtcaaactcggaaataacctcattgcttattccaggaacttcttgaaagacccatcaattcttcaatagaaagcatcaaaggacaatttacaccctaagactgaacccctgacctcaaaatctttcccttgctatgttcaccaacctcaacagaaatattaggattcttacctgatcctagccaagccccctccctcatctcccattaaagggtccatcttcaaccaaacttaagtctcaataaatatctggacattgtccttccaactctgggaagctgctaagactctgtccttactgcagaagaaaaaacagccttgtaccctggtcttctcaacaggttgttctggagatgttctggggagactgcattaaacacagcttcgcaccattgaataaactcagcaacaagccaatgcataaaagtaatctatgcttcaggtcacagaagcttcaaggggaaaaaaacagaatactctagggccattgttcacaaactcatctgaaaacatcctggaaaaattttcccaaacacatggaaagaaagagaggaaaaaagaagatatctgaataatgtggactagaataaagagctgccaggagctgtttatttaaaaacagtactttcttctctggctgagtccctggtattctctgctgcaatctgtagctgtagaattttgaagaatgcaattaaattcaaatggtttgatgagtaatatcttttctcttcatatttgtctaaaacttttctttattgaatagcgagagtgatgaaagtgttttccataataataacaatgacaagggcctgatgatgaactacaattagctcagtgattcatcagttagcagtgaaattttcaatgcatcctgacatttagagcatttggttgtgattaacagtctttgaaatgtcaccgaattttatttaattggctaagaaaaaattttaaaaggtaatcactgcaaagatcacattcatcgccaaaaatgataattgcagttgtcacatgacaaggtagatgctaactactgtagcaaacttgctctgtgttcttacagaatctaatgaatgcagcagagatcaagagcttgaaggggcttagaagtttatttgaatgctcctttcaaagccatttgtatcaagaactgcaagcctttaagtcatctgagcaaataccaaaactgaaatgcagtcatgacactggctcaggactgagatctaaacagtcatcttcgtggcaacaggtattattggtaaaagagagtctggaaattagggcctagcctttcttgagaggccagtatagctgagtagtaaaaagtcaagttttggagtcaggtgtaactaacccacaatccaagttatgaactgtggagtgaatgactcacctgcctgggcttctgcttgctcacctgcaaaatgacaacagcctgccctacagagctgcctgcagaccaacagcagcaaggccttgggagtctctgctggtctcccagctcctgcttgacacctcaagatgatgttgctccatttagtgcctgtttgttctcagactatcccatgccttcttcctgcaaaccacagctctcaagctccccaacagtttgacaaggatcatacaaaggggaaaggaagcaaggaaagaatcaaggtctttctaagcaatttctctacgctctcaggggataggcattttctggccgtgactgtgtctcctccatagttccaacttccacaggacaggtccttccctccatagtcacagttcttcttgggtagcctcctccacacttctgaatggcccatctgaatggccacagtgactcggcgctgatgtcacccctcctgcctgttgtaccccctgccctagagaggagatgcctcctgctgatgctaatctgtggattgcttcattctctggtttctcagcttttccatcccttatgccatcaattgcccgaattaaactcctactatttaaaatacctagagtggtttttatttttctgcttcttaacatcttcactgctatctccctagtccaagtcaccattatcttacccagataacttaatggcctccctgttattgtccttgccctcctagggttgcttctaaatacagcagccagaaaaatgctgttgagttcaag

SEQ ID NO: 723 - DNA, 10753 bp, Homo sapiens
caaaaagcacccccactgagcaccttgcgaccccccgctcctacccgccagagaacaaaccccctttgactgtaattttcctttacctaaccaaatcctataaaacggccccacccttatctcccttcgctgactctcttttcggactcagcccgcctgcacccaggtgaaataaacagcctcgttgctcacacaaagcctgtttggtggtctcttcacacggacgcgcatgaaatttggtgccgtgactcggatcgggggacctcccttgggagatcaatcccctgtcctcctgctctttgctccgtgagaaagatccacctacgacctcaggtcctcagaccaaccagcccaagaaacatctcaccaatttcaaatccggtaagcggcctctttttactctgttctccaacctccctcactatccctcaacctctttctcctttcaatcttggcgccacacttcaatctctcccttctcttaatttcaattcctttcattctctggtagagacaaaagagacatgttttatccgtgaacccaaaactccggcgccggtcacggactgggaaggcagtcttcccttggtgtttaatcattgcagggacgcctctctgatttcacgtttcagaccacgcagggatgcctgccttggtccttcacccttagcggcaagtcccgctttcctggggcaggggcaagtacccctcaaccccttctccttcacccttagcggcaagtcccgcttttctggggcaggggcaagtacccctcaaccccttctccttcacccttagcagcaagtcccgctttcctagggggcaagaaccccccaatcgcttattttcacgccccaacctcttatctctgtgccccaatcccttatttccacgccccaatctcttatctctgcgccccaatcccttatttccgcgccccaaccctttctctgcttttctggaggggaagaaacccccaccccttctccgtgtctctactcttttctctgggcttgcctccttcactatgggcaagcttccaccttccattcctttcttctcccttagcatgtattcttaagaacttaaaatctcttcaattctcacctgacctaaaatctaagcgtcttattttcttctgcaatgccacttgaccccaatacaaactcaacagtagttccaaatagccagaaaatggcactttcaatttttccaccctacaagatctaaataattcttggcgtaaaatgggcaaatggtgtgaggtgcctgacgtccaggcattcttttacacatcagtcccttcctagtctctgtgcccagtgcaactcgtcccaaatcttccttctttccctcccgcctgtcccctcagtaccaaccccaagcgtcactgagtctttctaatcttccttttctacagacccatctgacctctcccttcctccccaggctgctccttgccaggccgagctaggtcccaattcttcctcagcctctgctcctccaccctataatctttttatcacctcccctcctcacacctgctccggcttacagtttcattccgtgactagccctccccgacctgcccagcaatttattcttaaaaaggtggctggagctaaacgcatagtcaaggttaatgctcctttttctttatcccaaatcagatagtgtttaggctctttttcatcaaatataaaaatctagcccagttcatggctcgtttggcagcaaccctaagacactttacagccctagcccctaaaaggtcaaaaggccatcttattctcaatatacattttattacccaatctgctcccgacattaaataaaactccaaaaactggaatctggccctcaaaccccacaacaggacttaattaacctcaccttcaaggtgtgaaataacagaaaaaagttgcaattccttgcctccactgtgagacaaaccccagccacatctccagcacacaagaacttccaaacgcctgaactgtagcagccagacgtttctccagaacctcctcccccaggaacttgctacacatgccggaaatctggccactgggccaaggaacgcccgcagcccgggattcctcctaagccgcgtcccatctgtgtgggaccccactgaaaatcggactgttcaactcacctggcagccactcccagagctcctggaactctggcccaaggttctctgactgactccttcttggcttactggctgaagactgacgctgcctgatcgcctcagaagccccgcagaccatcatggacgccgagctttaggtaactcacagtggagggtaagtccgtccccttcttaatcaatacggaggctacccactccacattaccttcttttcaagggtctgtttcccttgcctccataactgttgtgagtattgacagccaggcttctaaacctcttaaaactccccaactctggtgccaacttagacaatactctttaaagcactcctttttagttatccccacctgcccagttcccttattaggctgagacactttaactaaattgtctgcttccctgactattcctggactacagctatatctcattgccgcccttcttcccaatcaaaagcctcctttgcgtcctcctcttgtatccccccaccttaacccacaagtataagatacgtctactccctccttggtgaccgatcatgcaccccttaccatctcattaaaacctaatcacccttaccctactcaacgccaatatcccatcccgcagcacactttaaaaaggttaaagcctgttatcactcgtctgctacagcatggccttttaaagcctataaactccccttacaattcccccattttacctgtcctaaaaccggacaagccttacaagttagttcaggatctgtgccttatcaaccaaattgttttgcctatccaccccgtggtgccaaacccgtatactctcctatcctcaatacctccctctactacccattagtctgttctagaactcaaacatgctttctttactattcctttgcacccttcatcccagcctctctttgctttcacttagactcaccctgacactgattaggctcagcaaattacctgggctgtactgccacaaggcttcacagacagcccccattacttcagtcaagcccaaatttcatcctcatctgttacctatctcggcataattctcataaaaacacacgtgctttccctgctgatcgtgtccgattaatctcccaaacctcaatcccttacaaaacaacaactcctttccttcctaggcatggttatagtgcagtcagaattcttacacaagagccaggaccacaccctgtagcctttctgtccaaacaacttgaccttactgttttagcctagccctcatgtctgcgtgcagaggctgccgctgctttaatacttttagaggccctaaaaatcacaaactatgctcaactcactctctacatttctcataacttccaaaatctattttcttcctcatacctgacgcatatgctttctgctccctggctccttcagctgtactcactctttgttaagtcccacaattaccattgttcctggcccggacttcaatccggcctcccacattattcttgataccacacctgacccccacgactgtgtctctctgatccacctgatattcaccccattttcccatatttccttctttcctgttcctcaccctgatcacgcttgatttattgatggtagttccaccaggcctaatcgccacataccagcaaaggcaggctatgctatagtactagccactagcctgcctctcagaacctctcatttcctttccatcgtggaaatctatcctcaaggaaataacttctcagtgttccatctgctattctactactcctcagggattattcaggccccctcccttccctacacatcaagctcagggatttgcccccacccaggactggcaaattagctttacttaacatgcccgagtcaggaaactaaaatacctcttagtctaaatagacactttcactgaataagtaaaggcgtttcctacagggtctgagaaggccaccagtcatttcttccgttctgtcagacataattcctcattttagccttcccacctcaatacagtctgataacagatgagtctttattagtcaaatcagccaagcagtttttcaggctcttagtattcagtgaaacctttatatcccttacagtcctccatcttcaagaaaggtagaatggactgaaggtcttttaaaaacacacctcaccaagctcagccaccaaaaaggactggacaatacttttatcactttcccttctcagaattcaggcctgtcctcggaatgctacaaggtacagcccatttaagctcctgtatagatgctcctttttattaggccccagtctcattccagacaccggaccaacttagactgtgcccccaaaaaaacttgtcatccctactattttctgtctagtcatactcctattttccattctcaactactcatacatgccctgctcttgtttacactgccggtttacactgtttctccaagccatcatagctgatatctcctggtgctatccccaaaccgccactcttaactcttgaagtaaataaataatctttgctggcaggactatgctgaatttccttaggcactctctaatcagatgccctaggtcctcccaattcttagaccttttatacctgtttttctccttcttattccatttagtttttcagttcatacaaaaccgtatccaggccatcaccaatcattctatacaacaaatgtttcttctaacaaccccacaatatcaccccttaccataagatctcctttcagcttaatctctccgactctaggttcccacaccgcccctaatcccgcttgaagcagccctgagaaacatcgtccactctctctccataccactccacaaaaattttccccgccccaacacttcaacactatcttgttttatttttcttattaagaaggcaggaatgtcaggcctctgagcccaagccaagccattgcatcccctgtgacctgcatgtatatgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgacccccgctcctacccgccagagaacaaaccccctttgactgtaattttcctttacctacccaaatcctataaaacggccccacccttatctcccttcgctgactctcttttccgactcagcccgcctgcacccaggtgaaataaacagccttgttgctcacacaaagcctgtttggtggtctcttcacacagacgcgcatgaaagggaagacatacaaaaacaaggcctctgaggtaggtactactgagacagccaggtgggaaggactccttggcaaaactccaaccagcctgtacactgggaggaatgtgcactgggatggagccatagaagtttgtgtcgtttgcagtggggaggagcctggtccctcctcttcctgtgaggaacctggaattcaatctgtgaggtgggaagaagcatgtactagcaggactagtacctgtttcccttttttccctttttgcccaataaatccgatttttcttactcttcaaacttctgcaagcctaaactttcgtggccatgtgacgaggatcctgtctttagctgagctaaggaaaagtcttccaacgctatcattatctttattttacaggtaggaaactaaggcacagagagattagctaacttgccccaggtcacacagctactatctgacatagctgggatttgaatccagaccatcaagctctagaatctactctccaattgagcacacaatatggcctttcagtaattcaggaagatcagtaagcaaatggataggtggtagggctccaaaagtattaatctcctcctcctgcctctacttcctccatcccttttagggtttcagggtcacagggcagtcaccagggctgtgatcctgagggtgagtgctccttacatgtggtgccccagacactttcctcatcttagtcctggccctggcagccactcctgcaactccgactgcacatgtgcaactgagttaatgagcagacgcagcccctgacactgtcacgttagtaggtagaaacacctggaaactccgctatcacaccacaaagctttccacgcgaccactattctactgtctttatcaatataacttactattccagaaaatgcttgcccaggaaggtcaaactcggaaataacctcattgcttattccaggaacttcttgaaagacccatcaattcttcaatagaaagcatcaaaggacaatttacaccctaagactgaacccctgacctcaaaatctttcccttgctatgttcaccaacctcaacagaaatattaggattcttacctgatcctagccaagccccctccctcatctcccattaaagggtccatcttcaaccaaacttaagtctcaataaatatctggacattgtccttccaactctgggaagctgctaagactctgtccttactgcagaagaaaaaacagccttgtaccctggtcttctcaacaggttgttctggagatgttctggggagactgcattaaacacagcttcgcaccattgaataaactcagcaacaagccaatgcataaaagtaatctatgcttcaggtcacagaagcttcaaggggaaaaaaacagaatactctagggccattgttcacaaactcatctgaaaacatcctggaaaaattttcccaaacacatggaaagaaagagaggaaaaaagaagatatctgaataatgtggactagaataaagagctgccaggagctgtttatttaaaaacagtactttcttctctggctgagtccctggtattctctgctgcaatctgtagctgtagaattttgaagaatgcaattaaattcaaatggtttgatgagtaatatcttttctcttcatatttgtctaaaacttttctttattgaatagcgagagtgatgaaagtgttttccataataataacaatgacaagggcctgatgatgaactacaattagctcagtgattcatcagttagcagtgaaattttcaatgcatcctgacatttagagcatttggttgtgattaacagtctttgaaatgtcaccgaattttatttaattggctaagaaaaaattttaaaaggtaatcactgcaaagatcacattcatcgccaaaaatgataattgcagttgtcacatgacaaggtagatgctaactactgtagcaaacttgctctgtgttcttacagaatctaatgaatgcagcagagatcaagagcttgaaggggcttagaagtttatttgaatgctcctttcaaagccatttgtatcaagaactgcaagcctttaagtcatctgagcaaataccaaaactgaaatgcaggtaactgtaaaacagaataaactccattcaattatagtaacctctgaaccattctaagctccagccacgatcacaattttaagcacgtgtgtgtgtgcgtgtatatgtgtgtgttcaagaaataactttttatttcatattgacttgtaaaggcaggcataatacacaggaagataataatatcacttaaaggtcatattgatgaagtagaaaatattaatagacaaagcttcattttcatgggagattaaccacctctgtgtttgtcaaagagtttagctatttaaaagctcactggcaatagatgatatgaaatgtttctccctatgagataaatgtgcactcaaacaaatatagtgttaatcgccaaccaatctcaagctgggacattttgtaacatttatctttgtgtgtgtgtgtgtgtgtgtgtgtgtgtgtgtttgatggagtctcgctctgtcacccaggctgaagtgcagtggtgcaatctcagctcactgcatcctctccctcctgggttcaagcgattctcctgcctcagcctcccgaatagctgggattacaggcgcctaccaccatgcctgactaatttttctgtatttttagtagagacgggatttcaccatgttggtcaggctggtctcgaaccccggacctctggtgatccgcccacctcgccctcccaaagtgctgggattacaggtgtgagccaccgtgcctggcctatcattgtgtttttttaaaaaacatttattcggctttttgctttccaagatctatattcagctcatgtggttatctgactgaccagactccagaggtatttttacaggggtatggagggttttcctgttcaaaaatgcttccctcacaaagattcaggataaaaaagtccaccatgtgttggtgatttctctgggtcttagtaggccctgtgaaagtgtgaatacaccttcttggagcatacaatattatgccccaaaatgtggttggtgagctgtaacttctacaagatgctaatacggagatgatggtatgatataaagtgttcctgggttagtaagtgtggttaaacacatttttaaaggtttgttcactgcaggacttctcaaggcctttgatatgcgcaagtaccttgtgagtctgcaagaggaggatggcatctcctcaccttgaccacaacccccatgtgggagtaccttggcaggccggcattaaactgcgcatgctatgggaaatagtgtcttaggagggtctgagaacaaaggtgacagatggaagggatggacagagaaagggtaccagggaaaggaacagaaaatagaggaaggggagcagacactcctaatgacttgggcaaagagaaccaaagcatttgtagtgggagctgtgtctagagacctgggttctcagtggtcacagaggtggcacttctcacccagcccagcactgctgaaagggagccaggtcctgcctcatcaggctgaatctcaaccccacgagaaagggaccaccaggaccacctcacgggtgtgtgacatgcacagctgcacaagattacactaagaaagctccgcacttggttcaaggctttgctaccattaccttaaaattctcaataactgtgaacaagaaaccctgtaaactctggctgagtcaggcttctcagccccaatctgccttactccaggggccacagacttaaccatacaacaatctcctaaccctttctccttcgccacttaggccagagaacagggaaagagaaattcactgcagggaagacttccaaacaagggactccacagctcagagaagtctccccctgctctggccactaggtttttgagataaaacgagagggaattttcaaactgtaacaggtcttttcaatatcaccacctggaaagagcctgctgagatgcagagacccaagccctaagaaggcacctgcccagcagcctagtcctctgtcctcgccggctgtgtcactaaaactattactttgctgtcaacagagatgtactgtccaaaacacggactcttacataaatgtttacatcctgtagccaacagccccttggagctcattaggtgaccggggctttggatttgtactgaggaagttgacttggcaccttctctccttatttttctcttctcctctgcagtcatgacactggctcaggactgagatctaaacagtcatcttcgtggcaacaggtattattggtaaaagagagtctggaaattagggcctagcctttcttgagaggccagtatagctgagtagtaaaaagtcaagttttggagtcaggtgtaactaacccacaatccaagttatgaactgtggagtgaatgactcacctgcctgggcttctgcttgctcacctgcaaaatgacaacagcctgccctacagagctgcctgcagaccaacagcagcaaggccttgggagtctctgctggtctcccagctcctgcttgacacctcaagatgatgttgctccatttagtgcctgtttgttctcagactatcccatgccttcttcctgcaaaccacagctctcaagctccccaacagtttgacaaggatcatacaaaggggaaaggaagcaaggaaagaatcaaggtctttctaagcaatttctctacgctctcaggggataggcattttctggccgtgactgtgtctcctccatagttccaacttccacaggacaggtccttccctccatagtcacagttcttcttgggtagcctcctccacacttctgaatggcccatctgaatggccacagtgactcggcgctgatgtcacccctcctgcctgttgtaccccctgccctagagaggagatgcctcctgctgatgctaatctgtggattgcttcattctctggtttctcagcttttccatcccttatgccatcaattgcccgaattaaactcctactatttaaaatacctagagtggtttttatttttctgcttcttaacatcttcactgctatctccctagtccaagtcaccattatcttacccagataacttaatggcctccctgttattgtccttgccctcctagggttgcttctaaatacagcagccagaaaaatgctgttgagttcaag

SEQ ID NO: 724 - DNA, 6373 bp, Homo sapiens
cacgtacacgcccagatggcctgaagtaactgaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgaccccccgctcctacccgccagagaacaaaccccctttgactgtaattttcctttacctaaccaaatcctataaaacggccccacccttatctcccttcgctgactctcttttcggactcagcccgcctgcacccaggtgaaataaacagcctcgttgctcacacaaagcctgtttggtggtctcttcacacggacgcgcatgaaatttggtgccgtgactcggatcgggggacctcccttgggagatcaatcccctgtcctcctgctctttgctccgtgagaaagatccacctacgacctcaggtcctcagaccaaccagcccaagaaacatctcaccaatttcaaatccggtaagcggcctctttttactctgttctccaacctccctcactatccctcaacctctttctcctttcaatcttggcgccacacttcaatctctcccttctcttaatttcaattcctttcattctctggtagagacaaaagagacatgttttatccgtgaacccaaaactccggcgccggtcacggactgggaaggcagtcttcccttggtgtttaatcattgcagggacgcctctctgatttcacgtttcagaccacgcagggatgcctgccttggtccttcacccttagcggcaagtcccgctttcctggggcaggggcaagtacccctcaaccccttctccttcacccttagcggcaagtcccgcttttctggggcaggggcaagtacccctcaaccccttctccttcacccttagcagcaagtcccgctttcctagggggcaagaaccccccaatcgcttattttcacgccccaacctcttatctctgtgccccaatcccttatttccacgccccaatctcttatctctgcgccccaatcccttatttccgcgccccaaccctttctctgcttttctggaggggaagaaacccccaccccttctccgtgtctctactcttttctctgggcttgcctccttcactatgggcaagcttccaccttccattcctttcttctcccttagcatgtattcttaagaacttaaaatctcttcaattctcacctgacctaaaatctaagcgtcttattttcttctgcaatgccacttgaccccaatacaaactcaacagtagttccaaatagccagaaaatggcactttcaatttttccaccctacaagatctaaataattcttggcgtaaaatgggcaaatggtgtgaggtgcctgacgtccaggcattcttttacacatcagtcccttcctagtctctgtgcccagtgcaactcgtcccaaatcttccttctttccctcccgcctgtcccctcagtaccaaccccaagcgtcactgagtctttctaatcttccttttctacagacccatctgacctctcccttcctccccaggctgctccttgccaggccgagctaggtcccaattcttcctcagcctctgctcctccaccctataatctttttatcacctcccctcctcacacctgctccggcttacagtttcattccgtgactagccctccccgacctgcccagcaatttattcttaaaaaggtggctggagctaaacgcatagtcaaggttaatgctcctttttctttatcccaaatcagatagtgtttaggctctttttcatcaaatataaaaatctagcccagttcatggctcgtttggcagcaaccctaagacactttacagccctagcccctaaaaggtcaaaaggccatcttattctcaatatacattttattacccaatctgctcccgacattaaataaaactccaaaaactggaatctggccctcaaaccccacaacaggacttaattaacctcaccttcaaggtgtgaaataacagaaaaaagttgcaattccttgcctccactgtgagacaaaccccagccacatctccagcacacaagaacttccaaacgcctgaactgtagcagccagacgtttctccagaacctcctcccccaggaacttgctacacatgccggaaatctggccactgggccaaggaacgcccgcagcccgggattcctcctaagccgcgtcccatctgtgtgggaccccactgaaaatcggactgttcaactcacctggcagccactcccagagctcctggaactctggcccaaggttctctgactgactccttcttggcttactggctgaagactgacgctgcctgatcgcctcagaagccccgcagaccatcatggacgccgagctttaggtaactcacagtggagcccgcctgcacccaggtgaaataaacagccttgttgctcacacaaagcctgtttggtggtctcttcacacagacgcgcatgaaagggaagacatacaaaaacaaggcctctgaggtaggtactactgagacagccaggtgggaaggactccttggcaaaactccaaccagcctgtacactgggaggaatgtgcactgggatggagccatagaagtttgtgtcgtttgcagtggggaggagcctggtccctcctcttcctgtgaggaacctggaattcaatctgtgaggtgggaagaagcatgtactagcaggactagtacctgtttcccttttttccctttttgcccaataaatccgatttttcttactcttcaaacttctgcaagcctaaactttcgtggccatgtgacgaggatcctgtctttagctgagctaaggaaaagtcttccaacgctatcattatctttattttacaggtaggaaactaaggcacagagagattagctaacttgccccaggtcacacagctactatctgacatagctgggatttgaatccagaccatcaagctctagaatctactctccaattgagcacacaatatggcctttcagtaattcaggaagatcagtaagcaaatggataggtggtagggctccaaaagtattaatctcctcctcctgcctctacttcctccatcccttttagggtttcagggtcacagggcagtcaccagggctgtgatcctgagggtgagtgctccttacatgtggtgccccagacactttcctcatcttagtcctggccctggcagccactcctgcaactccgactgcacatgtgcaactgagttaatgagcagacgcagcccctgacactgtcacgttagtaggtagaaacacctggaaactccgctatcacaccacaaagctttccacgcgaccactattctactgtctttatcaatataacttactattccagaaaatgcttgcccaggaaggtcaaactcggaaataacctcattgcttattccaggaacttcttgaaagacccatcaattcttcaatagaaagcatcaaaggacaatttacaccctaagactgaacccctgacctcaaaatctttcccttgctatgttcaccaacctcaacagaaatattaggattcttacctgatcctagccaagccccctccctcatctcccattaaagggtccatcttcaaccaaacttaagtctcaataaatatctggacattgtccttccaactctgggaagctgctaagactctgtccttactgcagaagaaaaaacagccttgtaccctggtcttctcaacaggttgttctggagatgttctggggagactgcattaaacacagcttcgcaccattgaataaactcagcaacaagccaatgcataaaagtaatctatgcttcaggtcacagaagcttcaaggggaaaaaaacagaatactctagggccattgttcacaaactcatctgaaaacatcctggaaaaattttcccaaacacatggaaagaaagagaggaaaaaagaagatatctgaataatgtggactagaataaagagctgccaggagctgtttatttaaaaacagtactttcttctctggctgagtccctggtattctctgctgcaatctgtagctgtagaattttgaagaatgcaattaaattcaaatggtttgatgagtaatatcttttctcttcatatttgtctaaaacttttctttattgaatagcgagagtgatgaaagtgttttccataataataacaatgacaagggcctgatgatgaactacaattagctcagtgattcatcagttagcagtgaaattttcaatgcatcctgacatttagagcatttggttgtgattaacagtctttgaaatgtcaccgaattttatttaattggctaagaaaaaattttaaaaggtaatcactgcaaagatcacattcatcgccaaaaatgataattgcagttgtcacatgacaaggtagatgctaactactgtagcaaacttgctctgtgttcttacagaatctaatgaatgcagcagagatcaagagcttgaaggggcttagaagtttatttgaatgctcctttcaaagccatttgtatcaagaactgcaagcctttaagtcatctgagcaaataccaaaactgaaatgcagcccagcactgctgaaagggagccaggtcctgcctcatcaggctgaatctcaaccccacgagaaagggaccaccaggaccacctcacgggtgtgtgacatgcacagctgcacaagattacactaagaaagctccgcacttggttcaaggctttgctaccattaccttaaaattctcaataactgtgaacaagaaaccctgtaaactctggctgagtcaggcttctcagccccaatctgccttactccaggggccacagacttaaccatacaacaatctcctaaccctttctccttcgccacttaggccagagaacagggaaagagaaattcactgcagggaagacttccaaacaagggactccacagctcagagaagtctccccctgctctggccactaggtttttgagataaaacgagagggaattttcaaactgtaacaggtcttttcaatatcaccacctggaaagagcctgctgagatgcagagacccaagccctaagaaggcacctgcccagcagcctagtcctctgtcctcgccggctgtgtcactaaaactattactttgctgtcaacagagatgtactgtccaaaacacggactcttacataaatgtttacatcctgtagccaacagccccttggagctcattaggtgaccggggctttggatttgtactgaggaagttgacttggcaccttctctccttatttttctcttctcctctgcagtcatgacactggctcaggactgagatctaaacagtcatcttcgtggcaacaggtattattggtaaaagagagtctggaaattagggcctagcctttcttgagaggccagtatagctgagtagtaaaaagtcaagttttggagtcaggtgtaactaacccacaatccaagttatgaactgtggagtgaatgactcacctgcctgggcttctgcttgctcacctgcaaaatgacaacagcctgccctacagagctgcctgcagaccaacagcagcaaggccttgggagtctctgctggtctcccagctcctgcttgacacctcaagatgatgttgctccatttagtgcctgtttgttctcagactatcccatgccttcttcctgcaaaccacagctctcaagctccccaacagtttgacaaggatcatacaaaggggaaaggaagcaaggaaagaatcaaggtctttctaagcaatttctctacgctctcaggggataggcattttctggccgtgactgtgtctcctccatagttccaacttccacaggacaggtccttccctccatagtcacagttcttcttgggtagcctcctccacacttctgaatggcccatctgaatggccacagtgactcggcgctgatgtcacccctcctgcctgttgtaccccctgccctagagaggagatgcctcctgctgatgctaatctgtggattgcttcattctctggtttctcagcttttccatcccttatgccatcaattgcccgaattaaactcctactatttaaaatacctagagtggtttttatttttctgcttcttaacatcttcactgctatctccctagtccaagtcaccattatcttacccagataacttaatggcctccctgttattgtccttgccctcctagggttgcttctaaatacagcagccagaaaaatgctgttgagttcaag

SEQ ID NO: 725 - DNA, 3535 bp, Homo sapiens
tgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgagggcaccctccctgcatggcccgatgacctgcactcctgtttcatctccccgtgtggcacctggggcagcttggagcctaccaaggtctcaacaaggaaccagtaaataccaaaaaaaggacatcacgtcccctacagctaactgcaaatggtgaccatcccagcccttgtttgataacacaagcaaagcaatggcttcttcaaggacaccgagaggaacctcacctctttctaaaacctccaacacagggccaggcgcggtggctcatgcgtgtaatcccagcactttgggaggccgaggcaggtggatcacgaggtcaggagatcgagaccatcctggctaacacggtgaaaccccgtctctactaaaaataaaaaaaattagccgggcgtggtggtgtgcgcctgtagtcccagctgctcggggaggctgaggtaggagaatagcgtgaacccagaaggtggaggtagcagtgagccgagatcactccactgcactccagcctgggcaacagagcaagactccatctcaaaaaacaaacaaacctccaacaccacctggaagggcctggaggcactcactgatgagcctggaatttctcacaggggacagagaggtggccaaggctcctgcacatttccccatctgtctgacacccctttccagaaccagaaagcgtgctgagctcggcctctgtcacgcagggttccaggtatttctggggctcagcagggagaaggccaggacgtgctccctgactctcggcagggcgggagaagaatgaatcctctgaggtccccagcttggggaaaagggggtgggagagtggcgggcagagacctcctccgtatccccctctcctgaagccctgccgctgtggcagccctacagggactacagggctccagccctacagggactctgcggtggggcgggtgtgcaggctcacaggctctggaaatgccccaggatgccttggcagtgtctcccacagacccaggagcgccactagaaacaggacccttcctcagtcatcctgcatgggggctcctgttgctttgggggctgctttccagcagctgcgtcagacaacgacccacctcatccccccagccaggacctgaacaggcactgacgtcagatacgtagaccttgttgctgaacttgtcaaaaacttcaatggtgatttcatacaggcggccggtctccagcacccacctatcaccagggtgaatggtgaaccctaaaacaggcagggggagcctgagcactcaggcctcaggggcagcagggtggaggaggatgggaccaccaccctcagcacaggggccctcagcatccacatgggaagccccactccacccacctgtaggccccacaccacccacctgcaggccccacaccacttacctggaggccccacaccacccacctaggggccccacaattatggcgctggcctcctccacagagagggacctgttgctgaggaacagatgcctgatgccgccttcagccctgagtcctgagctgacctcccgaggaccaaacctggactcatcccattctatctgaacaaggctccttcaaacttgttcctgttcctcagtgggtctacactcagaatcctagcagctctgtccttaacacacagcaggtctatgctctgaagtgataatagatctatagtgttcacagtagaactagtctgaaccttcagggggtctgtgctctgaggagggatggacatagactccaagaaagtgatgattctggaaaaggaacgcgttgttaaagtttgttgatcaaacccagacacaaggtctgtcagaatctaccacagcattccctatcagcccctcccactggggccaacactgaagaaataaggggtgtcccgttagtcagggctggggctacctagagacatgtccctgcagcttcctacatcagatctgcccatgtccttgtgaaaaatgcagatgcttggcccctggcccaggctgtgtctgcaagaagcctgggaaactccattttatccacctgcatacgtgatggaaacactgacatgcaagaccagccgctgagtccacacaggaacaatgaggcctgagagatgaggcaacaggcccaagaacacagcccagccgaggccggaccagcagcgccctcgcctccctgaggctgcctgctcctgtcccacctccctggcctaccacccagctctggggaacgattctccatgactggtcccttagccctggggaccggacggcaccacgtctcactctccccagatcccagcttggggagatgtcggggacgtggtgtagcatggagtgtgggctgctgggcaggctgacttcagggatccttcccacgcagcctcccacttcagcctgcatttacaaacgagcccactgttcccctgcacaagagcaatctgccgccatgcttccatctccccagcatctgccggtgccgggccacgccgtaatttatttcctcgcctggttactctaggtgtcacatgtcaaattgaccacaaatccaggacaatccagctccaacctgccttggtgtctgggatttctgttatcattcggctcaggtgcagagctgcctggaagcttggggggcctgacatggcaggggacggggctgtcagaaggggacagggaaccagcatcccctcaacatccaacatgcgccaggcccagagaggggccctgagcggatcaatctgccgagctgggcatgggatcccctccagctctgtttcccagggcaggaggctgaggctcaggtgggtaacgttccctggctaaggccacaggcaggaagtgacaaggccaggactggaatccaggtctctgactctccggctcgtggtcatagttttacaaaacaccagaaactgcagagctggtccagaaagctctgcctccaggagggcgactcagctctcaaaggcatcaggacgtgaggacgtctgcctggagtcaccgtgagctgagttctggagaaggttgtgatggaggaaccaccacgtccccatcatcccctacggcccagagctggactttaatggcgtaattgtgggcggatcacgaggttaggagatcgagaccatcctggccaacatggtgaaaccccatctctactaaaaatacaaaaattagctgaacgtggtgggtgcctgtaatctcagtactcaggagactgaggcaggagaattgcttgaacccgggaggcagaggttgcagtgagccgagattgcgc

SEQ ID NO: 726 - DNA, 3535 bp, Homo sapiens; identical to SEQ ID NO: 725

SEQ ID NO: 727 - DNA, 3076 bp, Homo sapiens
tttgctttgttgaagatcagttggctctaagtatttggctttctttctgagttctttattctgttccattggtctatgtgtctatttttataccagtcccatgctgttttggtgactatggccttatagtttagcttgaagtcatgtaatgtgatgcctccacatttttttctttttgcttagtcttgcaaaaagcaagactctgtggcctcttttttggttccatatgaattttaggatcttttttctacctctgtgaagaatgatgatggtattactcatggagggtgtccagattcttggcgtcttgaacaaagaattggacaaaatgcaaaaacaaagcaaggaaagcaaaagcagagatttattgaaaatgaaagtacattccacagggtgggagtgggcctaagcagaggggctcaagagacctggttacagaattttctggggtttcaatactctctagagttttcccactggttactttgtgcatgctctgtgtaaatgaagagaatgaagtgaagttacaaagtcatttactcagaatgcaccctatgtaaatggagaggatgttacttggtgtgtatgatctatgtaaatggagacgatgaatgtgaagttacaaagtgtaaatggtgtaagtggagaggatggagtgaagttacaaaaccattcacattcctgtcattgctgaagtgcttccatttgatttaattctaggaagtcagcctggatcggccttatgttccctgcctccaggcactattctccagcctcagtggtattttgatgggaattgcattgaatttgtaggttgcttttggcaatatggtcatttacacaatattgattctacccatctatgagtatgggatgcgtttccatttgttttgtgtcatccatgatttctttcagcagtgttttgtagttttccttgtagaggtctttcacctccttggttagatatattcctacgtattttattgtttttgcagcttttgtgaaaggggttgagttcttgatttgattctcagtttgatcactgttggtgtatagcagaactactgacttgtgcacattaattttgtatcctgaaacttcgctgaatttacttaccagttctaggagctttttggatgagtctttatggttttctagatatacaattatatcatcagcaaacagtgacagtttgacttcatctttattgatttggatgccctttatttctttctcttgtctgattgctctagccaggacttccagtactatgttgaatagaagtgatgaaagtgggcatccttgtcttgttccagttctcaggggaaatgctttcgactttgccccattcggtataatgttggctgtggtttgtcatagatggcttttattaccttaagcccttctatgccaattttgtatgtatgtcccttctatgccaatagaagtatgtcccttctatgccaattttgctgagggttttaatcataaaggatgctagattttgtcaaatgctttttctgcatctattgagatgattatgtgattaaaaaaattctgtttctgtggtgattcatatttattgacttatatatgttgaaccatccctgcatccctgggataaaaccaaatagattacagtggattatctttttgctatgctgttagattcagtccgctagtattttgttgagaattttagcatctatgttcatcaaggatattgatctgtagtttttgttgttgttgttgttgttgttatgtccttttgtggtcttggtatcagggtgatactggcttcatagaatgatttagggcagattccctttttctctatcgaaaaggattggtactaattcttctttgaatatctgacagaattcagctgtgaatccatctgatcctggactttttttgttggcaattttaaaattaccatttcaatctcactgcttgttatttgtcagacctctgagcccaagctaagccatcatatcccctgtgacctgcatgtgtacatccagatggcctgaagtaactgaagaatgacaaaagaagtgaaaatggcctgttcctgccttaactgatgacattaccatgtgaaattccttctcctggctcatcctggctcaaaagctcgcctgctgagcaccttgtgacccaccccccactcctgcccgccagagaacaacccccctttgactgtaattttcctttacctacccaaatcttataaaacggccccaacccatctcccttcgctgactttcttttcggactcagcccgcctgcacccaggtgaaataaacagccttgttgctcacacaaagcctgtttggtggtctcctcacatagatgagtgtgaaatttggtgctgtgactcagatcaggggacctcccttgggagatcaatcccctgtccttctgctctttgctccatgagaaagatccacctacgacctcaggtcctcagactgaccagcccaaggaacatcacaccaattttaaataaggaccccactggaaactggaccatccaactctcccggcagccacttccagagcccctggaactctggcccaaggctctctgactgactccttcccagatcttcttggcttagcacctgaagactgatgctgctcaatcaccttggaagcctacaggaccatcacagacactttcggtaactcttacagtggagggtaagtccatccccttcttaatcaatatggagcctacccactccacattaccttcttttcaaaggcctgtttcctttgcctccataactattgtgggtattgacggccaggcttctaaacctcttaaaactccccaactctggtgccaacttagacaatactcttttaagcactcctttttagttatccccacctgcccagttcccttattaggctgagacactttaacaaacttatctgcttccctgactattcctgggctacagccacacctcattgccgccttttcctccagttcaaagcctccctcacatcctccccttgtatctccccaccttaacccacaagtataagacatctctactccctc

SEQ ID NO: 728 - DNA, 5036 bp, Homo sapiens
gtcaggcctctgagcccaagccaagccatcgcatctcctgtgacttgcaggtatacgcccagatggcctgaagtaactgaagaatcacaaaagaagtgaaaataccctgccccaccttaactgatgacattccaccacaaaagaagtgtaaatagccggtccttgccttaagtgatgacattaccttgtgaaagtccttttcctggctcatcctggctcaaaaagcacccccactgagcaccttgcgacccccactcctgctcgccagagaacaaaccccttctgactgtaattttcctttacctaccgaaatcctatgaaacggccctacccttatctcccttcactgactctcttttcagactcagcctgcctgcacccaggtgaaataaacagccatgttgctcacacaaagcctgtttggtggtctcttcacatggacgtgcatgaaatttggtgccgtgactcagactgggggacctcccttcggagatcaatcccctgtcctcctgctctttgctccgtgagaaagatccacctacgacctcaggtcctcagaccgaccagcccaagaaacatctcaccaatttcaaatccagtaagcggcctcttttcattctcttctccggcttccctcactatccctcaacctctttctcctttcaatcttggtgccacacttcaatctctcccgtctcttaatttcaattcctttcattttctggtagagacaaaggagacaagttttatccgtggacccaaaactccagcaccggttatggaatgggaaggcagccttcccttggtgtttaatcattgcagggacacctctctgattattcactcacgtttcaaaggtgtcagaccacgcagggacgcctgccttggtccttcacctttagcagcaagtcccgcttttctggggaaggggcaagtaccccaaccccttctctccttgtctctaccccttctctgcttttctggaggaggggaagtacccctcaaccccttctccttcacccttagcggcaagtcctgcttttctgggggaggggcaagtacccctcaaccccttctccttcacccttagcagcaagttccgcttttctagggggcaagaacccccaatcccttatttctgcaccccaacctcttatctctgtgccccaattccttatttccatgccccaaccctttctctgattttctggagggcaagaaacccctaccccttctctgtgtctctactcttttctctgggcttgcctccttcactatgggcaagcttccaccttccattcctccttcttctcccttagcctatattcttaagaacttaaaacctcttcaactctcacctgacctaaaatctaagcatcttattttcttctgtaatgccgcttgaccccaatacaaactcgacagtagttctgaatagccggaaaatggcactttcaatttttccttcctacaagatctaaataattcttgtcgtaaaaggggcaaatggtctgaggtgcctgacgtccaggcattcttttacacatcagtcccttcctagtctctgtgcccagtgcaactcgtcccaaatcttccttctttccctcctgcctgtcccctcagtcccaaccccaagcattgctgagtctttctaatcttcctttcctacagacccatctgacctctcccctcctcgccaggccaagctaggtcccaattcttcctcagcctccgctcctccaccctataatctttttatcacctcccctcctcacacctggtccagcttacagtttcattctgtgactagccctcccccacctgcccagcaatttactcttaaaaaggtggctggagccacaggcatagtcaaggttaatgctcctttttctttatcccaaatcagaagcatttaggctcttttttatcaaatataaaaacccagcccagttcatggctccttcggcagcaaccctgagatgctttacagccctagaccctaaaaggtcaaaaggccatcttattctcaatatacattttattaccaaatctgctcccgacattaaataaaactccaaaaattagaatctggccctcaaaccccacaacaggacttaattaacctcatcttcaaggtgtacaataataaaaaaaaagttgcaattccttgcctccactgtgagacaaaccccagccacatctccagcacacaagaacttccaaacgcctgaaccgcagcggccaggcgttcctccagaacctcctcccccaggagcttgctgcaagtgccagaaatctgaccaccaggccaaggaatgccttcagcccaggattcctcctaagccgtgtcccatctgtgtaggactccactggaaatcggactgttcaactcacctggcagccactcccagagcccctggaactctggcccaaggctctctgactgactccttcttggcttagcggctgaagactgatgctgcctgatcgcctcggaagccccgtagaccatcacggatgccgagctttaggtaactctcacagcggaagatttgaaattcatgagctttgcaacatcttcacatcaggacaaataacccccctgctgttgaaatcacttgcataatttataacgttcaaaattggaattgcatcattgcctcctttgcaattaccctgtagtcaagcctttcaccttactgaaaggtctttaatttttcttgatttttaagcatttctcaatttctaatgggctcatttgaatggcttgggatgctacaaaaatctattcttatctatataatagtttagaagtataactatatccagattatgttcaaagtcaaactgttgcaaatgttacttatgtactgatttgtgtttaaaaatcagataataacattccaaaaaaaatgttatcaatacctaataggaaattcctctttaacctaagtttgttgttctctttgctatgctttcatagtgccttgtatatatttctagcctgacaataattgtattattaaaattatctatttgtgaatgtctttataattggaccatagctcctcaaaggatcacatacatcttaattaactgcttatccctaatgggtagcatattatctggaatgtactatttactcaatgaatgtttgttgattcatttagcaaactttcttataataaaacaaatagatatttttcatcttgtaaaaaaatagcagtgtagatgttatttcagaatctaattagatctaccttagcaattttcacttaaatataacacccctgaaagacaaacatgtgacatcttaaagctaatattgagtagcagctcattcaagatttcctttactctgactaaattgttacttcttttatcaagacactattccatcctttggagcattgtagaataagcgtaaattattctccacatgagagtccttcaaatatttgaagacagccataattcctcctttatctcagctttacacaaaatgtcctcagtgtttttcctattataaaatgatttccagactcctcatatttttatctgcattcctccttcagtaattcattttaatgtaatatttaggtatttgattaaagtaataaatagagaaaaaattagaaatcggaagaaagcatctagaaattttcagtggtttctccaatttttccatttaaaaatatgtatgaattaaaatgtaaagtcctctctgctgccttccagtctcacaaggtaacctcagtcagtagtttgagtttaattcttctatgatgtcatctttgcttattcaaacatgctcaaacacacacacacacacacactcaagcacacagatgtctcttttggagttttgttctatttttttaaaaatggaatcttgttatagtattgctattccatttttccccatgaaaaatcatcggttgctgttattgtcctttggttacactttatcagtggatcttttaaaatgttacctccaggactaaatataaattcagatacaattaacttttattaagaatttactagatgccagacactgcatttgcacttaagatgttatatcatttgaattctcaaaagaatatataaggtaattagtattcctatttcacatgtaacaaaatatgtttagagaaagcagttaaattgctcaagatcactcatacatagccatttaccaaagctatgtatctatttattcatttattcctcaatttgattcagaaagcatttcagaccattttccaggcttaaatgcttaagtgcaactgcatagcttaaatgtgaaaaaaaataggtaaaaagcaggaaagaatatttatgactgagaatgtaaaatgaagttagtaatgagactagcaaaaaaataaataataataattgtgcacttgctatagatgaccacagagtatggatattcttagcaatgcgacaatggtcagttattaattcgtaaagccaagaagagaaaaaatgtaaattatttttaaaaataagaatgcagctagacctggtactaagaataaagaatttctgttaaatatccttagagaaaggactagaggaatatgtagaaaatgtatttttataaaatatgtaattataaatttcagttggcttttatttacaatgtttcttgctatagccaatgccctcacaccaaagtctagaccagtaaaggcaattttctaggaaatcaagaattttatgttctcgatacccggagctttgtttgtttgtttaacttataaatggtagaaatggtagagtttagaacatctggagtaataaatgattataagtcttttcagtaatccttcatagatatataaaatatatgaatatatattatatatgaataatcatatataaatatatatatgctgtgtatatataatatataatgtaatgtatattcgtatatatgtacctttaaagataaaaatatcaaaaagtatatgagaaaggaatagagtaagtcaagatgctttagattggtggatcacagaagggag

SEQ ID NO: 729 - DNA, 1639 bp, Homo sapiens
cttttgagccaggatgagccaggagaaggaatttcacaaggtaatggcttcagttaaagcagaaaccggccattttcacttcttttgtgattcttcacttgcttcgggccatctcgacatatacatgcaggtcacaggggatatgatagcttagcttgggctcagaggcctgacactgttgatagtttattttgctctgcagacgttctttaacttcattaggcaatacttgtcaatttttgtttttgctgcaattgcttttggctactaagccaaaaattatttgccaaggctgatatcgggagggtatgtcctaggtttccttataggacatttacagttcgaagtcttacatttacatctttaatccatcatcagttaatttttgtatatggtgaaatgtaagggtccagttttattcttctacatatgactagccaattatcccagcatgatttactaaatggggagtcctttcctcattgcttttgttggccttgtcgaagatcagaggattatggagtcttgctctgtcgcccagccaggctgaagtgcagtggtgcaatcttggctcacttcaaactccgcctcccaggttcaagtgattctcctgcctcagtctcctgagtggctgggaccacaggtgcacaccaccacgcccggctaatttttttgtgtttttagtagagacagggtttcatggtgttagccagtatggtctcgagctcttgacctcatgattcgtctgccttggcctcccaaagtgctgggattacaggcatgagccaccatgtctggccaaacatttcaatacatttggaccttttgagattactgttgttccaaactctcaccaaaaggctcaaagagggaggcctaaaacaaatggatagtaagtagtggaatcagaatttgagaccatgactagttgattacagagcctatgaattcttattaccttggcaacttgccctttctactcccatggcctggcactatagctgactctggaagttctcaactcacctttaacagacaaatacataaacgaacactatgcttcatggtattgtgttttatacaaaaacaatgaaggtagatttctgtcctccagagttttatagtttacaacacaaataaccataacacaaaacactccacatagtgtgagagaagtaagaataaagttgatgtcacgtaaggtaaaatgtaacatatgttgtaaggaatgaagaagcatctacaaagatgtcatggaagtactggaataatcatttgcaaattaggtatggaatgcatttgaacaggcatattcctacagggcatcgccaacatgggaaataagtagtaatatgtcttgaaatcttactgagaaatttgactattttgtgaacatggtcctatatacaccacttagttttggtgatgtgatgggaatttagtgaaaccttcgtatgggttattttgtatgaactggccatgaaggtggctcttttcttacattttaacatggaagagagaagaagcatatggcagcccagaaatgctggacatcagggactttttgcttctgtgaatactgtgagtgtatctggaataaattacagtgactctaataaaatgaaatgttgaatcactt

SEQ ID NO: 730 - DNA, 870 bp, Homo sapiens
cttttgagccaggatgagccaggagaaggaatttcacaaggtaatggcttcagttaaagcagaaaccggccattttcacttcttttgtgattcttcacttgcttcgggccatctcgacatatacatgcaggtcacaggggatatgatagcttagcttgggctcagaggcctgacactgttgatagtttattttgctctgcagacgttctttaacttcattaggcaatacttgtcaatttttgtttttgctgcaattgcttttggctactaagccaaaaattatttgccaaggctgatatcgggagggtatgtcctaggtttccttataggacatttacagttcgaagtcttacatttacatctttaatccatcatcagttaatttttgtatatggtgaaatgtaagggtccagttttattcttctacatatgactagccaattatcccagcatgatttactaaatggggagtcctttcctcattgcttttgttggccttgtcgaagatcagaggattgtatggaatgcatttgaacaggcatattcctacagggcatcgccaacatgggaaataagtagtaatatgtcttgaaatcttactgagaaatttgactattttgtgaacatggtcctatatacaccacttagttttggtgatgtgatgggaatttagtgaaaccttcgtatgggttattttgtatgaactggccatgaaggtggctcttttcttacattttaacatggaagagagaagaagcatatggcagcccagaaatgctggacatcagggactttttgcttctgtgaatactgtgagtgtatctggaataaattacagtgactctaataaaatgaaatgttgaatcactt

SEQ ID NO: 731 - DNA, 996 bp, Homo sapiens
cttttgagccaggatgagccaggagaaggaatttcacaaggtaatggcttcagttaaagcagaaaccggccattttcacttcttttgtgattcttcacttgcttcgggccatctcgacatatacatgcaggtcacaggggatatgatagcttagcttgggctcagaggcctgacactgttgatagtttattttgctctgcagacgttctttaacttcattaggcaatacttgtcaatttttgtttttgctgcaattgcttttggctactaagccaaaaattatttgccaaggctgatatcgggagggtatgtcctaggtttccttataggacatttacagttcgaagtcttacatttacatctttaatccatcatcagttaatttttgtatatggtgaaatgtaagggtccagttttattcttctacatatgactagccaattatcccagcatgatttactaaatggggagtcctttcctcattgcttttgttggccttgtcgaagatcagaggattatggagtcttgctctgtcgcccagccaggctgaagtgcagtggtgcaatcttggctcacttcaaactccgcctcccaggttcaagtgattctcctgcctcagtctcctgagtggctgggaccacaggtatggaatgcatttgaacaggcatattcctacagggcatcgccaacatgggaaataagtagtaatatgtcttgaaatcttactgagaaatttgactattttgtgaacatggtcctatatacaccacttagttttggtgatgtgatgggaatttagtgaaaccttcgtatgggttattttgtatgaactggccatgaaggtggctcttttcttacattttaacatggaagagagaagaagcatatggcagcccagaaatgctggacatcagggactttttgcttctgtgaatactgtgagtgtatctggaataaattacagtgactctaataaaatgaaatgttgaatcactt

SEQ ID NO: 732 - DNA, 1268 bp, Homo sapiens
ggcggcgagggcgggcagcagcagcgggagcaggggcgccccgggcgccggggccgctggggacgaacgcggcgggtcaggccccgaagcccgggccgcggtggccgcctcaggcgcccgctctggggtgggggtgggggcatctttcgggaccgaactcgccgcagcctccctctttgtgctcctttcccctgctgcccttccagatgcgctctttccagaaaggcagcacacgcatgtctctgccgtggccccagatcctccccgcgccgccgttttgagcgttcacactcattacccaggtccgtctgggagacccgccgggctcccgccctcccggcccgcagcctcctggccaaaatcctcccgggacaccccacctggactgctgcgaacgggcctccacccgcctccccggacccgcagcgccccccgctccctcagggttctggggtgaaggggtctgaatagcaccaggggaggcggcagggcgggcctgtcctacctgcgcccgagcactgctgagacgacatcccttccagcgccgccacgtagtccagccccagccagccgcgatatctccccacaaacctaaacaatttcgagagggacttgtgttctgcaaccagtcacagaatatcaggtgagctgggcgtgtcttcactgacccacccgcccagggatgctgcactcctctccaccctgctcagaatcactagaatgaccgttctgtggctacagccctaaaagagctactaaaaagaccagaagtagtatgagaacttatgaatacgaatataaataaaggacatctggagaacatgcatgaatgtctatgtaaagtgttaagtactgatcaaggaggaacgaaggagtcaggtggctctcagtctttttggagggactcgcagatcctcctgaagatctgatgaaagctgtcagccttctccccagaaaaatgcacatccacccaggattcttctcccacattacttcagaggacttagcaaccccctagggaagcccagggacccagagtaaagcactcctgggatagaggggttctgtggggaagatgacaggaaggaacatgcgtcagttcacaatgtcaaagtttaggaacaggcctggcgagccagccagctctgcagttctgtggtgctggtgggtgtggagaaggcaatttcagcataagtcgggggagggggagtggttagaaaccagtggctccattgtgagacaacctgggtttaaattctaggtatatt

SEQ ID NO: 733 - DNA, 1504 bp, Homo sapiens
cgcgcggctccaggtggcgggaggcggcggttggcgggaagggccgcgcgggcccgggggcggcgcctcagatgcgctctttccagaaaggcagcacacgcatgtctctgccgtggccccagatcctccccgcgccgccgttttgagcgttcacactcattacccaggtccgtctgggagacccgccgggctcccgccctcccggcccgcagcctcctggccaaaatcctcccgggacaccccacctggactgctgcgaacgggcctccacccgcctccccggacccgcagcgccccccgctccctcagggttctggggtgaaggggtctgaatagcaccaggggaggcggcagggcgggcctgtcctacctgcgcccgagcactgctgagacgacatcccttccagcgccgccacgtagtccagccccagccagccgcggtcctggaagcaccgcaggcagacgacctgctcctcactgggctcaggcagggtcacccgcccagtgccgctagctgcaaattgctttacatacagtgacccaaagagcaagtcatttcagggccccaccactctgattggaagtcataagcttgacaactgattggcctctgtcacccaagcgggtgtggggacactaggcccgcaggtgccactggaagaggcgttcagaagcactgcggtgctccagctcctggatgcagaaagacccagaaatgagggatggtgtgggtgggattcctgagcgttctgctaggcctgctgagcacttcttggccttttccataaggctttctcactctgtcttacagatatctccccacaaacctaaacaatttcgagagggacttgtgttctgcaaccagtcacagaatatcaggtgagctgggcgtgtcttcactgacccacccgcccagggatgctgcactcctctccaccctgctcagaatcactagaatgaccgttctgtggctacagccctaaaagagctactaaaaagaccagaagtagtatgagaacttatgaatacgaatataaataaaggacatctggagaacatgcatgaatgtctatgtaaagtgttaagtactgatcaaggaggaacgaaggagtcaggtggctctcagtctttttggagggactcgcagatcctcctgaagatctgatgaaagctgtcagccttctccccagaaaaatgcacatccacccaggattcttctcccacattacttcagaggacttagcaaccccctagggaagcccagggacccagagtaaagcactcctgggatagaggggttctgtggggaagatgacaggaaggaacatgcgtcagttcacaatgtcaaagtttaggaacaggcctggcgagccagccagctctgcagttctgtggtgctggtgggtgtggagaaggcaatttcagcataagtcgggggagggggagtggttagaaaccagtggctccattgtgagacaacctgggtttaaattctaggtatatt

SEQ ID NO: 734 - DNA, 6514 bp, Homo sapiens
ccagttatttgaatttgtgaacctgaacttccagcttaggatttgttttcctcggccctgctgatcagctctcactttaccgctgcttttcagcttctctaattttgctgttatttttttctccatctttggggaatttatacttttgttattggagagatttaaaataatttgtattaccattcctcaaatctcagaccatccttttgggataattttcctccaccctgaacaacatcctttagaagtttttcagggtaattatcttggtattaagattcttcagtttctgttaatctgaaaatgtctgcattttgctctcattcttaaaaggtgttgctgagttcccagctgtgggttgacagttaatttctctcaacatttcaaaagttattatctgactgccttctgactccctttgggctgttaggaagtagctgtcattcaatagatgttccttcataagcaatctgtacattcctctgggtcctttgaaggttttttcttgttttttttttttgttttttgtttttttttttttgagatggagtctcactgtctcccaggctggagtgcaatggcgcaatcttggctcactgcaagctctgcctctggggttcatgccattctcctgcctcagcctcccaagtagctgggactacaggtgcccgccaccgcgcccagctaattttttttgtatttttagtagagacagggtttcgtcgtgttagccaggatggtctcgatctcctgacctcgtgatccgcctgcctcggcctcccaaagtgctgggattacaggcgtgagccaccgcgcccagcctgaaggttcgttctttgtgtttagtgttcaccagtttcaatatactgtgtgtgggcgtggactgctttcacttctcctctttggaatacattatgctttctgtttctggagacagcttctaattttaaccagtgctgtaaatttgcactattttctctttaaatattatctcttctccactctccctattatctcctttagagtctctgatttaaaacattttagaactttccatcttgtcttccatatctttgtgaaatttcccatttcctgtctctctgtgctgcattctgcctgatatcttcagctagatcttccagttcactaattctttgttcagctatgctaattagctctccaactcactcaggcttcctcattttataatttttcctttccaaatgtatctgtttgtttctaatttcccttgttggttggtcatttttgttctatttgttttgtattacatttctgacaagttaattatctgagatcttgggtgtctgaatctgttggttttttttttctggctttcaattatagcgacttgttttcttgtttatttaatctttgtgttgtgctcgttgcctgattttgattgttggggctcacactagggactgggaaagctcctgaggagagaattgctcctgtcctttcctatatcacagggcattgctggcctcgagggtccctctccatgtggggtgctgggttcaccttttcactctgctgctagccaagctcacagcagccctcaggagccctgtctctcccagctgctcatgagcttgtttctttggcctgacaccacctccttgctccagcctcaatgtgtgtgtttacttatttttagaagtgggggtagaaagtggagtcctccctgcatcttatgaaaggggcagtgtctcagagctgtatccatcccgtttcgccattctgtgggtggagggtgtcccctgagagtgccaaggtaggcgtctggattgtgccatccacacaccctcttctacagctccaatggagtatggtgggagtggagttaggtgtcagtgctcagttcctcagcctaccatctttgccaggaactccctgcccatcgcttctccatgttctaccctttgtcttcctcccccagtgccacagacccctcagccccagtccccatggcctgtgtgttgttgctgagcacagtgggccattccatgattatcctcctatggctcggacactgtggactgccgaccacttctcagcacagtgggctggaccaaccctcaccctgtaggcccagcagcaccctggagcccagcgtatccacatcccactaatatgaggggcatgcagtctcagtgtagttgtggagcccctccttctggcccaggtgccccccgtccacctgtggcagcacagtgtgcagggggctacagaccacgaatgggtccctcaggtgtgaacttgccctcacttgctcactgcccccctggctccccatgctgacccagttgggacaaggccttcctgaaactgggatggggtcaactgcttgggtatctctgggaggcatgttaaacgcaggtctgtaagtattcacgttgcgttttcatcaaaacaaacccagactcatccatttcttcccatgtccacgggtgtctctgaggcccaaacctctctcttttgggactattgcaggggcttctcctctccattttcctgtctatacccactactcactgctgtcaagatggcggccactgatgcagtgctgtttctgcactctgcgccttcccgtgctccccacctcattcaggagagggcagccacataggtcctgtctgatccaccctccggccaggcggcccctgtgggattcctcacacagcattccattaccggatggcgttccccattggtctccttcaaatctcaatgcctcagcacaacagtggccgtcctagtggcgtgggggccccagagacttctgtgatggcacccacgtcaacacatgccctggggccccagagacttctgtgatggcacccacgtcaacacatgccctggggccctggagacttctgtgatggcacccacatcaacacatgccctggggccccagagacttcagtgatggcacccacgtcaacacatgccctggggtccctgaggccaggaaagcacaatagcctctcacctgggcagtaaatgttctggccccaaagtgacgcctgtcctaccccagggacccccagctccatgctccaggagggagggcaggtggatccaggtgtctgcaggagtctgcaccacaaccccttccccagcctttcagtgatcctacaggacttcacaggctccacagtagcgcatggttctgtgagtctgctcttgcagtctctgccctttgactggagtgttgtgtccgtctgtcgaggcttcaatgcaccaccccattgtgctgctctggtgtctttgagtttagagctcctggcgaggttaactcggtcagcatcttctcctggtcatgccagccccagcggcccggtggctctgaccgtggagtttgccatgtgctctgactcaggagcatcaaggctggtgttctgtgcgttttatgggttctgattgtgggttcatgttcctggggatcctcttgagttccaagtacacagtgtgatctctacacaggatttacggccattctttcaggggcctcctggcattgtcagtcccaggaaccttaagaaaactttaagccaggggtttttcagatctccacgtcacctcagagctcatgcgcccgtgagcttgggcttagttcattgttttcaaggatggtgggcggggatggcgtgcagggtggtgggagctgggcctggggtctggttctagaagcatcagggctggagggccttagacagttacgaggaagggtcgtctaccaggcctcggtgagagaagtgagcccccaccttccagtcactgggagaggactgaagaagcagccatcccccaagcatctccatcctcaaaccacacagagctcccgcccaggcactgagagggccctggggttccaccagagagatccataacatggaaacactgacgcttccgaaaccgccccatttattcacttctcaagtggcccccgcttggatgcgccctcgggagagtgggctcagcacagcctagagcaccaggtctgaggtatctgcaaccacgtgggagccaggcccctggacgatgaaggacaatctcctggagcagcaataacttataaggagacataatttagagtagctggagccttggggatgactttatcctgcaggaggaggaggaggctgtttcccaatgcccgtgccggccaccagagggcccttcagtgcagagatggtcggcgcggcctcaccgcggtcaggagcagcgcgaaaccccctgtgccctcggccgcctgcagcatgagcctgcacaggagcccccgacaccccatggctccggggggccccaggggctgcggggctctggtcttagacgcagttatcagggacgcactcagcctcttcttcgagctcggggcaggggctcccgttgttggcgggctggacccggacgtagcgagtcctgctcttggtcccgagcctcccacagtggcctccgcacagtccccaggacgaccacagggagacctcgcagtccagcggcgtttctggaactggaccaagcaaaggggagaccgaggtgaacgctcgcgtgaagaggcgcttcgtacaaacggaagccacctcccaccaacgtgtgcattcatcagaggccacgcccacccttcgggggcacttgcgtttctccgcacagtcgcagagtgagcggcaagatgggatggcaccatagcaacctcggacacaacctagggactggagttgcgcgtttctacgtaagagccggagctgccgctcaagtccctgtggtggtggaactcccacatcgtggcagagtaaggggcccctgggaaccccgtgggaaccccgggagagggcggacacccctgctgtagaaagctgctctgcccgagcctggacccagctgctacatttacccgaataacagacaggggcacctgattagctgtcttgcgggacctggaccccccacaggactcagaccttttcagtatcgttctcgtttccctgtgtcccatctggttccataattttcataaatttaaaaatcatcatttggtgttatggttaagtcacttggtaatttccatgtttccaaagcaaagtgaaaacacctcttttgcaccccacaggccaagccagccagatggacagtgtttctctggctgtgtggcccagagcgggcagcccctaaggaggccaggagccccgcctcactctgccgtgcacgggaggacagtcagcaagggctcggctctcctcacaaatctgcgagtaccctgctgccagctttgtggctactgaaggatgagagagagtggagaagggggtcaatgtgcaggtgcagtgcctggactggtctggaagccctggccaggcccacacctggagcagccctctccagagatgcaggaacagggcttgcaaagaccttgggcgctgaggcttcgcaggggcactggtgtagaagccagagagccagggccccgggcagcccacctggggagcacacagagctgctggcagatcccagcaccccccagcttcctgactgaaaccgaggtggtgggagcgcccctgccctggctgcaatgaggagtcagtgagcactggcagtgcctgttctacagcgagggccccaccacaagcctctccaatgctgcagagccctgtcaggaggcctggggacaggcatccagcgtgtgagcaggaagccagagctgagccaggctggcttggcgtggacctggcggagcctcctgggtgccagccgccacatgcccatcccagcctctgccctcgggaagccagaagtcacaggagagacccttgtgggcggtggtctgtgctccgtccccactgcccactctggtccctcggctggcacagctggctctgtccgtctcccacccttctctccatgtcctgcctcctgctcagagctcatagcacagtctctccccacccttcccctgcaatactgcttctgcttggccacagctgactttatccctctcctagcccagggcactggccatgtgctcccctgcccactgtggcccagtgcccccaaatgtggggcaaaccgcacctctctggaccctctgcccacgaggggctcttcccgccagaccagttgcacaccacgaacagtgctggcacgtctgcctgttggggacggctgacagtaagcttgtaattactgctgctcctcaagacgacatctgtccctaccacatggcttggggggcaggtgtggggcggccccgtacctgcctcaactccagccagcaacatggagggtggaggacgacggggcccatggccaggttggtgggctccagttcctcctcgggaaagtctgaagtccgctgttgtctggggcctacactgactgtcccacacccatatcaggtgagacccagagacccagagccaacaggccctgacccacgacccagcaatgcgctccagaccacaggcgctccgtgaggccagtggctgccacccag

SEQ ID NO: 735 - DNA, 673 bp, Homo sapiens
gtgcgggatataatctcgtggtgcgccattttttaagccggtcggaaaagtgcagtattcgggtgggagtgacccgattttccagctaaaagaaggtctcaagagccacagatgtcttggatatttctgtatttcagactctactacccagacaccaaaagaagaaatgattaaccctggaggctgccttggtctaggtgaaaaaatatatgtacgatgacagtgcaatcatactagaactcaggattaagaaactcactcaaaactgctcaactacatggaaactgaacaacctgctcctgaatgactactgggtacataacgaaatgaaggcagaagtaaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagaggaaacacattcaaaagctagcagaaggcaagaaataactaaaatcagagcagaactgaaggaaatagagacacacaagaacccttcaaaaaatcaatgaatccaggggctggttttttgaaaagatcaataaaattgatagaccgctagcaagattaa

SEQ ID NO: 736 - DNA, 673 bp, Homo sapiens; identical to SEQ ID NO: 735

SEQ ID NO: 737 - DNA, 673 bp, Homo sapiens; identical to SEQ ID NO: 735

SEQ ID NO: 738 - DNA, 673 bp, Homo sapiens; identical to SEQ ID NO: 735

SEQ ID NO: 739 - DNA, 6566 bp, Homo sapiens
caatttattctataatcctaaagaaccttaaattacaattcactggtaaattaagatttctgaagttgtaagaaatggggccaaaacaagtcacgctcaaaaagggatggttaacacaagaaatgtgctatgagtaaagtgcatgaaagaaagcctgctcagctaaatgaagtagacaaagatcagaagtcaagggtcattcgccagagcggcagcaggctcgaaaaccacactgcaaattctggcatccactggcggtatcagcatgaggacctgtatgaaaacagaaaaatgtgaaaggaggaatttcttagagatcacataaaaataattttgcttatgaaggagttaaacattcattggttttactagcagtacttatatgatagaagtaaatctcatgataagtgtataagaaattattcagacacaaaactcaatagcagcttgactttaattaatatatccttcatggtccaaaaggtaagtggaagaagggaaaaaaataatttttagcaacaacttacaatataaaaatccaaaatggaaatgagacaatccacagaagcaagattgccaagctaacttataaaaagattcttataatctgaacatcctccctagaaatgtaataaaggcaaaaaacagccctaactataatcgatcagctaaagaagtcagtattgagcaattacaataaatattatcttcaaattttaaagcaaaataaactatatagacaaagatttaatatatttgccatatttttatttagtatttgtagccaaaaatatctatatatggtagggttagatgaaattattttccaaaattaaatatataatgagtgatcaattaaactgtagccatagtaaaaattatcattcacttacaaagaataaaaaaaaatctgtggaataactgacattttatcccagtcacactatgctacccaggcactagatacaagacccattagggaacatagctgagaattagaaaatatcaaagaagaagtttcacagcacatattcaaatgtcaagtactctgaatgaatgatattttcataaaagcaggcaaatgtggaaaagattgtttcaactatattgaagtctttcattatgtctataccatgaacaaataaggagtagttaatttgttctttacatatcaacaagaacaaccaaaatacttgcaattgtgatataaggaacaatacaaaatgaaaactgtacatgaaatataattttactgcagaatatatcaaatggattgtaactgaaaaatcacagtactctggggtgatatctagcttaactcaaaaacacattttaaatttactttttattttctaaaacagcactcggctgcaacaacaacaacaaaaaagcaagtaagctaatactaccataacaattacttccaactaaacacatagaacacattaatttccagaaatttaacttttccttatattccccaaatggcacatacaaaatacaaagggcaaatttcttaagacatacagtcttaggaaagaaactaataaacattacgcaaatatgtggaactacaacagcttatgctttcagtcatattaatttttaagttgatatgacacctgtgattagcttaatggcggagtagatatgggaatgagcaatggtatagatgaaaggagactgcccacaggtttataactgctgaagctgatggtacatgaggattcgttgtattattcgatgttaaatttttccataacaggaagtttaaaattattttaaatataaagttgaattactaaagccaatttttatttaatcaaaataacaatcttttctggtctttaaatgagaagttaaatatgttaaatatttaaaattcacaaagcagcattttgttaaaattattttcccttaaaataagaaacaatgttaatcatcttaatcacaaactcaagataaaatgttttagtatatattgaatacttattaaaaatgccctgagaagcaaccctatgatctgaaattcttctcccactgccaatctttaaccaagtttttcctttgaatataatgccagctttacccactgtgcaccacccaatccccattattccccttcttagcttgtctttcctcaccccttacactgcccactgttttgtctaccaatcacctagtgcctctcctcaagacacaagccctgcctcactgccattctcctgctctgacccttaggtccatcatgaaatgccagattcactgggttttgccaaaatggatctgattatcattttatcagattaaaattccattctaaatttttttaaagaaataagaagagacatgaagactctatacaatttttccaaactgcaactccctcaaatatttcaaaatgtctataccattaagtcctcacttaacatcgataggttcttagaaactgcgactctaagcaaaataacgtataacaaaggtagttgttttgtttgcatcattataatgaaatgacactatttgaggacttcctgtatgttttctttaaagtcagtttccaaaaacataccaccgacacggaggacttactatagtcctatttttttaaaaggacagaaaggtaagggagaaatattatgctaaatttcaacagtagcctaagaaaaatatgccatatctggaagcaatggaagtgaagtatgcaattggttttcaaaggataaagtaaaagggagactcaaaggagcaaacagatcaaaaaagctattctcctagagattcagatctaacctgacatgacacagtttttcaccaccctccccaaaagatgtagggtccacatgctcagtttccaccctagctacctgggtcattatgctcctgaagtctaagggatggtggcagagataatgggggaagaaaaatgtagaaataaaagtttttaccctgtattaggtaaaaagcacaaacctactgtcagcatctccttatttatcacaaaacaaagttcctgcctatattcatataaaatgtgtctactcagtgagtagacacattttatatgaatataggcaagaactctgaatacattttaagttcaccagaattgagtttcagtgagattctaagtatacagagtgaagagagagaatatattgttttcaaatttgaaagcagaatctgtttaaagaaggctatatgaacttaatcagtaactatagtattaaatgactcaaaactacaatcctatgataaggtaaataataagagtagttactggtatttgatcccaataatcatgaaagtgacagcacccattaaaggatctgctgaaggcctgagccaaaacaaaaatgaagacaagcactgttttaaactcagtatcacattgtagaaaacaggagactaacaccttccaaagcatggaaagtataagcaacattaacaataaaatccttaagtaacacagaaggactgttcagagaagtgaataaatggacaacagaataaatggacaacagaaaaggtgagggaaaactagaaagaaatatgactaagatatgatggattgccaggtagacagctatgctttaacagacgaagataattcacaaggtagttccctttaaatatttgacttatcaccagcaaacttccatctcgatgtaggacacagaacccaaatggttaagatatataaagcctaaattacattaaggaataataaagaaaatagaaaaatataattgaataatcattaaaatatttaaatgcgtggtaaagaataatcttataagaaagcatttttaagtatcagatgataggaagtataaggttagctattatttctccagacttttattattgaataacttgtttttactgagttctaagtatattacttatgctgtatatctgcacttaccttcacttacctttaattcctctttaacttaaattagaaacataaaagagcacatcatctgagactgtgtcacctccaaaactatgagctaatctatcttaatttataaattatacatacattgaaatgcaaatcagtaaaaaagtttatttgctatcattgctcaaatgttcttcacagctctacaactatgctattccatttaacacttcttaaatgttaaagaaattttttaatgttatggctaagaagacttttcaaatcttatcaaataaatttaaaagtcataaagaatcattcagaagaatctagacttgcattttatatcaagacactttatgtacagtgtcttgcactgtactgggcactgtttgaatatatgataactaacttattatctccaaaatctctgctaatgcttggaaaatagatcattctgctttacttatcatgtattacttaatgactaatgtttatcagtattaacttcttttacatttagtaacctgatagttaactatatatgttttcttttaaaaaatatatttttagctaaacgtcactttcaaatatttgaaatataatttgtcacctaaatacacttctccattgctctaataccacgtattaaaacacactactttcagaaataataaaaatagtaacaaggatgcccctgagcattcactagatatctactgtacaagctgagctgttttgaaagatactggaacaagtgtcatcttgcaaaactggatacaacacaacttctttctaacactttctaggttgtccacatatccttttaaggaaaagactatgagagagcattgctttaagaacaacctatgtggaactcagacacaagttatttaacaagtcaccctgtaaattttaaaggctttccattcccccaaatcatgcttcaataagctataaaaggagagttaatattggattatacaagcactgaaatttcctttcaaatctttcaaagtcagatatcttcatcacaattcatttattttaaaaaatcaatcatttatccaaaaaaacttttacattcaacaaaaggaatataatagctcctctgaaactatatattcaaaacaagtttagaggaaatgcataaggacaaagtgcaaaagattttaattatttcattttatcccatcatctaaattatttcaaagtttaaaaacatacaaacataaaacaagtaagcataaaaacaaactgaaacccagtcccctccctctacccaataacatctatgaatccaaaaataaatataatgaattcaatagtgagatttattccaaagcataacctatgctgaaatcaatatgaaaaattcaaatgcaacatacaaataaaattttttctgataaaaaacaattgcttattaattactcttgataatatgtcctataagccttaggaagtggaagtatagcactaaacctacaataaaataactttatgttaacaaaactccgttctcaaatccacagcatccacaaaagtaacagcttcactgcatcaatcaaactttgttttcataggcttagcatgttgcaactacaatgacattcactttcaccaactacgatgacattcactttcaccaactatgatgacattcactttggccattccttgattatacacagaaggcaacagaaaacaaagaaatgtccaacttagtgctgatatatcaagaacatgggaggtcatctcctgcataacaatgtgattcctgaaataagagagctaccatctccagtttcctcttatatattttaaggaaaacctaatctcgagaaatagcagttttctccattttgcggtatgtcattactccctctggtcttcctgactcctgtcaattgttctgcctgagaaaaattttgttgattttcctgtcatcttaaggtgaactgggcactcaaagacaatagggcgcagtataaaaagacaggtacatagtagtctgagccatctaaaattttctccagttataaatacaggaggttgatttgcttactaataacagaagagcagctttttatgcttctgggaaattcagtctctaccagtgactatcaaatgtgcaaaaaggcactgaacatactttgaaaaagcatgttcaataagaccactgtagggtagaatatgtttaaaagaacaaaatcaagaagtatttcttgtgatttttgaaagtaggttcaggaatcaatttccaaaatactacaggaattctagtcatgtctaaagcatctcagactcttctcaatactacatactgtcctctcccctcaatctttgctaagagttgtcatcagatccagaaactctggaagtccacattaccaaagtcctcatttttctacatttgataaagctgtcttacaagaaataagactctattatccctaagaaatcagtgtatctagaacataaatagttctaaattcttaatgagtgctacaaaactctagaggaatacctaaaacttttaacaagaattttagtatttctattaacttaccatttttgattacactattacatccctcaaaaatctgacacaatggatatttagaatatacatctgcaagaaaaacttacctttcaa

SEQ ID NO: 740 - DNA, 5875 bp, Homo sapiens
atgggcactaatcctatcacaaggcctctaccctcatgaactcattaccttccaaaggtcccacctccaaatgctagcacattggggattagggaattcaacatatgaattttggggggaaggtacacaaacatttagtccatagcatgtatatatactatgatcccttctatgtaaaacaaaaatataaactatatacatacgtatatgcatattaaatttctagaaggagccaggcacggtggctcacgcctgtaatcccagcactttgggaggccgaggtgggtggatcacgaggtcaggagatcgagaccatcctggctaacacagtgaaaccccgtctctactaaaaatacaaaaaaattagccaggcatggtggcgggtgcctgtagtcccagctactcgggaggctgaggcagaagaatggcatgaaacagggacgtggagcttgcaggagccaagatcgcgccactgcactccagcctgggagacagagtgaggctccatctcaaaaaaaaaaaaaaaaaaaaaaaaaattctagaaagatgtgtgtctatactttccaaaaacagccacagaattaaagccaaacatgctcttctagaatcttgccactccccattgagaggtgaaatctggccagactctgtggctcatgcctgtaatcctaacactttgggaggtcaaggcaggaggaacgcttgagcccaggctatggtcaagccattgccctccatcctgggtgacagagcaagaccctgtcaaagaagaaaggaggaagaaggaagaagaaaggaaagagggaggaaggaaagagagaaatctgtttgccctcctcttgaacctggacaggcctgtgactgctacacccaagaatataggaaaggtgttatgacttcttacactaagttctctccctctcccatctcctctcaggagggatgttctcccttggaaccaggccaccattctatgaggaagccaagcagccacatgaaaaggccgtatgtagacattctaactgacaatactagctaaggttccagctactcaccagcatcaactatcagacagtgagtaaccaagtttccagatacttcctgccctcagcttctatgtcttctagctaagaacacaaacaatgatcagcagacaagctgtgtgaattccagacacagtctgtcagcttaatgaatggttgttctatggaactaagttttggggaaatttgttatacaataataataatgggaacaatacacaagaaactgtcggctgagggtggtggctcacgcctgtaatcccagcactttgggaggtcaagaagggaagagtgcttgaggccaggagtttgagaccagcctgggcaaaatagagagaccccatctctattctaaataaataaataaaacgtaactatacatcctaaatacacagttcaaaattggtaagaccaattgtattgctaattatagaaggctatgtgccttttatgtcttccagtgcctgcatattgatttaaaaaaaggattaagatttgaaacaaagtagtccactgaaatttccttattgactaaaataaaactcaaaagttaatcacacgattaaaaaagctttcatagcaacatgaaaaatgcaaaatattattaaattgaggaaaatatacatattccatagtatctaaaaacatatttcttaaaaagatctgggaagatacacaccaattcatctaggaaagtaggaaataaaagctaagtatggggaaaggagttcagccttacttttaatgtattgatattttttgaaaacacatattcatatattatttatataaataattaaatattttaaaaagaaaaacaaatattttacaaaagttttaacacaactagcaaaaatacatttgctgcatagagaagtctctcaaagaaactttccagacacagatatttttcttccaggaaaggtccgatgggccttaaagtgatttatttaagtacagtagacatcacaatttacagggcattcaggctgataaaaaggaatctgaccaagggtctcccaaatcacatttttacagtactttaatacagaaacaaatttactttattttttcttcagacagagtctcgctctgtcacccaggctggagtacaatggcgcgatctctgcacactgtaacctctgcctcctgggctcaagcaattttcctgcctcagcctctcaagtagctggaattacaggtgcccatcaccacatctggctaatttttgtatttttagtagagatgagttttcaccatgttgaccaggttagtttcaaactcctgacctcaaatgattcgcccgccttagcttcccacagtgctgggattacaggcatgagccactgcacctggcccagaaacaaatttcagtgaagatgtagaagttttagttatgctgtttagattaagagttgaaatacagagctcaacaattaaaacataaaaatgaagaggattacctgcattccaaaatcttagattctaacagaacaggaaaaacacatgagcataatccaagttcgcatttctaaatccatctgctttctctttctagaattcctatcattaatagaagaaactatatgccaagtgacagccagtgaagcagaacaacaggagaagacggcgaagccagaagcaaattatttcaatggaagaaaaatcccctctccaggttgttttcattgccggccctataatgtgtactttaaaataaccctataataacatagtcagagaagcttagtgaggtggctcacgactgtaatcttagcacttaaggagggtggaacaggaggaagcttgaggctaggtgtgtgagaccagcgtaggcaacacagtgagaccccatctctacaaaaaaaaatacaaaaattagccaggcacaatggtgtgtacctgtagaaccagctactctggagactgaggtgggaggatcgcttgagcccaggagttcaaggctgcagtgatctattacaccactccactccagcctagatgatacaatgagaccctgtctcttaaaataaaaataaaggaaaaatatagatagatagacagatagatagatagtcacagagatggtcatttgcctctttttttttttttttttttaagacagggtctcactttgttgctcaggctggtttctaaatcctgcctttaaacaatcctcccgcctctgcctccgaaagtgctgagattatgagcatgagcccagccagatttatagtctttgtactaaaacttatatataaccagtgatgaggcagtagtaagagaagttccaactgctgttagtgcccataaagctttatgagaggatacttttcttctatttttatagattttttaaaacattctgatgagaacaaatcctaccaatttataaatcaaggtaatgagaagttttattaagaattattgaacagctacattgtagtgtacattttcttttcaaatcatataactatggtgcatttaaagattttcttcttcagaaaagagagaagaatcaaatagacgcaataaaaaatgataaaggggatatcaccaccaatcccacagaaatacaaactatcatcagagaatactacaaacgcctctacgcaaagaaactagaaaatctagaagaaatggttaaattcctcgacacatacaccctcccaagactaaaccaggaagaagttgactctctgaatagaccaataacaggctctgaaattgtggcaataattaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccaaatccagcagcacatcaaaaagcttatccaccatgaccaagtgggcttcattcctgggatgtaaggctggttcaatatatgcaaatcaataaatgtaatccagcatataaacagaaccaaagacaaaaaccacatgattatctcaatagatgcagaaaaggcctttgacaaaattcgacaacccttcatgctaaaaactttcaataaattaggtattgatgggacgtatctcaaaataataagagctatctatgacaaacccacagccaatatcatactgaatgggcaaaaactggaagcattccctttgaaaactggcacaagacaaggatgccttctctcaccactcctattcaacatagtgttggaagttctggccagggcaattaggcaggagaaggaaataaagggtattcaattaggaagaggaagtcaaattgtccctgtttgcagatcacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacagttgcttcaaagagaataaaatacctaggaatccaacttacaagggatgtgaaggacctcgtcaaggagaactacaaaccactgctcaatgaaataaaagaggatacaaacaaatggaagaatattccatgctcatgggtaggaagaatcaatatcatgaaaatggccatactgcccaaggtaatttatagattcaatgccatccccatcaagctaccaatgactttcttcatagaattggaaaaaactactttaaagttcatatggaaccaaaaaagagcccgcattgccaagtcaatcccaagccaaaagaacaaagctggaggcatcacggtacctgacttcaaactatactacaaggctacagtaaccaagacagtatggtactggtaccaaaacagagatatagatcaatggaacagaacagagccctcggaaataacgccgcatatctacaactgtctgatctttgacaaacctgagaaaaacaagcaatggggaaaggattccctatttaataaatggtgctgggaaaactggctagccatatgtagaaagctgaaactggatcatttccttacaccttacacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaagacacatgaaaaaatgctcaccatcactgggcatcagagaaatgcaaatcaaaaccacaatgagataccatctcacaccagttagaatggcgatcattaaaaagtcaggaaacaacaggtgctggagaggatgtggagaaacaggaacacttttacactgttggtgggactgtaaactagttcaacccttgtggaagtcagtgtggcgat

SEQ ID NO: 741 - DNA, 5875 bp, Homo sapiens; identical to SEQ ID NO: 740

SEQ ID NO: 742 - DNA, 837 bp, Homo sapiens
gactccgtgggcgtaggaccctacgagccaggtgtgggatgtaatctcatggtgagccatttttttaagccggtctgaaaagcgcaatattcgggtgggagtgacctgattttccagttgagacaggatctcactatgttgccttgcatggactggaactccttggctcaagaaatcttcttgcctcagcctcccaaatagctaggactatatgcacatgctactacacctagtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctactgtttgtttctcacaaattatgactggcatctgtatatctgggaaggttctactgcattgctgtattatcactatataattataagagatcacagagtgcattgatgaaggccatgttgagacatgatgaaacagggtccattgtgactgggtgaaactgtcttcaatttcctggtctataaagcagag

SEQ ID NO: 743 - DNA, 837 bp, Homo sapiens; identical to SEQ ID NO: 742

SEQ ID NO: 744 - DNA, 837 bp, Homo sapiens; identical to SEQ ID NO: 742

SEQ ID NO: 745 - DNA, 757 bp, Homo sapiens
cagcgagactccgtgggcgtaggaccctacgagccaggtgtgggatgtaatctcatgagctggtatacgatgcctctccagaatcaccttgttctttctggatctattcagaatctgaaactcctagaaaagaaaaatgcaagatgcatgaggtggaaaatgaagcacagagaagttcagtgatggacctcagatactaccagcagaaagcagaagagctaggatttcaacttaggatgtctggatccacagtctgcactcctacccactatgctacactgcctctaactatgaggaagcaagggcatttttttttttctggtgactaaaaagataagagttcaagtatgtggctcctgataatctaacttatacagcctggaaaaattgatagttactatatccagactgtctcattcaattaacagtttctcaagtaatcttctagttactgtcgtattttatctgtatcaacttagcaaaccaagtccaaaacattttatatgtgtctatctttcctgctgttcatattattgagttagccaaataaattcaattttttttctactgtttgtttctcacaaattatgactggcatctgtatatctgggaaggttctactgcattgctgtattatcactatataattataagagatcacagagtgcattgatgaaggccatgttgagacatgatgaaacagggtccattgtgactgggtgaaactgtcttcaatttcctggtctataaagcagag

SEQ ID NO: 746 - DNA, 1574 bp, Homo sapiens
ctgggaggcgaaggttgcagtgagccaggatcacaccactgcattctagtctgggcaacttccagcctcaactttttttgagactctgtctcaaaaaaaaaaaaagggtataaagcaatcagtaatattgtcagattttaaatttcaagacaggaggggtcatctcccactcatctttataaatcccacagcactacacaaaacacatctgttgaataaattgatgtagtaataacaatatgacaaagtaaaagcattcattggatttttttagaaagttgacattttttccatgaaatatcactagcttactagtagtttacaatttttactagtttaccagagtatttgcatagatgtctattgtattcttttaattttttatctcttcaaactatgtcccatctgtggttgccatttttcttgctttgatttgacaaagtttcatctcttatataggtcttttgggaaaaaagctcttagatttatttattatgcttatttttctagtagaagagatgtatttatttcagcaaaattataaagtaaaaaatcaaagaaacaataatatttggcactcgctgagacataattttgtaaagaagaaaacagtaatcagcataagtataataaattataaagatctattgatcttttaatgggggcaaataaccagaagaaacacaaaaagacttaaaatacagcatcattgtcacatctcatgaaaacattcccataaaaaattaacaatttccacttgaacatgtatttcagccctctttgaacttattctgaaatcttgatgctctactgacgtttatagactagccattttctcactccatgaactcacaagttatcggtctcttcaaaagcaattaaaaaggagcacttcatgttagatatagagtacttaaaggctaatatttaatcttaattggcaacaagtttagtgcaaatacaattatatttagcggcttagatagtcctggtaaggatgcattctcttaacccttactgtttccccagagtgaaatcatttctctctttttatgagtacaaacgttggccattcaaacctctgaaaactagtaacgataattctgtttgttacacagggagtttccatgaaagatggtttcagtcactatgtaaatgagccacatggtttttacatttggaaagttcccttcgggttgatacaaaaaagcagggcctgaatgacagtcattcctcttaggaatggagtccaagtcataactggatcttacccagctgcttctctgatcagtgagaagacccaaaggaggcattaatcattttacccattaaccaccatgcatggaattcaaaagaagacttgagaacagggctgaggaatctcttaaatcgaactgtgctctccagtaataattttatttcactgatttaaatgccaaaaaaagaaaaataaagccatctgatttcaaacctggtgcttcccactgtcagccaagatttattcttcaaatgaacagaagccagagagctactagcctgggactcctgcttcaggaaacaatatggcttactgt

SEQ ID NO: 747 - DNA, 1574 bp, Homo sapiens; identical to SEQ ID NO: 746

SEQ ID NO: 748 - DNA, 1574 bp, Homo sapiens; identical to SEQ ID NO: 746

SEQ ID NO: 749 - DNA, 1574 bp, Homo sapiens; identical to SEQ ID NO: 746

SEQ ID NO: 750 - DNA, 1574 bp, Homo sapiens; identical to SEQ ID NO: 746

SEQ ID NO: 751 - DNA, 1574 bp, Homo sapiens; identical to SEQ ID NO: 746

SEQ ID NO: 752 - DNA, 1574 bp, Homo sapiens; identical to SEQ ID NO: 746

SEQ ID NO: 753 - DNA, 1574 bp, Homo sapiens; identical to SEQ ID NO: 746

SEQ ID NO: 754 - DNA, 10936 bp, Homo sapiens
ctcaaggagaagtgtacaagctaaactggatcattctaattttcctgaacacttacaacctcgtaggaagacatacatacataagtaagtatgatacaaggaaaatttgtaagacaaagtaaataaaagtattataagaaacacagaagagggatagattactttaggctgagtgaggtggcttttgagttcctactagaagggtgtgtaggattgtgactagaagagagaggaaggtctggatggagcaacaagagtctgggctattaacacaggtttgagtcaggctgaccggagctgtaaagcccttctcgttctcactgtgtgttcttttcagttctgtcttcctgaggctgctgtttctgggcatggccaggggatcttcagactttacaaaccagttgtgcagagccaggcatttcaataaggaacaaaatgctgagtaacaacatgaagtcagagtgttgcttgccaagagctgggaggcctgggtggtttcccaatcttaaagaagcagaaggatattaaagtgagcctcccaaaggaaaacgtggatctacttaccaacgcagaaaatgatacacacggattcgatttaggcacgctacattcaaatgacttggaagagcaggttctctgagccaggatactaaagtccctgtttaggaaagagccacgttgtatgtttaccctaccacaaagatacagaattctggaggaaagtggctctgggaattgaacagtggctcagtgatgttggggccaccaagtctgcaattctccctacctgttcttcatggttgtaagatgactgctgcaattctcggcatcatgtgcatgttaatgtcaggaggaagaaaggaagagggagcactgggatgttacattcattttgtcaggaaaagcaaagcctttccagacagctccgaaacttgcttacctctcattggccagcaccatcacttgaccacttgtccactcctagctgcaaggaaagtggcaaagtagaaggtatttgagaatgtctgctgggttagccaaaacaatagtgacttctacacccaattttctgggcactgcagaagtatccttgagtcctatgtgatcagagggagagcaaacctcaataatgaaacagattcaatttccatcacccagtgagacaccatgggattagaataaatttttaaaaaaacaaattgaaaaaaatgcatttttaaaacaacaaaatcagaaaggatgaaaggtgatatttctagcatatcagtttgtggtggtaaattaattaccttatacaaaggcctcagtgactttcttctccttacctaacgaatcatctttaaaataagtaaaataaagaaacaagagcagcagcagatgcttcctaaaaagaagttaccaaatctgttcaccacaaacctgagaattcaactgtggacatttggacaccagcaatgaacatgaaactcagcttatgaggcatatttggctaaaggtcaaggtgacttaaagttcatcataggacatctacaatttgcaaagcaggtgactggatatggactccttccaagtctcatttaattggataatgcctacgttttaagtatcagaagtgagtctttctctattaaatgaagtcagttccactaaaacctaaatcttgtttggcaggcactccatgtttcttaatttttattccatgctgtatattcttttagacttgattttcacttttttttcttttttcctgtacatttatctttgctgtgaaacaaagtgccctgctttgaaggacaggtttgtgggctgctggtggtgagacaacagcagtccttccaagtcttcctcccatcactctgttagctctccctttgtttttaattagcattacaccagttaattctgttatctcttaaccctggttctgcatcctcttcttcttttctattccttactccgctcctgttttttcttgttctgcttttccaagaaatgtcttgtctcctcatcagttgactgtcttctctttccagagggaccataaaggtgccagcctaaggaacacgtaaaacgtgggaacagacaaacaagctgctgcctattacagagatagataattaactttggaccattacatgcaattcatcagcttatctttttcaaactttatataagaagtcatttcccaatggtaaccacttgccagctgcaactttgacgcatattatcaggataggtgagattgatgggggccctttgaactcttcccagggaattatctttataatgttacagttttctctatagcatggtcatattgttaacattggttataaggtcatatggttagtatggttagtattggtggctcacagctgtaataccagcactttgggaggccaaggtgggaggatcacttgagccctggtgttcaaaaccagctctggaaacatagcaagaccttgtctctacaaaaaaaaattaaataaattaaaagattagctgggcatggtggcacatgcctgtagtcctcactacttgggaaactaaggtgggaggatcctttgagcttgggaggttgaggctgcagtgagctgtggttgtgccatggcactccagcctgggtgacagagtgagagcctgtctcaaaaaaaaaaaaaaaaaaaaaaaaaagtacctgtaaggtctttgggattttgaagatgaaaggtgttgcataaattgaatgaattcacttagagagatagaaggcaactacagggaatattacgtacatcatggagcggaaagcactaaggcctgtggaattattctcagtgacacgtcgttgagggcagtggtccacatgttttgaacatggtttctcccaggtgaaaaggatgagtaatttgttctccttcacatgtgtgtatgtaggtcttatacacagcagatttgccacaaaacaaatgaagattacactttgggcccctctctcacatgagccccttccaaagttctgtttgctaattttacattttgtaatttcttattatttttcttaaagaagcctcctccaattgcataaacttcaagcctcacaaaatttggatccatacctgagccaacatacaatacaattttccatttctaacttttagttgtacctagtgttttattggaaatgatcaagtacatgagtggtgtctttttaaaaaatttactttatttgcttctctagcttcatcgttagttaggcagttaaatctaaccatttggaggtattttcatataacctccattgaggacaatttggcaatagcttttaaaattataaatatatttgtacagttataagctgccatatctataaaactatttgatagacaaaagttgaaaaccctccaagagctcatcaataaaagattaaattaattatgatacatccatatgagcactgagcagctgtgaaaaaaatgaggaagtaattcctgtgctgatatgggaagacttccaagacatgttgttaagtacagaatggtgtatacagtatgctatatagtgtggtaaaaggtttagggataagcatttatatttataactgtttatatttacataaagtaattctgaaaggatacaaaaaagctaacaaaagagattacctgtggtagtgtggggcttggggattggatgggtgagaaacagtagtggaaatgagatattgtacagtttaaggcattatacacctataaaaacatgggaatgtattacctactcaaaaagtgaaattaagagagatacaagaaactgtttggatgttccttcccgtttcaatgtatctatattttttcagccctcaaagttattataaatgtcattataataacttcataaagcttcccctataatgagaatcttaccattctcctaactccaatagcactgtaatccacctctgttaggacacatcactcttcatcatgtgtgattattatttgcagatatcatcttcaaggctcttctctatttaccacctgccattcttgttctcacctctacatgaccttcacattttatttctctcggttttttggacaagctacattcccttccacagagaaggcttccctgacccctttcacttggttggattaccttgctattcttttctatctttgtacattccttttcaaaatacttatctcccttgttgttacctataatgtctgtcttctttactcaagagtctagacaaaaagctccacgccagcctcggctgtgtttgtattgtttacgtctgtgttcctagtgcttaataaaatacctagcaagggttaataagtacttgttgactggaagggaatgacttccttcccttactagagagtgatttccttacaggcgagatgtgtcaaccttctatagcccacataaaataaaggacaatatctcctattggataaaagacaagaatttacatatgagttttgtcatttaccataccagctctgggatcttaactttttagcctctctgggcttcagagctctcatctacattaagtttttcattcattctgtcattcaataaatatttatggaatgcttagcatgtgccactagtctagcaactgtggatactgaagtacgcaaggcagaatagtacttgctatctgaagcacacggtttaattggggtggggaaagagttggtggggagggtctcattaaacatataagccaaataaaccaaaattacaggtagagttaaggccatggcagagcaactgaaggtgatgaattcagagaggccaggaagggaccctctgaagcgatcatatctgaactgagtttttgagtcaactaaatgagatagtgtctgtgaatgtcttagaatcatgtctggcatgtaataagtgtcataaatgataagtattactatttataaaaacttgtcaaaaaatgaaccaaaaatacaagcagcttgtctttcacatataaaatactatagttgcaacatgtatatgtctttgtatagtgagaaagcatattgtatgtatattatatttcatttgagtaagttattttttaactgaaggaatctcctattttggttctgaaatagttaacgttccttttaagtagtctcatttataccttgagagtgatttaattacccacagcatctgtttaacattgtactcacagagaaatcacagaaacgtatgcaacattggttgttcctaagtagattcaatgttctctaaggtctcattaacctgtaagttctcacatgtttgttacatctgagctaatgaagaaatagccaggggtaaggaactgagaaagagactatggctgtctcaacacaaacccattccaggactgtaaaaaatatctgacaagtcatatcttcccagtgtggtagtaaaatcactggagtgtattggatggtataagcaactgaagaggattaagaatggcctctgtggctgggcacagaggttcacgcttgtaatctcagaacattgggaggcttaggtgggagaatcacttgaactcaggagtctgagaccagcttgggcaacataggaagacccccacctctacaaaaaaaaattaaaaattagctgggtctcgtggtgcacgtctgtggtcccagctactcaagaggctgaggtgggaggattgcttgggcccaggaggttgaggctgcagtgagccaagatcacaccactgcactcaagcctaggtgatggagcaataaccactctagaaaaaaaaaaagaaaaaagaaaggaaaaaaaaaaagaatggtctctttgccaggcatttctcctttagtccctaaaaaacataggcagtaggtagctgcctcaagttggattcttcagaagctgacccttagacgcaggagagagaagtgtaagatggggataaaagtctcttttccaggtaaagtctctgcctgggctggggtattctagggtaatgtgtaaattacacattgaagtttgtccttatttgaggttagagaattaggctttcaaactcctgcaccagtcactcactggctatgaccccaagcagctccagtagcccaagggcagttccccaaagacagccacagatatgggctgggcaagcaaatgacagaggggctttctgcacagaaatgatgaaggaggcccacagaatcagggcagagccctacccgtgctctacggcattcatatccccaatttacatgggagaaaatccgacactcagagaggtcaagtacttcattaaaggtaactgtttaaggggcagagcttggctacaaacccagacagatttgactccacagttcatgctcactcttctctaccaaatgtgcctccctttcctgaccatcagttatatattcaggaacatattctgtatttatataaatagacattattaacctagcttcctgaggcagaagattctatcaggaattgtagtgaaatattatatttggggatctctagaagagcactacctaaaatcaatgcaatgaaagctacctgtgtaatttaaaatttactagtgctctcaataaaaaggaaaataaataagagaaattaaattaaataatatattttattttacccaacatacccaaaatattatttcaacatataatcaatattttaaaatgtaaaattttttatacaatgtatttttgtgtcctttacacttgtagcatgtctcaatttggttgtgaaatatttatcaaaaacattgccaggtgtggtggcttatggctgtaatctcagcactttgggagggaggcagattacttgaggtcaggagttggagaccagcctggccaacatgaaacctcatctctattaaaaatacaaaaattagccaggcatggtggcacatgcctataatcccagctacttgggaggctgaggcaggagaatcacttgcaccagggaggcagtggttgcagcgagcagagatcttacccctgcactcaagcttgggcaaccgagcgagattccatctcaaaaaaaatacttgatgtgaatttagatttcatacgatttacagctgaaaaagtagattcacatagccaagttagtccaagaacacttaaaactttctataactgcatcaagtatcatttttaaaatttaaaaatattaaaattaaatttaaaaaaattagttcctcagtcgcactagtcatatttcaaatgctcaatagttttacaaggctggtggctaccacattgaagagtacagaaaattttccctatgaaaaggtacaaggatgtgattcagtataccatcaagaatcaaaccagtcaaccaataggtaaatattgagtgtctctcacgtgttgcatgtagtagatatagtggcagctaaaacacccttggccaggacaagttagctataaggactttgcaattggagttacatggaaggaataagaattggccattctccaggcacagtggctcacgcctgtaatctcagcactttcagaggccaaggtgggtggatcacctgaggtcaggagtttgagaccagcctgaccaacatggtgaaaccccgtctctactaaaaaaaaacacaaaaattagccaggcatggtggcgggtgcttttgtaatcccagctactcgggaggctgaggcaggagaatcacttgaagcagggaggtggaggttgcagtgagccgagatcacgccattgcactccagcctgggggacaagagtgagactccatctcaaaaaaaaaaaaaaaaaaaaaaaaattggccatgttcatagctttggatcagagctactcaggaagaaggtaaagttggcttttatttgatctttggtaaacagcctatttgcaatacttgattttcatctcagtaatacatcctggaggcctagttacgtggtacattttgtaatctggtgagaagctctgcaacaaacccaagagcactgataagtggccactttaaccctgtaacctttcctgtacatgatggatagtactggaagcccagcaaggtgctagaatatgaaagcactagaaaaaatctgtcatccgtctaaacgtacatggaggtttatgctcaaaagaaaagagtatgtttccaaaaggcaagttcagagtgttcatgatagaactattgttagccaaaaactagacattattccaacacaaatagagagtagaattctttaataaacagtgggattttctggactattcatgatgtgaaataccattcagtgatgagaatgaaaaacctactgctatatccaataatatggatgaatctcacaaatattataatgagtaaaaaaagccaaatacgaaaaacaacaaaatgtagaattctatttgtacggagtttaaaaacagggaaagtgaatgttttattttaggagtcaggagagtcattatccctggcaaggaatgaggggtaataattagaaagcagcataacgagggctcccgaggtattggtaatgctctgttttgtaatctgaatgccagtcatacagatgttcacttaatgaagatacttattgtccacatacttttctgtatgtgtcatacttttaaaaaatgtatttaagcaatgaattcattcatccgtttattcactcatgtgttaattctcctgaagacgaacagagttctctattctagaactctaaaggtaagctaggcatgtaagaaagtcaaaggcatcatttcatgctgtgattccaccttctgaaaattcaaacatccttcttggaggcagaggaaggaaaaccaagcagatcacagagctggggactccatgagaattggaggtggtaaaaaagaacttttgtgcttattgaggttactttgcctggcctgtcctcccctcacctctgcctaatgaaatactaaccttcttcaagttccattcatgacgacttcttctcaaacaaaaattaccttgccttcttctaaatttttaggacatttgtctgtgctaatcatagtttattcccatgcattataataatttctagaaagcagtgtaatgttgtgtttaaaagcttgggctgcagagtcaagcagggttcaagaccttccatcacttgctgtgtgacctggagcaaattgcttaatcagtatgcatttttttctctgttgtaaaatgaaggtgataatagctggacctatctaataagctgttatggagatgaaaagagataatggatgtacagctgctggaaatcagtaaaatctcaggaaatgtttcctattatttttactgagtactatctactctagcagataataggttcctgaagaacatggaacatgactcagagaagttacagtgaataaactcattacagacatctcagattggcttgccttacatgtagtcatgttcttttttctcatacactagcttaaactcctctagaacaggacctacaacttattcattgtaatattcctcacacagcataacactgggttttaggttacatagatgggttataatctcattttattaatgagttgaagccactgaggaagtcttgccctttctcgtttagcgatgctcaaagcaaaccaaagataacttctataaactccccctatgaattctcttacttctagggtgaccaaccattctagttcatgaagggctgtcctggttttggcactgaaagttccgtgattccagaaacccctcagtcctagacaaaccagacctgttgatccccctacctgcctctgtgcccatatgctcaggctagcttgtttgtttgttcatttgtttgtttgtttgagatggagcctcactcttgttgctggagtgcaatggcacgatctcggctcactgcaacctccgcctcccaggttcaagtgattctcctgcctcagcctcctgagtagctgggattacaggcacctgccaacacgcccacctaatttttgtatttttagtagagacagggtttcaccatgttggccagactgctcttgaactcctgacctcaggcgatccacgcacctctgcctccctgggattacagtcgtgagccaccgtgcccggccacttgttgtttttattgatgaatcatccttgctcctatctaaagccaagtcttcattctggttggcattttctctacttattcaactactgggctcttgaaattctcctccctctttcctgcatcatcaatctttttccttctactgaaccacttccattagcatataaacacgctataatttttcctactaaaaaatgctttaagagacctggtatgttggctcacacctgtaatcccagctttgggatccctataatcccagcctgtaatccctcactttgggaggctgaggtgggcagatctcttgagctcaggagtttgagaccagcctaggcaacaaagtgagaccctgtctcaacaaaaaaaatagccagccatggtggctcatgcctatagtcccagctactcaggaggctgaggtcgggggatggcttgaacctgggaggcagaggttgcagtgagctgagatcatgccactgtactctagagtgagctacagagcctgaccaaaaaaaaaaaaaagccttaaaaattaaaaacatctgaacttgtttctagacacaggtaaaaaataataataatacaaaaattaaaacaacaacaaaatgtcccaagcctacatctccttcaacctaccaccccaattcttggctcccctttataacaaaactccttgaatgaattgtctatacacagtctccacttccaattccccttttctcattctttgttgaacgacttcaatcaggtttttattcccaactctccacagaaataggtcttgtcacaatttgccaatgatctggaattttcctaggctatggaattatgagaaataaactcctattgtaataaa

SEQ ID NO: 755 - DNA, 10936 bp, Homo sapiens; identical to SEQ ID NO: 754

SEQ ID NO: 756 - DNA, 10936 bp, Homo sapiens; identical to SEQ ID NO: 754

SEQ ID NO: 757 - DNA, 10936 bp, Homo sapiens; identical to SEQ ID NO: 754

SEQ ID NO: 758 - DNA, 10936 bp, Homo sapiens; identical to SEQ ID NO: 754

SEQ ID NO: 759 - DNA, 11030 bp, Homo sapiens
ctcaaggagaagtgtacaagctaaactggatcattctaattttcctgaacacttacaacctcgtaggaagacatacatacataagtaagtatgatacaaggaaaatttgtaagacaaagtaaataaaagtattataagaaacacagaagagggatagattactttaggctgagtgaggtggcttttgagttcctactagaagggtgtgtaggattgtgactagaagagagaggaaggtctggatggagcaacaagagtctgggctattaacacaggtttgagtcaggctgaccggagctgtaaagcccttctcgttctcactgtgtgttcttttcagttctgtcttcctgaggctgctgtttctgggcatggccaggggatcttcagactttacaaaccagttgtgcagagccaggcatttcaataaggaacaaaatgctgagtaacaacatgaagtcagagtgttgcttgccaagagctgggaggcctgggtggtttcccaatcttaaagaagcagaaggatattaaagtgagcctcccaaaggaaaacgtggatctacttaccaacgcagaaaatgatacacacggattcgatttaggcacgctacattcaaatgacttggaagagcaggttctctgagccaggatactaaagtccctgtttaggaaagagccacgttgtatgtttaccctaccacaaagatacagtcatgtgcctgggaaagattgatgccagctccagaaaggcatccgaatggtctaagtaatgccatccatctgtcagtaatagattcagaaatggaattctggaggaaagtggctctgggaattgaacagtggctcagtgatgttggggccaccaagtctgcaattctccctacctgttcttcatggttgtaagatgactgctgcaattctcggcatcatgtgcatgttaatgtcaggaggaagaaaggaagagggagcactgggatgttacattcattttgtcaggaaaagcaaagcctttccagacagctccgaaacttgcttacctctcattggccagcaccatcacttgaccacttgtccactcctagctgcaaggaaagtggcaaagtagaaggtatttgagaatgtctgctgggttagccaaaacaatagtgacttctacacccaattttctgggcactgcagaagtatccttgagtcctatgtgatcagagggagagcaaacctcaataatgaaacagattcaatttccatcacccagtgagacaccatgggattagaataaatttttaaaaaaacaaattgaaaaaaatgcatttttaaaacaacaaaatcagaaaggatgaaaggtgatatttctagcatatcagtttgtggtggtaaattaattaccttatacaaaggcctcagtgactttcttctccttacctaacgaatcatctttaaaataagtaaaataaagaaacaagagcagcagcagatgcttcctaaaaagaagttaccaaatctgttcaccacaaacctgagaattcaactgtggacatttggacaccagcaatgaacatgaaactcagcttatgaggcatatttggctaaaggtcaaggtgacttaaagttcatcataggacatctacaatttgcaaagcaggtgactggatatggactccttccaagtctcatttaattggataatgcctacgttttaagtatcagaagtgagtctttctctattaaatgaagtcagttccactaaaacctaaatcttgtttggcaggcactccatgtttcttaatttttattccatgctgtatattcttttagacttgattttcacttttttttcttttttcctgtacatttatctttgctgtgaaacaaagtgccctgctttgaaggacaggtttgtgggctgctggtggtgagacaacagcagtccttccaagtcttcctcccatcactctgttagctctccctttgtttttaattagcattacaccagttaattctgttatctcttaaccctggttctgcatcctcttcttcttttctattccttactccgctcctgttttttcttgttctgcttttccaagaaatgtcttgtctcctcatcagttgactgtcttctctttccagagggaccataaaggtgccagcctaaggaacacgtaaaacgtgggaacagacaaacaagctgctgcctattacagagatagataattaactttggaccattacatgcaattcatcagcttatctttttcaaactttatataagaagtcatttcccaatggtaaccacttgccagctgcaactttgacgcatattatcaggataggtgagattgatgggggccctttgaactcttcccagggaattatctttataatgttacagttttctctatagcatggtcatattgttaacattggttataaggtcatatggttagtatggttagtattggtggctcacagctgtaataccagcactttgggaggccaaggtgggaggatcacttgagccctggtgttcaaaaccagctctggaaacatagcaagaccttgtctctacaaaaaaaaattaaataaattaaaagattagctgggcatggtggcacatgcctgtagtcctcactacttgggaaactaaggtgggaggatcctttgagcttgggaggttgaggctgcagtgagctgtggttgtgccatggcactccagcctgggtgacagagtgagagcctgtctcaaaaaaaaaaaaaaaaaaaaaaaaaagtacctgtaaggtctttgggattttgaagatgaaaggtgttgcataaattgaatgaattcacttagagagatagaaggcaactacagggaatattacgtacatcatggagcggaaagcactaaggcctgtggaattattctcagtgacacgtcgttgagggcagtggtccacatgttttgaacatggtttctcccaggtgaaaaggatgagtaatttgttctccttcacatgtgtgtatgtaggtcttatacacagcagatttgccacaaaacaaatgaagattacactttgggcccctctctcacatgagccccttccaaagttctgtttgctaattttacattttgtaatttcttattatttttcttaaagaagcctcctccaattgcataaacttcaagcctcacaaaatttggatccatacctgagccaacatacaatacaattttccatttctaacttttagttgtacctagtgttttattggaaatgatcaagtacatgagtggtgtctttttaaaaaatttactttatttgcttctctagcttcatcgttagttaggcagttaaatctaaccatttggaggtattttcatataacctccattgaggacaatttggcaatagcttttaaaattataaatatatttgtacagttataagctgccatatctataaaactatttgatagacaaaagttgaaaaccctccaagagctcatcaataaaagattaaattaattatgatacatccatatgagcactgagcagctgtgaaaaaaatgaggaagtaattcctgtgctgatatgggaagacttccaagacatgttgttaagtacagaatggtgtatacagtatgctatatagtgtggtaaaaggtttagggataagcatttatatttataactgtttatatttacataaagtaattctgaaaggatacaaaaaagctaacaaaagagattacctgtggtagtgtggggcttggggattggatgggtgagaaacagtagtggaaatgagatattgtacagtttaaggcattatacacctataaaaacatgggaatgtattacctactcaaaaagtgaaattaagagagatacaagaaactgtttggatgttccttcccgtttcaatgtatctatattttttcagccctcaaagttattataaatgtcattataataacttcataaagcttcccctataatgagaatcttaccattctcctaactccaatagcactgtaatccacctctgttaggacacatcactcttcatcatgtgtgattattatttgcagatatcatcttcaaggctcttctctatttaccacctgccattcttgttctcacctctacatgaccttcacattttatttctctcggttttttggacaagctacattcccttccacagagaaggcttccctgacccctttcacttggttggattaccttgctattcttttctatctttgtacattccttttcaaaatacttatctcccttgttgttacctataatgtctgtcttctttactcaagagtctagacaaaaagctccacgccagcctcggctgtgtttgtattgtttacgtctgtgttcctagtgcttaataaaatacctagcaagggttaataagtacttgttgactggaagggaatgacttccttcccttactagagagtgatttccttacaggcgagatgtgtcaaccttctatagcccacataaaataaaggacaatatctcctattggataaaagacaagaatttacatatgagttttgtcatttaccataccagctctgggatcttaactttttagcctctctgggcttcagagctctcatctacattaagtttttcattcattctgtcattcaataaatatttatggaatgcttagcatgtgccactagtctagcaactgtggatactgaagtacgcaaggcagaatagtacttgctatctgaagcacacggtttaattggggtggggaaagagttggtggggagggtctcattaaacatataagccaaataaaccaaaattacaggtagagttaaggccatggcagagcaactgaaggtgatgaattcagagaggccaggaagggaccctctgaagcgatcatatctgaactgagtttttgagtcaactaaatgagatagtgtctgtgaatgtcttagaatcatgtctggcatgtaataagtgtcataaatgataagtattactatttataaaaacttgtcaaaaaatgaaccaaaaatacaagcagcttgtctttcacatataaaatactatagttgcaacatgtatatgtctttgtatagtgagaaagcatattgtatgtatattatatttcatttgagtaagttattttttaactgaaggaatctcctattttggttctgaaatagttaacgttccttttaagtagtctcatttataccttgagagtgatttaattacccacagcatctgtttaacattgtactcacagagaaatcacagaaacgtatgcaacattggttgttcctaagtagattcaatgttctctaaggtctcattaacctgtaagttctcacatgtttgttacatctgagctaatgaagaaatagccaggggtaaggaactgagaaagagactatggctgtctcaacacaaacccattccaggactgtaaaaaatatctgacaagtcatatcttcccagtgtggtagtaaaatcactggagtgtattggatggtataagcaactgaagaggattaagaatggcctctgtggctgggcacagaggttcacgcttgtaatctcagaacattgggaggcttaggtgggagaatcacttgaactcaggagtctgagaccagcttgggcaacataggaagacccccacctctacaaaaaaaaattaaaaattagctgggtctcgtggtgcacgtctgtggtcccagctactcaagaggctgaggtgggaggattgcttgggcccaggaggttgaggctgcagtgagccaagatcacaccactgcactcaagcctaggtgatggagcaataaccactctagaaaaaaaaaaagaaaaaagaaaggaaaaaaaaaaagaatggtctctttgccaggcatttctcctttagtccctaaaaaacataggcagtaggtagctgcctcaagttggattcttcagaagctgacccttagacgcaggagagagaagtgtaagatggggataaaagtctcttttccaggtaaagtctctgcctgggctggggtattctagggtaatgtgtaaattacacattgaagtttgtccttatttgaggttagagaattaggctttcaaactcctgcaccagtcactcactggctatgaccccaagcagctccagtagcccaagggcagttccccaaagacagccacagatatgggctgggcaagcaaatgacagaggggctttctgcacagaaatgatgaaggaggcccacagaatcagggcagagccctacccgtgctctacggcattcatatccccaatttacatgggagaaaatccgacactcagagaggtcaagtacttcattaaaggtaactgtttaaggggcagagcttggctacaaacccagacagatttgactccacagttcatgctcactcttctctaccaaatgtgcctccctttcctgaccatcagttatatattcaggaacatattctgtatttatataaatagacattattaacctagcttcctgaggcagaagattctatcaggaattgtagtgaaatattatatttggggatctctagaagagcactacctaaaatcaatgcaatgaaagctacctgtgtaatttaaaatttactagtgctctcaataaaaaggaaaataaataagagaaattaaattaaataatatattttattttacccaacatacccaaaatattatttcaacatataatcaatattttaaaatgtaaaattttttatacaatgtatttttgtgtcctttacacttgtagcatgtctcaatttggttgtgaaatatttatcaaaaacattgccaggtgtggtggcttatggctgtaatctcagcactttgggagggaggcagattacttgaggtcaggagttggagaccagcctggccaacatgaaacctcatctctattaaaaatacaaaaattagccaggcatggtggcacatgcctataatcccagctacttgggaggctgaggcaggagaatcacttgcaccagggaggcagtggttgcagcgagcagagatcttacccctgcactcaagcttgggcaaccgagcgagattccatctcaaaaaaaatacttgatgtgaatttagatttcatacgatttacagctgaaaaagtagattcacatagccaagttagtccaagaacacttaaaactttctataactgcatcaagtatcatttttaaaatttaaaaatattaaaattaaatttaaaaaaattagttcctcagtcgcactagtcatatttcaaatgctcaatagttttacaaggctggtggctaccacattgaagagtacagaaaattttccctatgaaaaggtacaaggatgtgattcagtataccatcaagaatcaaaccagtcaaccaataggtaaatattgagtgtctctcacgtgttgcatgtagtagatatagtggcagctaaaacacccttggccaggacaagttagctataaggactttgcaattggagttacatggaaggaataagaattggccattctccaggcacagtggctcacgcctgtaatctcagcactttcagaggccaaggtgggtggatcacctgaggtcaggagtttgagaccagcctgaccaacatggtgaaaccccgtctctactaaaaaaaaacacaaaaattagccaggcatggtggcgggtgcttttgtaatcccagctactcgggaggctgaggcaggagaatcacttgaagcagggaggtggaggttgcagtgagccgagatcacgccattgcactccagcctgggggacaagagtgagactccatctcaaaaaaaaaaaaaaaaaaaaaaaaattggccatgttcatagctttggatcagagctactcaggaagaaggtaaagttggcttttatttgatctttggtaaacagcctatttgcaatacttgattttcatctcagtaatacatcctggaggcctagttacgtggtacattttgtaatctggtgagaagctctgcaacaaacccaagagcactgataagtggccactttaaccctgtaacctttcctgtacatgatggatagtactggaagcccagcaaggtgctagaatatgaaagcactagaaaaaatctgtcatccgtctaaacgtacatggaggtttatgctcaaaagaaaagagtatgtttccaaaaggcaagttcagagtgttcatgatagaactattgttagccaaaaactagacattattccaacacaaatagagagtagaattctttaataaacagtgggattttctggactattcatgatgtgaaataccattcagtgatgagaatgaaaaacctactgctatatccaataatatggatgaatctcacaaatattataatgagtaaaaaaagccaaatacgaaaaacaacaaaatgtagaattctatttgtacggagtttaaaaacagggaaagtgaatgttttattttaggagtcaggagagtcattatccctggcaaggaatgaggggtaataattagaaagcagcataacgagggctcccgaggtattggtaatgctctgttttgtaatctgaatgccagtcatacagatgttcacttaatgaagatacttattgtccacatacttttctgtatgtgtcatacttttaaaaaatgtatttaagcaatgaattcattcatccgtttattcactcatgtgttaattctcctgaagacgaacagagttctctattctagaactctaaaggtaagctaggcatgtaagaaagtcaaaggcatcatttcatgctgtgattccaccttctgaaaattcaaacatccttcttggaggcagaggaaggaaaaccaagcagatcacagagctggggactccatgagaattggaggtggtaaaaaagaacttttgtgcttattgaggttactttgcctggcctgtcctcccctcacctctgcctaatgaaatactaaccttcttcaagttccattcatgacgacttcttctcaaacaaaaattaccttgccttcttctaaatttttaggacatttgtctgtgctaatcatagtttattcccatgcattataataatttctagaaagcagtgtaatgttgtgtttaaaagcttgggctgcagagtcaagcagggttcaagaccttccatcacttgctgtgtgacctggagcaaattgcttaatcagtatgcatttttttctctgttgtaaaatgaaggtgataatagctggacctatctaataagctgttatggagatgaaaagagataatggatgtacagctgctggaaatcagtaaaatctcaggaaatgtttcctattatttttactgagtactatctactctagcagataataggttcctgaagaacatggaacatgactcagagaagttacagtgaataaactcattacagacatctcagattggcttgccttacatgtagtcatgttcttttttctcatacactagcttaaactcctctagaacaggacctacaacttattcattgtaatattcctcacacagcataacactgggttttaggttacatagatgggttataatctcattttattaatgagttgaagccactgaggaagtcttgccctttctcgtttagcgatgctcaaagcaaaccaaagataacttctataaactccccctatgaattctcttacttctagggtgaccaaccattctagttcatgaagggctgtcctggttttggcactgaaagttccgtgattccagaaacccctcagtcctagacaaaccagacctgttgatccccctacctgcctctgtgcccatatgctcaggctagcttgtttgtttgttcatttgtttgtttgtttgagatggagcctcactcttgttgctggagtgcaatggcacgatctcggctcactgcaacctccgcctcccaggttcaagtgattctcctgcctcagcctcctgagtagctgggattacaggcacctgccaacacgcccacctaatttttgtatttttagtagagacagggtttcaccatgttggccagactgctcttgaactcctgacctcaggcgatccacgcacctctgcctccctgggattacagtcgtgagccaccgtgcccggccacttgttgtttttattgatgaatcatccttgctcctatctaaagccaagtcttcattctggttggcattttctctacttattcaactactgggctcttgaaattctcctccctctttcctgcatcatcaatctttttccttctactgaaccacttccattagcatataaacacgctataatttttcctactaaaaaatgctttaagagacctggtatgttggctcacacctgtaatcccagctttgggatccctataatcccagcctgtaatccctcactttgggaggctgaggtgggcagatctcttgagctcaggagtttgagaccagcctaggcaacaaagtgagaccctgtctcaacaaaaaaaatagccagccatggtggctcatgcctatagtcccagctactcaggaggctgaggtcgggggatggcttgaacctgggaggcagaggttgcagtgagctgagatcatgccactgtactctagagtgagctacagagcctgaccaaaaaaaaaaaaaagccttaaaaattaaaaacatctgaacttgtttctagacacaggtaaaaaataataataatacaaaaattaaaacaacaacaaaatgtcccaagcctacatctccttcaacctaccaccccaattcttggctcccctttataacaaaactccttgaatgaattgtctatacacagtctccacttccaattccccttttctcattctttgttgaacgacttcaatcaggtttttattcccaactctccacagaaataggtcttgtcacaatttgccaatgatctggaattttcctaggctatggaattatgagaaataaactcctattgtaataaa

SEQ ID NO: 760 - DNA, 11030 bp, Homo sapiens; identical to SEQ ID NO: 759

SEQ ID NO: 761 - DNA, 11030 bp, Homo sapiens; identical to SEQ ID NO: 759

SEQ ID NO: 762 - DNA, 7755 bp, Homo sapiens
cagagcccctggaactctggcccaaggctctctgactccttcccagatcctctcggcttagcggctgaagactgacaccgcccgatcgcctcgaaagccccctagaccatcacggacgccgagcttcaggtaactctcacggtggaaagtaagcccatccccttcttaatcaatacggaggctacccactccacattaccttcttttcaagggcctgtttccctcgcctccataactgttgtgggtattgacggccaggcttctaaacctcttaaaactccccaactctggtgccaacttagacaatactcttttaagcactccttttagttatccccacctgcccagttcccttattaggctgagacactttaactaaattatctgcttccctgactattcctggactacagctgtatctcattgcctcccttcttcccaatccaaagcctcctttgcatcctcctcttgtatccccccaccttaacccacaagtataagatacctctattccctccttggcgaccaatcatgcaccccttaccatctcattaaaaccaaatcacctttaccccactcaacgccaatatcccatcccgcagcaagctttaaaaagattaaagcctgttatcactcgcctgctacagcatggcctttcaaagcctataaactctccttacaattcccccattttatctgtcctaaaaccagacaagccttacaagttagtttaggatctatgccttatcaaccaaattgttttgcctatccaccccatggtgccaaacccatatactctcctatcctcaatacctgcctctacaacccattatcctgttctatatctcaaacatgctttctttactattcctttgcacccttaatcccagcctctcttcgctttcacttggactgaccctgacacccatcaagctcagcaaattacctaggctgtactgccacaaagcttcacagacagcccccattacttcaatcaagcccaaatttcttcctcatctgttacctatctcggcataattatcataaaaacacatgtgctctccctgccaatcgtgtccaactgatctctcaaacccaagcaccttctacaaaacaacaactcctttgcttcctaggcatggttagcgcggtcagaattcttacacaagagccaggaccgcaccctgtagcctttctgtccagacaacttgaccttactgttttagcctagccctcatgtatgcatgcagcggctgccgctgctttaatacttttagaggccctcaaaatcacaaactacgctcaactcactctctacagttctcataacttccaaaatctattttctgcctcatacctgatgcatatactttctgctccccggcttcttcagctgtactcactctttgttgagtctcccacaattaccgttgttcctggcccagacttcaatccggcctcccacattattcctgataccacacctgacccccatgactgtatctctctgatccacctgacattcaccccatttccccaaatttccttctttcctgttcctcaccctgatcacgcttgatttattgatggtggttccaccaggcctaatcaccacacaccagcaaaggcaggttatactatagtacaagccactagcccgcctcttagaacctctcatttcctttccatcgtggaaatctatcctcaaggaaatcacttctcagtgttcctcaaggaaataacttcttatatgatgcagcatattcattaaacaagtggtttcccatgcttgggaaaccatatgtccaagattcaagggctggaggtgagaatggactttattataccaaatatttgttttggggaatgttttcttcccatccatgcaatcttggattctgtgggtttatagtaacagaaggagaaacgaatccctaagggaatacaataatagttccattgaattagaaactgagattgcccactggccatttcaggctgatgaagcaaagacagagaagagcttattgcatgtactggctgggtgattgatcctgattaccaaggagaaacaaatgtgcagtgggggtgaggaggattatttatggaaccccagtggggtttgtggctacttaggactttattaccccacggcccttggcaatagaaaattgtggcagtgtagtaaagataggaccaccaaatggctcagctcctgtaggactaaagtttgactcaggcaatcaggttaaaaatccattcaaccaagatactttcatagaataaggaaacatgaaatgggcattggaagaaagatgctgtggttaacaacttagacatactaaccagttacagaagcagagattttaacagctatggcctctgatcattgtttcttatccccatgtttcctcccactccttttatgaagagcactgctgatggctaacatttttaggttgcaagtgttctggccttgaagatatggtaactggttgggaacacaaagttgtcacctaggcaaaggatgagagtggatgtcaagaagcaaggctatgctggatcctttctgctgttctaccagatccatcctccaccgtcatctatcattgtctgtgtggatcttgatcaacggactttgcctctggctcctgattgggtttgcccaatgggaagcagaagagagtgaagttgtggctccttcttttcacagagctgcaggtttcttgaacttttcatcttgcaaaactgactctatacccactggtcaagtgatcttcaacaagggcactgagactataaagtggggaaagaatattttcttcaacaaatggtattgagaaaactgaatatctatgtacaaaagaatgaagttggactcttacattataccatattttaaaatgaagtcaaaatgggattaaagatctgaaactttaaaactcctaaaataatagggaagaatctttacaaagctgaatttggcaatgatttattggctatgacaccaaaagcacaagcaatgaaagcaaaaatagacaaatggaactacatcaaactaaaaagcttctgcacagcaaagaaagcaatcaacagagtgaaaagacaatttatggaataggataaaatatttgcaaatcatatatctgggaaggagtcaatatcaagaatatatgaagaacacctgtaacttaacaacaaaaataacccaacttaaaaaattggcaaaggacttatatacatatttctccatagaagatatacaaatgcccaaaaagcatatgaaaaggtgttcaacatcactaattatttagaaaacgcatgtcaaagccacagtgagatatcactttatacctattagcatggctgctatttaaaaaacaaaaacaacaacaaaaacaaacaaaaaaaaaacaaaaacagaaaataacaagggctggcaagaatgtggagaaattggaacccctgtgcactgttagtggtgatgcaaaatggttcaatccccatgaaaatatatctctggactctattctggtccactggtctgtatgtctgtctttacatcaataccatactgttttgattgcagtagctttggaatatgttttgtaatcaggaagtgtgaggattctggttttctcatttctcttaggattgttttgactatatggcttcttttgagatttcatatgaatttgagaattttttatttttaaaaattccattgaaatttcatagggatggcatcgaatctgtagattactttacatagtttgcatattttaataatattaagtcttgcaatctgtgaaaataggatgttttttcattgatttgtgtcttctttaatttctttcagcaatgtggtgtagtttttagtgtataagtctttcacctctttgcataagtttattcctaagtattatatatttttgatgctataataaatgaatttttttcttaattatcttttaaggttgttcattgttaatgtatagaaatgcaactgatttttgtgtgttgattttgtatcttgcaactttgctgaattcatttattagcttaaacagctttttttgtggagttcttacaggtctctacaaatatggtcagaggcgttcgaactagagtgactccatcttgaatagggggtgggtaaaataagactgagacctactgggctgtgttcccaggagattaagcattcttagtcacaggatgagaaaggaggtcagcacaagatacaagttacaaagaccttgctgataaaacaggatgaggtaaagaagctggccaaaactcaccaaaaccaagatgatgatgaacgtgacctctaaacgtcctcactgctcattatatgccaattataatgtattagcatattaaaaggcactcccaccagcgccatgacagttcacaaatgccatggcaatgactggaagttaccctctatagtttaaaaacaggagggaccctcagttctgagaaatctctgtccctttcccagaaaactcacgaataatccaccccttgtttagcataaaatcaagaaataactataaatatatccagttgagcaacccatactgctgctctgcctatggagtagccattcttttgtttctttaggtttttaataaacttactttcactttactctttgaactcgccccaaattctttcttgtgcaaggtccaagaaccctttcctgggttctggatcaggatccttttccagtaacaatgtcatctgcgaacagataattttatttcttccttttcaatttagataccttgtatttctttttctttcctaattgtttttgcctaattgctaggactgccagtactatgttgaatagaagtggagagagtggacattcttgccttgttcctgatctcttatatgaaaagctttcagtctttcattattgagtatgatgctagctgtgggcttttcatatatggcctttattttgttgaggtaaagtatctctatttctagtttgttgagtgtttttataataaaaaggcattaaaattttgtcaaatgctttttgtgtcaattgagatgattatgtaatttttatcctttcttctgttaatgtggtttattacactgattggtttttatatgttgaataacccttgcctcttagagataaaacccacttagtcatggtgtgtaatccttttaaggtacatttgaactctgctagaattttattcagaatttttgcattaatatttatcatggatattgaacctcatagtattcttttctcatagcagattgatctggctttgctatcaggttaattttgggctcagagaataagattgggttttgcctcctctttaattttctggaagagcttgagaaggattggtgttaacctttctttaaatatttggtagaattttccaatgaaaccatctggtccttgtcttttcttttctgggaggtttttgattactgattcagtctccttactggttataggtttgttcagactttttatttcatgattaaatcttggtagatggcatttttctagtaatttatccatttttttctaggatatccacttggtataaaataaaatatttcctgtcatatgcaaaacaactttcatttcattcttgagtggtgcttacttctgatcacaattgtgtataacagagatgtccaatcttttagcttccctgggccacactgaaagaagagttgtcttgggccacacataaaacacactaacactaatgatagctgatgagctaaaaaaaaaaaaaatcacaaaaaaaatctcataatgttttaagaaagtttacgaatttgtgttgagccacattctaagccgtcctgggtcacatacagcctgcaggccacaggttgaacaagcttggtgtataaccaagtgcactcttagaaaaatttgaacattttaaaaccaaactgcctaatgaaaacccctattattcaagaagtgtctatataatatttaattttttctaatttagcatagaccatcagttaaaattaagagaaacacaagtataactatcaaacacacccatgaaaaaaatctcagagtaataatttgatttttgtttgactattttgtctgtttgcaaagtaatgtgatagattttcagtaatttattgagtcactttctcagtcatcaagttgttattgcatttatcagactaagaagtcacttcttaaaggcagttgtaattacattgtagatgcaaaataaaatagagaacaactctatcaatccccttcatacttccttcctctcaagagtaaggctccatttctttcagaatatcctttaaaaactaattgaatagaaatccatctccttcctagcatcagggattgagaatgggtaccacacatacttgaaaaaaagtgctgtaaaacgtttgcatttcaagacaaaaaactaaccgctggctgacacacctgagcaaaaggcaactctgccttccctgtagtaaatgtaatttaatataggtcattagctaagagaaaagcagcaatttgaattttcaaagtttgattctcagggtcctctacttaagaatcacctgggctgcccattaatggaaagggcagggagggtcccatgaatttgcatttccatgggaagccagagttatttttttcctttgcagaatctcaataagctctggagaattagatggacaggaaagattgattcttttgattatttgtgagaattattggcagctccttaagtggcagtaacatagagtaaattcctacctcaaaaatatcttaatagatttttaggttcagacctataaattattagatatattagtttttagatttcatatttcagttatgttggattctactaactcatcaattcatggcattaattcatggtatttccagagttctctaaagtcttttcatatcatactcactttctatatttcaatatgccccaggagggcaggaatctttttgtttgttcacagatgcataacaactacctaaaacaattcctggctcatagtgttacagtttggattcaccgctggtaactcagatacctgccattggtaacaatggcaagtgttcaacaaatatttgttgaatgaatgaataaatgtcagattaaatgtcagtttctcattttgttgaagccgtaactgtgcgcacaaagattcagaagggattcttaggatttgaacaaggccagtggcttttgattcaaggtactaaggtttcatgcacatccgtgtgaagagaccaccaaacaggctttgtgtgagcaataaagcttttaatcacctgggtgcaggtgggctgagtccgaaaagagagtcagtgaagggagataggggtggggccgttttacaggatttgggtaggtaaaggaaaattacagtcaaaggggggttgttctctggcgggcaggagtgggggtcgcaaggtgctcagtggcggtgttttcgagccaggatgagccaggaaaaggactttcacaggtaatgtcatcacttaaggcaaggaccggccatttacacttcttttgtggtggaatgtcatcagttaaggtggggcagggcatattcacttcttttgtgattcttcagttacttcaggccatctgggcgtataggtgcaagtcacaggggatgcgatggcttggcttgggctcagaggcctgacattcctgccttcttatattaataagaaaaataaaacaaaat

SEQ ID NO: 763 - DNA, 8076 bp, Homo sapiens
ttttcctccttctctcctttcttctatgactagttgttccatttcctgtctccttatcttctttccttcccaagacttttagaagaacagttaatttttcgttgatgcccttaccaatctgcacaagcaaatttaagtagaaacatctgtacatcccttatgtcaggcctctgagcccaagccaagccatcgcgtcccctgtgacttgcacgtatacacgcccagatggcctgaagtaactaaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaagcactcccactgagcaccttgcgacccccactcctacccgccagagaacaaccccctttgactgtaattttcctttacctacccaaatcctataaaacggccccacccctatctcccttcactgactctcttttcggactcagcccacctgcacccaggtgattaaaagctttattgctcacacaaagcctgtttggtggtctcttcacacagacgcgcatgaaatttggtgccgtgacttggatcgggggacctcccttgggagctcaatcccctgtcctcctgttctttgctcggtgagaaagatccacctacgacctcaggtcctcagactgaccagcccaaggaacatctcaccaattttaaatcaggtaagcagcctcttcttactctcttctccaacctctctcactgtccctcaaccactttctcctttccactcttcactctcccttctcttaatttcaattcctttcattttctgggagagacaaaggagacatgttttatccgtggaccgaaaactccggcgccggtcacggactgggaaggcagccttcccttggtgtttaatcaatgcagggacgcctctctgattattcacccacatttcaaaggtgtcagaccacgcagggacgcctgccttggtccttcacccttagcggcaagtcccacttttctgggaaaggggcaagtaccccaaccccttctctccttgtctctaccccttctctgcttttctgggggaggggcaagtacccctcaaccccttctccttcacccttagcagcaagtcccgcttttctggcggaggggcaagtaccacaacctcatatctctgcgccccaatcccttatttccgtgccccaacctcttatatctctgcacctcaaccccttatttctgtgccccaaccccttatttccatgcctcgaccccttatttctgcgccccatcccttatttccatgccctgacctcttatctctgtgccccaaccccttttcccacttttctggaaagtaagaacccccaaaccccttccctctgtttctctactctctcttttctctaggcttgcttccttcactataggcaagcttccaccctccattcctccttctactcccttggcctgtgttctcaaaaacttaaaacctcttcaactcatacctgacctaaaacctaaatgccttattttcttctgcaatgccgcttgaccccaatacaaactcaacagtagttccaaatagccagaaaatggcactttgaatttttccatcctgcaagatctaaataattcttgtcgtaaaataggcaaatggtctgaggtgcctgacgtccaggcattcttttacacatcagccccttcctagtctctgtgcccagtgcaactcgtcccaaatcttccttctttccctcccgcctgtcccctcagtatcaacccgaagcgtcgctgagtctttctaatcttccttttctacagacccatctgacctctcccttcctccccaggctgctcctcaccaggccgagctagatcccaattcttcctcaggctctgctcctccaccctataatccttttatcgcctcccctcctcacacctggtctggcttacagtttcgttccgtgactagccctccccctcctgcccagcaatttactcttaaaaaggtggctggagctaaaggcatagtcaaggttaatgctcctttttcttcatcccaaatcagaagcgtttaggctctttttcatcaaatataaaaatccagcccagttcatgacttgtttggcagcaaccctgagacgctttacagccctagaccctaaaaggtcaaaaggccgtcttattctcaaaatacattttattacccaatctgctcccaacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcggccaggcgttcctccagaacctcctcccacaggagcttgctacatgtgccggaaatctggccactgggccaaggaatgcccgaagcccgggattcctcctaagctgcgtcccatctgtgtgggaccccactgaaaatcggactgttcaactcacctggcagccactcccagagcccctggaactctggcccaaggctctctgactccttcccagatcctctcggcttagcggctgaagactgacaccgcccgatcgcctcgaaagccccctagaccatcacggacgccgagcttcagagcactgctgatggctaacatttttaggttgcaagtgttctggccttgaagatatggtaactggttgggaacacaaagttgtcacctaggcaaaggatgagagtggatgtcaagaagcaaggctatgctggatcctttctgctgttctaccagatccatcctccaccgtcatctatcattgtctgtgtggatcttgatcaacggactttgcctctggctcctgattgggtttgcccaatgggaagcagaagagagtgaagttgtggctccttcttttcacagagctgcaggtttcttgaacttttcatcttgcaaaactgactctatacccactggtcaagtgatcttcaacaagggcactgagactataaagtggggaaagaatattttcttcaacaaatggtattgagaaaactgaatatctatgtacaaaagaatgaagttggactcttacattataccatattttaaaatgaagtcaaaatgggattaaagatctgaaactttaaaactcctaaaataatagggaagaatctttacaaagctgaatttggcaatgatttattggctatgacaccaaaagcacaagcaatgaaagcaaaaatagacaaatggaactacatcaaactaaaaagcttctgcacagcaaagaaagcaatcaacagagtgaaaagacaatttatggaataggataaaatatttgcaaatcatatatctgggaaggagtcaatatcaagaatatatgaagaacacctgtaacttaacaacaaaaataacccaacttaaaaaattggcaaaggacttatatacatatttctccatagaagatatacaaatgcccaaaaagcatatgaaaaggtgttcaacatcactaattatttagaaaacgcatgtcaaagccacagtgagatatcactttatacctattagcatggctgctatttaaaaaacaaaaacaacaacaaaaacaaacaaaaaaaaaacaaaaacagaaaataacaagggctggcaagaatgtggagaaattggaacccctgtgcactgttagtggtgatgcaaaatggttcaatccccatgaaaatatatctctggactctattctggtccactggtctgtatgtctgtctttacatcaataccatactgttttgattgcagtagctttggaatatgttttgtaatcaggaagtgtgaggattctggttttctcatttctcttaggattgttttgactatatggcttcttttgagatttcatatgaatttgagaattttttatttttaaaaattccattgaaatttcatagggatggcatcgaatctgtagattactttacatagtttgcatattttaataatattaagtcttgcaatctgtgaaaataggatgttttttcattgatttgtgtcttctttaatttctttcagcaatgtggtgtagtttttagtgtataagtctttcacctctttgcataagtttattcctaagtattatatatttttgatgctataataaatgaatttttttcttaattatcttttaaggttgttcattgttaatgtatagaaatgcaactgatttttgtgtgttgattttgtatcttgcaactttgctgaattcatttattagcttaaacagctttttttgtggagttcttacaggtctctacaaatatggtcagaggcgttcgaactagagtgactccatcttgaatagggggtgggtaaaataagactgagacctactgggctgtgttcccaggagattaagcattcttagtcacaggatgagaaaggaggtcagcacaagatacaagttacaaagaccttgctgataaaacaggatgaggtaaagaagctggccaaaactcaccaaaaccaagatgatgatgaacgtgacctctaaacgtcctcactgctcattatatgccaattataatgtattagcatattaaaaggcactcccaccagcgccatgacagttcacaaatgccatggcaatgactggaagttaccctctatagtttaaaaacaggagggaccctcagttctgagaaatctctgtccctttcccagaaaactcacgaataatccaccccttgtttagcataaaatcaagaaataactataaatatatccagttgagcaacccatactgctgctctgcctatggagtagccattcttttgtttctttaggtttttaataaacttactttcactttactctttgaactcgccccaaattctttcttgtgcaaggtccaagaaccctttcctgggttctggatcaggatccttttccagtaacaatgtcatctgcgaacagataattttatttcttccttttcaatttagataccttgtatttctttttctttcctaattgtttttgcctaattgctaggactgccagtactatgttgaatagaagtggagagagtggacattcttgccttgttcctgatctcttatatgaaaagctttcagtctttcattattgagtatgatgctagctgtgggcttttcatatatggcctttattttgttgaggtaaagtatctctatttctagtttgttgagtgtttttataataaaaaggcattaaaattttgtcaaatgctttttgtgtcaattgagatgattatgtaatttttatcctttcttctgttaatgtggtttattacactgattggtttttatatgttgaataacccttgcctcttagagataaaacccacttagtcatggtgtgtaatccttttaaggtacatttgaactctgctagaattttattcagaatttttgcattaatatttatcatggatattgaacctcatagtattcttttctcatagcagattgatctggctttgctatcaggttaattttgggctcagagaataagattgggttttgcctcctctttaattttctggaagagcttgagaaggattggtgttaacctttctttaaatatttggtagaattttccaatgaaaccatctggtccttgtcttttcttttctgggaggtttttgattactgattcagtctccttactggttataggtttgttcagactttttatttcatgattaaatcttggtagatggcatttttctagtaatttatccatttttttctaggatatccacttggtataaaataaaatatttcctgtcatatgcaaaacaactttcatttcattcttgagtggtgcttacttctgatcacaattgtgtataacagagatgtccaatcttttagcttccctgggccacactgaaagaagagttgtcttgggccacacataaaacacactaacactaatgatagctgatgagctaaaaaaaaaaaaaatcacaaaaaaaatctcataatgttttaagaaagtttacgaatttgtgttgagccacattctaagccgtcctgggtcacatacagcctgcaggccacaggttgaacaagcttggtgtataaccaagtgcactcttagaaaaatttgaacattttaaaaccaaactgcctaatgaaaacccctattattcaagaagtgtctatataatatttaattttttctaatttagcatagaccatcagttaaaattaagagaaacacaagtataactatcaaacacacccatgaaaaaaatctcagagtaataatttgatttttgtttgactattttgtctgtttgcaaagtaatgtgatagattttcagtaatttattgagtcactttctcagtcatcaagttgttattgcatttatcagactaagaagtcacttcttaaaggcagttgtaattacattgtagatgcaaaataaaatagagaacaactctatcaatccccttcatacttccttcctctcaagagtaaggctccatttctttcagaatatcctttaaaaactaattgaatagaaatccatctccttcctagcatcagggattgagaatgggtaccacacatacttgaaaaaaagtgctgtaaaacgtttgcatttcaagacaaaaaactaaccgctggctgacacacctgagcaaaaggcaactctgccttccctgtagtaaatgtaatttaatataggtcattagctaagagaaaagcagcaatttgaattttcaaagtttgattctcagggtcctctacttaagaatcacctgggctgcccattaatggaaagggcagggagggtcccatgaatttgcatttccatgggaagccagagttatttttttcctttgcagaatctcaataagctctggagaattagatggacaggaaagattgattcttttgattatttgtgagaattattggcagctccttaagtggcagtaacatagagtaaattcctacctcaaaaatatcttaatagatttttaggttcagacctataaattattagatatattagtttttagatttcatatttcagttatgttggattctactaactcatcaattcatggcattaattcatggtatttccagagttctctaaagtcttttcatatcatactcactttctatatttcaatatgccccaggagggcaggaatctttttgtttgttcacagatgcataacaactacctaaaacaattcctggctcatagtgttacagtttggattcaccgctggtaactcagatacctgccattggtaacaatggcaagtgttcaacaaatatttgttgaatgaatgaataaatgtcagattaaatgtcagtttctcattttgttgaagccgtaactgtgcgcacaaagattcagaagggattcttaggatttgaacaaggccagtggcttttgattcaaggtactaaggtttcatgcacatccgtgtgaagagaccaccaaacaggctttgtgtgagcaataaagcttttaatcacctgggtgcaggtgggctgagtccgaaaagagagtcagtgaagggagataggggtggggccgttttacaggatttgggtaggtaaaggaaaattacagtcaaaggggggttgttctctggcgggcaggagtgggggtcgcaaggtgctcagtggcggtgttttcgagccaggatgagccaggaaaaggactttcacaggtaatgtcatcacttaaggcaaggaccggccatttacacttcttttgtggtggaatgtcatcagttaaggtggggcagggcatattcacttcttttgtgattcttcagttacttcaggccatctgggcgtataggtgcaagtcacaggggatgcgatggcttggcttgggctcagaggcctgacattcctgccttcttatattaataagaaaaataaaacaaaat

SEQ ID NO: 764 - DNA, 3527 bp, Homo sapiens
tttcaatctgatacccaaccaacgtaatttttagtgtcgaggattcaaggtcaaattgtgttaggttttaagaaccaggtgagactttttgatccctaatagagcacttcctttgagaaaaaatgagataaattcgaacaatatcaattaactggttggaattatgataagctgacaaatcttgttcagagttgacacttgccagctaatgattctaatgttgttagaatccacacagtattacctgttattgataatactaattttttgtttgagtccatcttaaggaactcaagacacgaggcaatttaagtgccctggaaccccacccaagggttcattgctcatatcctattatctcaccaacatcatctgcaattttttttcatttaaatctttgacttctcttcggtgttggtaggcatagttttgctgagctcaagagaagaatgcctgtgatcatatccactttgagtgattatacatgcttgaaatctagggatccatttccaaaaaatgtagggcttttattggtttgtgcaaatcaacacactgatacatgtccaaaaggagtctccaaaacataatcgattttcatccctgtttgccatttccagatatgaaattaggtgcttaaagagaagcattaattccctgtagctactcagttaccagtctgtgcttcagttgctggagttttctaagcacaaaatctgctaccagggagtaacaccattaattgggggggcatctcattcaataataatatttgtaaaacagagcagtcatggaaatatgcaactttcaattagtggttttaatttgtgatttatctgaatatactagtataaataaaatgtattatgtgtgcctatatatgtggataagctatttacatttttatgtgtagaaaatgaaaaatatatattgattagcccttttgaggcttttgaacaactgtttcatcttccttctttcctgcaactgctttgaggatttagataattcatacaaggtatgacaaattctgttactgaatacatgtgcacacttttgttggctttattcatgtatgtacatatgcctgcctgaatacagaaattggcctttaaatgggatacgacaagttattttttttacacataaaaatagaaaactgatcactcagactgtacacactcacagaatgtattgacataccacgaccagctacagtattatgcacgacatattgttcacacattagtacagcagagatacacacatttagaaaattagtaattgctagtatatatttttcttattttcaggctgtgttgacctttttcaaccttaataaaaggtatctccaggggcccttaaaacaagaattagtctttcctctcctctagggattggggagtatgactataatactgcaatctcctgatataccagcatcattttaagacacgatggaaaacattaggaaaaataagttacgtaaagatgtgatctaaaataaatgttaaggaatctcaactaaaatcatcaaggatgccaattaacatgagtaagccctttctactcattttatatagtttgctctacacacagcctttacatgttattaaaagcaatgatatgaatcagaaaaaaaactgtttaactgctcaagagtttttctaaagagagacaatttttaaagcaacaaagaacaatactagcagcaatgtcaaaaagcaagctataattttcaccccagaaataaatgaatgacatctccatagttaagagatcaagaaagctgttagcaattctctcccatttaattctttctaacatcattaaatcactggggtatctcatcataattatcaccatgcaggttgatcatcaatatccttttctaaagtgtaaaatatgtgatttttattcctactattttgcagccaattaattttgagcttgaatccagaaagatacttgatgaagagttagcatttagaagtgcccatctggagcatcgttttctgtaaggcatcatttgaagcctctttggatacaagatctcatgttttagtgattttacatccgggagcccattttttcacagctaaagctggtaatcctctgggcagagttaactgaattgctttctacatgctagtgtccagaaagagtaattaccataagtttaaagtctccatttcaacaaaacttctggttgcagctgtcttgagttttaagccagcaagactttgagtggctcctcttccctctgggctcacataaaaacatagatgccaactgtatcctgactaatgctcattagtgctgtacctctttatgaagcttctaaacaagtttttccaggaagaaagcagaaactatgcctttgcttattttatcctgtgggttacagtcagtcttcataaagcaaaccatcattatataatggtgtgcccataatagatgcatttgctggtataactgcctctttttggcacattattgcttggctttaatttcatattcaacagtctttattctcattattagtatctgagatatttgtgtcttaaaaaaacttgcaaataacatcttgttgcaccattctggccaccacaagtcatttcaccaaggtccaaggttatttgaatgttgtttataattatcatcacgtttacttacctaacagccaaaaataatgtttcaggattgtttgttgctgctatctacacatatatacagatgcactggatttattttgagagaggttattttgttgtggcaagtgagtagtttagctggtgactgttcacagttaaaagtagctgtaatgacctctggcagatgtcactgatcacttgggagacagaatttttccacttcaatccatcttcatttatgtccttggtcattgcaaacccagcttatttgatttctgcagccaaggagaattgttttctttccaagagtaggataaagttcatggaaatctgtttcagtatttacaagactattttttttcccatttgcaaaaatgtctaaaattttgtagacatccttaagcccatgtgtctggacagatgacatttgtaattgctcagccagttgaagaatttcattaagaaggatatcgttacaaggatggacaggagattcagcatatcctctgttatttgccaggtggcagcagctgacccgaatttggagagaatcaaccaaaaagggccacgcacaacatcaggaagcattgctaacagaaaacaaaatgctcagatacatatgtaaaataacaaacactaaaggggatgtttgacttctgatttcaccatgtacacaaaaacagagtgggaataaggtagtcggctcacttatgcaagatactgctgagttcactgttctaccacaaagggaaattcacaggcctcacttctcaaacaccacttagaacaaagcaggagagagtaaacagcatcatctccatggcagcattacagataattagtaaatcaggcaggtagaggtctacacaaggctac

SEQ ID NO: 765 - DNA, 3527 bp, Homo sapiens; identical to SEQ ID NO: 764

SEQ ID NO: 766 - DNA, 3652 bp, Homo sapiens
ccacgcccagcctccatgcatattttcaatctgatacccaaccaacgtaatttttagtgtcgaggattcaaggtcaaattgtgttaggttttaagaaccaggtgagactttttgatccctaatagagcacttcctttgagaaaaaatgagataaattcgaacaatatcaattaactggttggaattatgataagctgacaaatcttgttcagagttgacacttgccagctaatgattctaatgttgttagaatccacacagtattacctgttattgataatactaattttttgtttgagtccatcttaaggaactcaagacacgaggcaatttaagtgccctggaaccccacccaagggttcattgctcatatcctattatctcaccaacatcatctgcaattttttttcatttaaatctttgacttctcttcggtgttggtaggcatagttttgctgagctcaagagaagaatgcctgtgatcatatccactttgagtgattatacatgcttgaaatctagggatccatttccaaaaaatgtagggcttttattggtttgtgcaaatcaacacactgatacatgtccaaaaggagtctccaaaacataatcgattttcatccctgtttgccatttccagatatgaaattaggtgcttaaagagaagcattaattccctgtagctactcagttaccagtctgtgcttcagttgctggagttttctaagcacaaaatctgctaccagggagtaacaccattaattgggggggcatctcattcaataataatatttgtaaaacagagcagtcatggaaatatgcaactttcaattagtggttttaatttgtgatttatctgaatatactagtataaataaaatgtattatgtgtgcctatatatgtggataagctatttacatttttatgtgtagaaaatgaaaaatatatattgattagcccttttgaggcttttgaacaactgtttcatcttccttctttcctgcaactgctttgaggatttagataattcatacaaggtatgtacacaatcacacccatagtatgtacatcctagtcacacacttaacacggagaggatgtgtgaggaatgtaaattatcccagtggtcaaagaactgaccttacctgtgactaatggcatggttacttagccctggcatatttaataatatgccaatgtactgattactatattcagcctttgtgataattatgttacctactcaaggagatgataaaaaaaaaacacaaatcaaacagccctttctgaccttcaaaaataaaaggacaaattctgttactgaatacatgtgcacacttttgttggctttattcatgtatgtacatatgcctgcctgaatacagaaattggcctttaaatgggatacgacaagttattttttttacacataaaaatagaaaactgatcactcagactgtacacactcacagaatgtattgacataccacgaccagctacagtattatgcacgacatattgttcacacattagtacagcagagatacacacatttagaaaattagtaattgctagtatatatttttcttattttcaggctgtgttgacctttttcaaccttaataaaaggtatctccaggggcccttaaaacaagaattagtctttcctctcctctagggattggggagtatgactataatactgcaatctcctgatataccagcatcattttaagacacgatggaaaacattaggaaaaataagttacgtaaagatgtgatctaaaataaatgttaaggaatctcaactaaaatcatcaaggatgccaattaacatgagtaagccctttctactcattttatatagtttgctctacacacagcctttacatgttattaaaagcaatgatatgaatcagaaaaaaaactgtttaactgctcaagagtttttctaaagagagacaatttttaaagcaacaaagaacaatactagcagcaatgtcaaaaagcaagctataattttcaccccagaaataaatgaatgacatctccatagttaagagatcaagaaagctgttagcaattctctcccatttaattctttctaacatcattaaatcactggggtatctcatcataattatcaccatgcaggttgatcatcaatatccttttctaaagtgtaaaatatgtgatttttattcctactattttgcagccaattaattttgagcttgaatccagaaagatacttgatgaagagttagcatttagaagtgcccatctggagcatcgttttctgtaaggcatcatttgaagcctctttggatacaagatctcatgttttagtgattttacatccgggagcccattttttcacagctaaagctggtaatcctctgggcagagttaactgaattgctttctacatgctagtgtccagaaagagtaattaccataagtttaaagtctccatttcaacaaaacttctggttgcagctgtcttgagttttaagccagcaagactttgagtggctcctcttccctctgggctcacataaaaacatagatgccaactgtatcctgactaatgctcattagtgctgtacctctttatgaagcttctaaacaagtttttccaggaagaaagcagaaactatgcctttgcttattttatcctgtgggttacagtcagtcttcataaagcaaaccatcattatataatggtgtgcccataatagatgcatttgctggtataactgcctctttttggcacattattgcttggctttaatttcatattcaacagtctttattctcattattagtatctgagatatttgtgtcttaaaaaaacttgcaatggatttattttgagagaggttattttgttgtggcaagtgagtagtttagctggtgactgttcacagttaaaagtagctgtaatgacctctggcagatgtcactgatcacttgggagacagaatttttccacttcaatccatcttcatttatgtccttggtcattgcaaacccagcttatttgatttctgcagccaaggagaattgttttctttccaagagtaggataaagttcatggaaatctgtttcagtatttacaagactattttttttcccatttgcaaaaatgtctaaaattttgtagacatccttaagcccatgtgtctggacagatgacatttgtaattgctcagccagttgaagaatttcattaagaaggatatcgttacaaggatggacaggagattcagcatatcctctgttatttgccaggtggcagcagctgacccgaatttggagagaatcaaccaaaaagggccacgcacaacatcaggaagcattgctaacagaaaacaaaatgctcagatacatatgtaaaataacaaacactaaaggggatgtttgacttctgatttcaccatgtacacaaaaacagagtgggaataaggtagtcggctcacttatgcaagatactgctgagttcactgttctaccacaaagggaaattcacaggcctcacttctcaaacaccacttagaacaaagcaggagagagtaaacagcatcatctccatggcagcattacagataattagtaaatcaggcaggtagaggtctacacaaggctac

SEQ ID NO: 767 - DNA, 3369 bp, Homo sapiens
aataggaaaagtgagagtggaagaaagaaaaagccagcatagaatgtgttaatgagtggattgttgggactcacttctgctgagtatcctctgacaaactgtgatgaatatgcttctggatagtactactgagagatgggcatttttttctccacaattgcaggtgaagacacaagcaagccaaggaaatattgagtgctttatccattgtgttggctaccgtctacctcttgcactgctcagatatgcttacatccaatacagattctgtcaggcctctgagcccaagccaagccatcacatcccctatgacttgcatgtatacacccagatggcctgaagtaactgaagaatcacaaaagaagtgaatatgtcctgccccaccttaactgatgacattccaccacaaaagaagtgtaaatggctgatccttgccttaagtgatgacattaccgtgcgaaagtccttttcctggctcatcctggctcaaaaagcacccccactgagcaccttgcaacccccactcctgcccgccagagaaaaaaccccctttgactgtaattttcctttacctacccaaatcctataaaacagccccacccttatctctctttgctgactctcttttcagactcagccagcctgcacccaggtgaaataaacagccatgttgctcacgcaaagcctgtttggtggtctcttcaaacagacgtgcatgaaatttggtgccctgactcggatcgggggacctcccttgggagatcaatcccctgtacttctgttctttgctccatgagaaagatccacctatgacctcaggtcctcagaccaaccagcccaaggaacatctcaccaattttaaatcaggtaagcggcctcttcttactctcttctccaacctctctcactgtccctcaaccactttctccctttcactcttcaatccctcccttctcttaatttcaattcctttcattttctgggagagacaaaggagacacattttatccgtggacacaaaactccagcgccggtcacagactgggaaggcagccttcccttggtgtttaatcattgcagggacgcgtctctgattatacacccacctttcaagggtgtcagaccacgcaggaatgcctgccttggtccttcacccttagcggcaagtcccacttttctggggaaggggcaagtaccccaaccccttctctccttgtctctaccccttctctgcttttttgggagaggggcaactattcctcaaccccttctcctgcacccttagcggcaagtcccgcttttctacggggcaagaacccccaatcccttatttccacgccccaacctcttatctctgtgccccaatcccttatttctgcaccccaacctcttttctctgtgccccaatcccttatttctgcaccccaacctcttatctctgtgccccaatcccttatttctgcaccccaacctcttttctctgtgccccaatcccttatttctgcaccccaacctcttatctctgtgccccaatcccttatttctgcaccccaacctcttttctctgtgccccaatcccttatttctgcaccccaacctcttatctctgtgccccaatcccttatttctgcaccccaacctcttttctctgtgccccaatcccttatttccacaccccgacctcttatctctctgccctaatcccttatttctgcaccccgacctcttatctctgtgtcccaatcccttatttctgagccccaacctcatatctctgcaccccaaccccttatttctgtgccccaaccttttatatctctgtgccccaatcccttatttctgcaccccaaccacttttcccacttttctggaagataagaacccccaaatcccttccctccgtttctctactctctcttttctctaggcttccttccttcactatgggcaaccttccgccctccattcctccttctactcccttggcctgtgttctcaaaaacttaaaacctcttcaactcacacctgacctaaaacctaaatgccttattttcttctgcaatgccgcctgaccccaatacaaactcaacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccagtgcaacttgtcccaaatcttccttctttccctcctgcctgtccccccagtaccaacaccaagcgtcgctgagtctttctaatcttccttttctacagacccatctgacctctcccttcctccccaggctgctcctcgccaggccgagctaggtcccaattcttcctcagcctccgctcctccaccctataatccttttatcacctcccctcctcacacctggtctggcttacagtttcgttctgtgactagccctccccctcctgcccagcaatttactcttaaaaaggtggctagagctaaaggcatagtcaaggttaatgctcctttttctttatcccaaatcagatagcatttaggctctttttcatcaaatataaaaacccagcccagttcatggctcgtttggcagcaaccctgagacgctttacagccctagaccctaaaaggtcaaaaggccgtcttattctcaatatacattttattacccaatctgctcccaacattaaataaaactccaaaaactggaatttggccctcaaaccccacaacaggacttaattaacctcaccttcaaggtgtgcaataacagaaaaaaagttgcaattccttgcctccactgtgagacaaagcccagacacatctccagcacacaagaatttccaaacgcctgaaccatagcagccaggcgttcctccagaacctcctcccccaggagcttgctacaagtgccagaaatctgatcaccaggccaaggaatgcctgcagcccaggattcctcctaagccgtgtcccatctgtgtgggaccccactggaaattggactgttcaactcacctggcagccactcccagagcccctggaactctggcccaaggctctctgactgactccttcttggcttgccggctgaagaccgacgctgcctgatcacctcagaagccccgtagaccatcacggacgccgagctttagttctgcactgtcatggcctttctggtgtagttcctgacagcactctccaatcaaccccctgtaaggcaatctcattttgggaaacccaacctatgactgcaatgcaaacattcttttctacctttgttatagaatcttttattaaattgacattg

SEQ ID NO: 768 - DNA, 3469 bp, Homo sapiens
aataggaaaagtgagagtggaagaaagaaaaagccagcatagaatgtgttaatgagtggattgttgggactcacttctgctgagtatcctctgacaaactgtgatgaatatgcttctggatagtactactgagagatgggcatttttttctccacaattgcaggtgaagacacaagcaagccaaggaaatattgagtgctttatccattgtgttggctaccgtctacctcttgcactgctcagatatgcttacatccaatacagattctgtcaggcctctgagcccaagccaagccatcacatcccctatgacttgcatgtatacacccagatggcctgaagtaactgaagaatcacaaaagaagtgaatatgtcctgccccaccttaactgatgacattccaccacaaaagaagtgtaaatggctgatccttgccttaagtgatgacattaccgtgcgaaagtccttttcctggctcatcctggctcaaaaagcacccccactgagcaccttgcaacccccactcctgcccgccagagaaaaaaccccctttgactgtaattttcctttacctacccaaatcctataaaacagccccacccttatctctctttgctgactctcttttcagactcagccagcctgcacccaggtgaaataaacagccatgttgctcacgcaaagcctgtttggtggtctcttcaaacagacgtgcatgaaatttggtgccctgactcggatcgggggacctcccttgggagatcaatcccctgtacttctgttctttgctccatgagaaagatccacctatgacctcaggtcctcagaccaaccagcccaaggaacatctcaccaattttaaatcagtttttcaagtggtacctgagattcagcacttctaaaaagctccaaggtgatgaaggtgctgctagttggaggccatactttgagttgccagatgctaaaaattcaacagatgggagtaggatttaatggcatcaagattacagcaagagtgtcgtcaatgtctgagagaaaaggcacaggacaattcatgtaatctactttttacctcctcactatgccagcagcacacttggagaggaatgttataatggaagaagctgcccagtcactgattaaaatgtaagaaactgtgctccattgcagacatctcctgttatgcgttcatgagcatatatgtgttctagtatgtgtaacctttaagacaatgatggaatttgaaccatactttaggactgacacaggtaagagagtcttgtattaataagcttcaaaatattttattgtaacttaaattacctcagcaatgatactggggtagtcagaaaaaaaattcacctaattttgaactgattttttttaaactttagtagctttgtgttagacagataatgtaatctgagtttcaattaacttatttatggtatggtagtaaaactaccctctacacagtgctcttgatagagtttttagatataaatagtttctgtggtggaaggatttgttttgccagttgagtcacatgtaatgtttgacaaacataagaagatatttgagatgaaaaaatgatgttatataaaggcacagaaagagaaaatacaagtttgattgaagtagagggcttataaaaggaaaataagtgttaaaagtgagctttggggcagattgtggagtgcttcatacagattgggatctataggagtctaactggctactagacttcttgagacataaaatgattgatttaactggaagcaatatgcatgttagaagggagaaaaaacttctaacggaggtagcagttcaattaggaagctattattgtggtaaatgcagcactggattgcaagtgttagctcttagtgtatttttgacaatgattggtctctcaagactttagtttcttcgactattaagtaaaagcatttacattagatgaattctataatttggtatgacttctaaatatgactcctccataatatggacttgaatttgagtagtgacaatccaaagacaatgggagataaaaatgaaaagcaaatacttttgttatagcaagcaaacaacagcaaaaaaacacatggaaacaaaaactgtaaaacttggttacttactgggtatatgtttttgtcatttcacaagatattttaaagcaaatacttagctcataaattattgttaattactaaatatatttctgatattttcagtttttcctttttcctctgctttctttttcttctttttaatatcatgtttcctcaaaatttctttctgaactataaaccaatttagaaaaaaatcttaaagtttgcctttgggctgtgactagtaatacaggagaatttttcagaagtttatgagaagtgaaaaaggggtaaaaagaacaaaaaataacagaccttacatcctcaccaagtactcctgggatttcatgcaatataaaataatgttataagggaaaagcacggaagcatttataaaagttacgaaatagtatttttgaggaaggatgataaaaattttacaatagttcttttatttcatgtgaattctttctcattcagaattttgataacctaaagatgattgtatattttggcttaatctctgtaaatgtaaactcagccaagtaaaatatatatcctttcacataagcgtagcctcccttaaatttagaatatttatcgtaaagaaatatcagaagtaaatagaatttcttttctagaataaagaatacagagatggagtgaagtaagtacaaaatgcatgagtgaatgaaggatggacaccatttttttaaaaaatgtataagagtgatatctttcacccatcctctggggaaaaaagtgaagagaggtgcttgagtggtagtatggtagctttttctcttgccatcaccagcacaagtgaagaaaagccacagtgtgtgtaactgctctcttaagactctattctcagaaactaagattagtttacaatgtaatgcttatcagtttctctgtttccaacttaaaacaaagtagaacttaaaaagacaattctggataattaacgttattctctggtgtagagcttgatacttttgcctaattttgagaaagttttgtttgcctttttctctttctctcggtccttcactgattcattctggcaatatcagcctgaggtatatgtttttctgtcctataattcaggcatttcataaaattgtggaactcagtgttattccatttttttccttaatagatattttttcagtttttgctatgtgccaagcactgtataggtgctagaaatacaaaggaaaaagaaagaaggcatctcttttctcagcaggattaacattctaaagggtgagactgaatccaaggaagaattttgttgatgaaaacacaaaatgaaaattaaatagaatcaaaattaactagtaaattattat

SEQ ID NO: 769 - DNA, 319 bp, Homo sapiens
agttaaaacagtgtagtttatttctgttcaatgtcctgtataggtggaaactaatttcagggttaatttttggttaaacaactagcttggaaatttataattatttgggattgaggaccaaacaaggtgaggcacgataaagaaattagaaggggatcgctatgaaaatcaagatgaataaaacgaagggagtgtttacggcaaagtaaaaaaagaggcatcaaattttaattcactgctgcaaagtagagctcttatatctattgctgatgtaaggagacaatctggattatactgtgagaaggaaagcataacaaac

SEQ ID NO: 770 - DNA, 450 bp, Homo sapiens
ggaccctcagagccaggtgcggggtataatctcgtggtgcgccgttttttaagcccgtcggaaaagcgcagtattcgggtgggagtgacccgattttccaggtgctgtccgtcacccctttctttgattaggaaaggaactccctgaccccttgcgcttcccgagtgaggcaatgcctcgccctgcttcggctcgcgcacggtgcgcgcacccactgacctgcgcccactgtctggcactccctagtgagatgaacccggtacctcagatggaaatgcagaaatcacccgtcttctgcgtcgctcaggctgggagctgtagactggagctgttccttttcggccatcttggcgcctccctcagtcccgggctgcatacatcatcagaggagaatgttgatcacctgtttccaagccttggcaaggcaattcaggataaatgttccataag

SEQ ID NO: 771 - DNA, 450 bp, Homo sapiens; identical to SEQ ID NO: 770

SEQ ID NO: 772 - DNA, 522 bp, Homo sapiens
taaaatatgcgagggaactctcttgttgccattgtgagaccctggagaacagatggaaccaactctcaagcttctgctcgggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaacctagcagaaggcaagaaataactaaaatcagagcagaactgaaggaaatagagacacaaaaaacccttcaaaaaattaatgaatccaggagctgcttttttgaaaggatcaacaaaattgatagaccgctagcaagactaataaagaagaaaagagagaagaatcaaatagatgcaataaaaaatgataaaggggatatcaccaccgatcccacagaaatacaaactaccatcagagaatac

SEQ ID NO: 773 - DNA, 522 bp, Homo sapiens; identical to SEQ ID NO: 772

SEQ ID NO: 774 - DNA, 1293 bp, Homo sapiens
cccaagtcctcggacgcgctgcttttaaatgcctccttcaccccgcccgtgcatcccgctcctaaggggtcatctcctcgcccttccccgaagtttggtggaaactaaaaaccacattcagagggtgtgaagctgagtctggtgcagagagagaaacccggctctgcgtccgatcgccacgatccggcgagggagccagctcctcctccccgctgcacccgctccccatgccgcaagtcgccctcacctccatctcggcgtctgcgggaccagcgctggccgcagacgcaaccgcctgcgccgcgacgccttcggggccgcctttgttgctgctgttgctcccgccgctggcgatcgaggctgcgggcttggaaggcgcgctctcgggaggcgggggtggcggaggctcggccgcggacgacatgatgttccgtctgcgtcacccgctgctgccagaggcccgagtccggcggggatggacggggaggcctaggcctggatgctacgtcgcaataaactggtggaggagcgagactcccacccgagcgctcccctgcgccgcgcctccgcgacgggcctgagccgggcccaggagctgcacactcccaaacgttctgctcttccgcggggctctaggttccaccggcgcttacctcacggcgggaatcacgtcgacgagggtgggcggggccagacgggtcactgaggtcaaggaaggccggctgatttagagaagggcggagggttgggggaagggaaaaggaaaacgaaagagagactgaggctgggaaaacgcttcgccgcctcctcctcttcctctggaagataacatctatctcgccagcatccaggacgacgacctacgccaccgactttcaacactcgcgagattccttattggctcactgactgggtcctgagcgcgcatgcgcatactgccctcctcacccttggcccgccctcttccagatctctagccggctcgggagagaagagtgggcgggacctccagggagcgctcggaggtgtaggtttgtgcgcctgctgcttggcaggacgcgagctcagtgttttaggctttcgtaacggctcacggttctcgctgtgtcttctgtgcctgacaggggttggcggcactaccggaaaacttgtctgggttttgcgctgcccattcaaacttggaagtcttgtgtctggccccaaaacttctgccgtatccgcttagaggcgtgacgccacagccttgacgacgttatggttaccccaagtgaagtctcacggttttttgttgtt

SEQ ID NO: 775 - DNA, 2702 bp, Homo sapiens
gtggggctgttgggtcatgagggcagaaccctcgtgaatgggaataatcccgccataaaagaggcctgagggagtttgcttgcccctttcctccttccaccatgtgagaatgcagcaagaaggtgccctgtatgaagcagagggccctcaccaggcaccgaatccggtggcaccttgatgttgaacttctcggccttcagaactgtgacacagagaatgagtggaatactaatacattgaagggcaaaatcaaaaccccagaagatctctaaaagtctgaatgaatcagcccatattacaagataaagtccataatggtaaacggaaggctctggtcttggtttacaaaatccaaccactcaaatatgtagttgctggaagttttgtggccatggggatgctgacaaagattgcttgggatgcacacaaggcagcggcgaagcctgaggggtgctgccaggccgggctctccactggccacggcctgaccgactgctattccagaggcatcacccgtcaggcctcaccggaaggctgcacagccggtgccacctcagagagtctctggcaagaggtcagcctcctctggctgctcctgcccttttgtggatctgctttcctagtccaggtgctctgttcggagggctcagggacccttaagggaagacacctttcttcactctgactcagtacttttacactctcagctttttcccctctcactacccaactccccagcccctggtccacaacccttcaggaagcctttggttaggggccccctcaagagtgagatgacccccacatctgtgctgatcctcctgaccctgaaccgtatgggtgcattgttccaaggggaaaatgaagcaggagagctcagcactccctccagtgttagcctcttgcttgtactactgcagtgcgggattaaagtcttcgctattacttccatttgtgcttgttgtagcttcaagtggctactctaacacctgacagctcagctcccttccagctctactgagctcctgacagcgccatgcgatgcaatttaatctaagaggaattcagccgcatggttataccggggcacggtggagaataaatgacattctgcctttgttctgcctaaaatacaggtgtgatgactggagatgcagaagccattccattatatcaacataacatgataagccaagaccctaaagatgctgagaaaaatggtcaaaagagcttggggtttttttggtttttttgtttgtttgttttgttttttttgaggcagtggtctcactgtgttgcccaagctggtctcaaactcctggcctcaggcttcagcctctcaaaactgctaggattacaagtgtgagccactgcatgagactgggctgttttttgtttggtttggtttttttagagacagggtcttgctctgtcacccaggctaaaatgtagggatgtgatcatagctcactgcagcctcaacctccttggctcaagtgatcctcccacctcagcctcccaagtagctgggaatacagacatgcactaccacacccagctaattaaaaaaacaaagtttagtagagacggaggtctccctatgttgcccaggctggtctcgaactcctcacctcaagtaatcctcctaccttggcctcccaaattgttggaattacaagcgtgagccaccatgcccagtactgtctggtttcttaataacattgttgagccattgcaatagccttgggatattgctctttgtactttttcttatgcaagaaaaacagattcacaagttatttgatgactctcttcccatcaaaaggaaaagtctaattctttttcccttgattatggatcagcttgagcttgttgcttctaacaaatggaagagagcaacatgctggagtgatcacatggaggaagcacaaagggatacatgcccaaggggccccagctgttccagcccctagacatttgaatctactcaggcaccaagtaagcaggtgaatagccttcaggtgattgcggcccactcccagctgaagccaagtggagcgcagatgagcttcccctgctgagccctgcccaaattgcagatttggaagcaaaatgaatattgttttaagccacaaatttgtgagtgttttgttacatagtataaggagccagaacagctctacagatgtaaattatagtcagatatgttgctatttataaccaaagcattcctaacttataaatgtttcaacattaataagcagaagaaagtgtaataatcttatcaaggtaatacaagttacttgtttaatataaccaccttcatggcaagcctcaatttcataacctaatcactttgagtacaacttggacctaatgggtagctttttttttttttttttttttgagacagggtcttgctctgtcacccaggatggagtacagtgacacaatcatggctcagcacagtctcaaactcctgggctgaaatgatcctcctacctcagcatcctgagtagctgggactaaaggcaggccccactatgcccagctaatttataatttttttttttttctgtagagatggagccttgctatgttgcccaggctgatcttgagctcctgggctcaagcagtcctccagctcaacatccccaagtattgggattataggcatgaaccaccactcttggcctctgtgt

SEQ ID NO: 776 - DNA, 2030 bp, Homo sapiens
aattaatatcaatttgttttagccttgcaaataaattacagacccatcaagttgaaaataagcttgacacgaaggagaacacatactgataataaatgcgagttttcttacccccaccaccctctctggaaaggatctagcatcgcctcaggaatgatattttgaattcagtgaaacactttggtttgaatttagcctgcccatctacctgcaggtcaaagacccctgtgaaacatgatactagacgtggcttcagggtgttaggtctgagcccttctgaaaccctactacctccctggactgtcccatagagcaaatgaagatcccagttaggcttttggggagttctaaggaacaggcaaatatttctccataaaaacattctagttccccgagccgactagagaaacctctcctgagagctggggcaactgaacgcagtttcaagtatctattattgcactgtatattatttgtttgctctccttatggtagtgagttttaattctaatagaaagcctggtatttcccaaaagcaactcttttttgttgttttttgttgttaatacagggttccaatggactacggaataaggcaacacagggcctgttttcccgcagtgtcctctgctccaaggaactttcttaaggaagcgggacgtgtcaatgaggtacctcccggggttctacagttcctcctgcccactggccagggggaatctggcgggagcctctcggtggatgctgtcacatgactgtgccttctgaaagaacatctgtgaagagcagtttctggtgtccctgagtaacccttttctaacaattcagccagtgtatttcctccaagagtagaaaacactggcttggaaaatctagtgaattttcagcttcttgtgaatgtgtatgaacaaaccaacctactcggtctgtgaaattctcgctaattcagatgggacatgggcaaggcttctaatactttcatcccatgaacataaattttgatatttcagctgcagattttttcaaatatacaatgacctgaggccaggaaagttaccttgtcaatttattttcttataatttgcatgtcttataaaagtagactacagcaggcatggacaaaaacagaacaaaagtctaactgattgaaagcttattccatagagaagacattgggttctagagacttacaggctatgcttgtagtttctcatatttaccttccttttgttggaaaatatagcagaaaatagagtggaggagggtgagaaggtgaggttatttgtgtgaagaatggttaggatcagtttgtttacctcctccccatccgtaccactttttggaacagttatctgtaaatataaggataaagtagtctgaacctgggtacagaagaggagaacactaacaagacaggcatctgatggtaataccaacagctttttccccaaacctaagttacaactttagtgatcattatgttctaattgttatagaaaaataaaatgtgaaaatactagttacaacatcccaatgctttcctctattgaatatttaaaaatgtttctgaacgtgaactttgagttttcagatatgattttaattgtgtattgatatgtatttctctaatctacaaccaagcagttcaatttagacaactacttacaggcacttcaaacatttcttgtgacattgttaaaaggggcatagcttggaatcaaatgcagtctaattaggtgatatgtgtggttcattttggggaaatctgtgagatgtctaacagataaattattacttaggagtatattcagattcttagcccagcacattgggtccacagactaatggttttcatatactttatccaatatttaattttatttgttctgaaagttttaagcccagtcatatatctgtgaagtgactatattaactataaactatgacaaatgtgagtgcatatattataatcctaaagcaggtgggttattacctatagcatgagctgtaaccatctagttaaatgagat

SEQ ID NO: 777 - DNA, 1119 bp, Homo sapiens
attcgggctgtgtttagctgctggaatatcgtagaattggttttcagagaagttcctcgactcctgaggcgaaacataaagggatgggagtggtgtgggaagtgatcgtgtggggaaaaaaaagtttcgagcccgtttcgcatttgtggagacagagtttttggtgtgaccactcttttgtgggaaacccaaaccaaggagaactcaggagaattggcgctcttcggtcctggaggttccgcagctaacatcccggcttgaccaactatcgaggccgcaaattaatagggcacctcctgggaggaaaacgcccatcctgacttctcaactgtgacagctaatatgaaagctgcatctttactagttagctaccatgcgtcattatttatcaaaagatatatgctgcttaaacacaaatacgttttaaaatatattttaggcagtagggttttgggttttttttttgcaagttcttttggtgagtaaatttagtgataaatgatttttttttcttttgagacagtttgctctgtcgcccaggatggagtgcagtgcagtggcgcgatcctgcaacctccgcctctcgagttcaagcgattctcctgcctcagcctcccgagtagctgggattacagacgcgcgccaccccacccagatgatctttttaaatgcaaaatgccatcgacgcagaaaatcaaagaatcagcttaagttccagaaaaaagaaaaaccaaccaaatgaacaataagacaacaacaacaacaacaaaaaaggccttttgggattttggatgatattgcatcaaatccatacattaacctgagagacgagcgacttcttcaacattgagccttccaatcatgattttcaattcatttaggtcttctgtaatgtttcttaatataattgtatttgttgctatgcagaagtttcactgatcttttattatatctctatatatatttgatatttctgacactattgtaaatagtatctttttaatatttcattttccttttttgttgcttaaatatatataaaataagctaattttccaaactaatttttatatccagcaaccctgctaaaatttcttatccaataaaaatataaatgta

SEQ ID NO: 778 - DNA, 1119 bp, Homo sapiens; identical to SEQ ID NO: 777

SEQ ID NO: 779 - DNA, 1983 bp, Homo sapiens
ccagggcccaggtggtgaccaaggcccggcgcagtggccccggagcgtggaggggcagctgctgggcggcctcccgggggagggtgacggcttcacccgccaacgctgcctccctcctgggattaggccggaggaatcttggatcgcccgaggctggtgctcagcctccttcccccatcccacctccaccacccggcgacccccgtagacttgattggcaggccctgccccgacccctacccctccaggtccccgcctcggtgcctcggtgcccggctccgggccactcctgcaggccctgcctagggcagccggcggtgcctggaggcgggctcgccccggctgctccacgcccaggccggtccctggcatttcagccagtgggagggcgtccccgccgcccccgtgcctctccgcaggggctgcgccgcgtccccgggcctctccctccgccgtggcctggtctgcctgctccagggcgcagctgcgcccgcttcagcgcctcccgggtctgcgtggcctgctcggctcagaggcctccaccacggtccgctccctgccggacgccgcgctgctgtggccgcggtggttctgtggctgtgagggccgtttctgtccgtccacaccgccttccctctgcagatttcctctgcagaggcccggagttaccagcaaggtctgacgcagcagagtgcagaaacggcctccctgtctgtcaaagtggcctcccgaggacacccagcgaggccaccagatcatcacgtggagtatcggtggccttattaaaacaaaaacaacaactccacagcccggcgagcgtgtgaaatcatcaccacaaccaagccaagtgcatccatcgctcaggcagtcaccatggtgtgagtgcggtgagacggctttgatctggctctcagccacttctgatgctcctggtacctgcagtcaccacgctgcacccaggcttctgtgtgtgttcatcccacagctgcagaaattattgcaacaccctgcagcgttcagacttgtcatggatgactctaacagggcaggtgttaccacgtcaactggtccaaaaaacaaaataccgggtgcacatcccttgaagtttcgggtgtgtttactctgaggcaccgtgcactgcaaagctggggattcacaggcaagtttaggtgaatcctcggaacacgtgactgatgaattccgggcccgtgtcgggctctcagccagcgcctgctccgtgcgccagggacggagtgctgccttctcgggagtcacacgggactggcttagccctggcgagtgtttcgcatcaggtgacaagttgtgccgagtgtctgccaccctgcatgcccacactgaatccgtgcagggccctcccggccgcctgctcagctgtggacacggagctccggcacagccaagtcctgaatgacatgcagccaattctcttgggccctttccgggtttgtctgtggtccttccttctgtgtttccaggctgagtcctaaggccctggtcctgtgcccagtgtggtgccttggaagttctgaaagtcacaggcatttagtgctataaatttccctctacacacagaaatacaaactaccatcagagaatactacaaacacctctacgcaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttga

SEQ ID NO: 780 - DNA, 4287 bp, Homo sapiens
gccccgtgaggagtggggttttggggttttgggtttcgcgctgggctgcgtttctgcaggagccaggcctcttcatgctctgcggcgacagccgctggggtggggctacggggaagtcgcgctgcccctcgtctgagcgtgggccagggcccaggtggtgaccaaggcccggcgcagtggccccggagcgtggaggggcagctgctgggcggcctcccgggggagggtgacggcttcacccgccaacgctgcctccctcctgggattaggccggaggaatcttggatcgcccgaggctggtgctcagcctccttcccccatcccacctccaccacccggcgacccccgtagacttgattggcaggccctgccccgacccctacccctccaggtccccgcctcggtgcctcggtgcccggctccgggccactcctgcaggccctgcctagggcagccggcggtgcctggaggcgggctcgccccggctgctccacgcccaggccggtccctggcatttcagccagtgggagggcgtccccgccgcccccgtgcctctccgcaggggctgcgccgcgtccccgggcctctccctccgccgtggcctggtctgcctgctccagggcgcagctgcgcccgcttcagcgcctcccgggtctgcgtggcctgctcggctcagaggcctccaccacggtccgctccctgccggacgccgcgctgctgtggccgcggtggttctgtggctgtgagggccgtttctgtccgtccacaccgccttccctctgcagatttcctctgcagaggcccggagttaccagcaaggtctgacgcagcagagtgcagaaacggcctccctgtctgtcaaagtggcctcccgaggacacccagcgaggccaccagatcatcacgtggagtatcggtggccttattaaaacaaaaacaacaactccacagcccggcgagcgtgtgaaatcatcaccacaaccaagccaagtgcatccatcgctcaggcagtcaccatggtgtgagtgcggtgagacggctttgatctggctctcagccacttctgatgctcctggtacctgcagtcaccacgctgcacccaggcttctgtgtgtgttcatcccacagctgcagaaattattgcaacaccctgcagcgttcagacttgtcatggatgactctaacagggcaggtgttaccacgtcaactggtccaaaaaacaaaataccgggtgcacatcccttgaagtttcgggtgtgtttactctgaggcaccgtgcactgcaaagctggggattcacaggcaagtttaggtgaatcctcggaacacgtgactgatgaattccgggcccgtgtcgggctctcagccagcgcctgctccgtgcgccagggacggagtgctgccttctcgggagtcacacgggactggcttagccctggcgagtgtttcgcatcaggtgacaagttgtgccgagtgtctgccaccctgcatgcccacactgaatccgtgcagggccctcccggccgcctgctcagctgtggacacggagctccggcacagccaagtcctgaatgacatgcagccaattctcttgggccctttccgggtttgtctgtggtccttccttctgtgtttccaggctgagtcctaaggccctggtcctgtgcccagtgtggtgccttggaagttctgaaagtcacagcagcccaaagggatgagaagatggatatggcccggagataatgcacacctctcgtggggacagtgtccccatccccctccggctgcactgaagacctggagcaatggctgccatccatgcgcgaggacccctcggaggttccacctgcacagaccttgctaagggtgaggtgattactagaaggagcaccttttctagttaaaatctaactagattctccttggcaacttgtcttacagaaacaggtatagactatcaccttgcccagctgggcgcatcttcggagggaggcctggggccacgtgcacctaatgaaggtgcctgggagggggctggctttccactcagcaaatgctttcttacagaaagactgtggggagagtccgttttcttagagccgtatgaagaaatcctaaaaaccaactgcccaatctcaactcgtaacagggaacctggggagtgacatcagagattcccaatgttttcctcctcgttgatccctgcgatgaaggcacttgcccatgtgtattctgtagtaggagtttgcattctgaaactggtctttattaaagaacaaacacattatttacaaattatagtaagagaaatacctacttatttgtaaaacttgttgctcagcataacaacacaggtgactgcatgtcatccacagagtttcagatgactctgttatgccgaccatgtcctggtggatgtgcagttctctcataggccttttaccttattgaaaatcacgcgtgcatcccagctgttgtttaggatcctgagccccctgggctgggagccacagcactgatgacctcagaaacaaggttgttagaggctgtgttctctccacacccctttcttgtgaggccctgggatgctgcttggtctggaggggcatccttcccaaagccccacaggaggctgctgtcatctgcattctaccgagggcatccccagtcccaggtttcatcctggtgtcccgctcatatgttccctgtcaccctgacgtgctcaaatgagtcagtcgtcttcattcatagattctacattgcaaattctcctactcactaaaatttatttgtagcgtcaaaatcagcattcatgcactgtcttagattgtaggtgtgcacagagcgataaaaaatcggagtcgcctgacatgcacagccccgcctggggctgaacaaaggcccagctctgccttcccgttacggctcatcctgtaaacggtgtcctttctgtggtctgttgagtgccgtattttttgaatttgtgtgcattttgctggtgatctcactgcttaagagggcgagcacagtgtggaagtgctgtagtgttcccacgtgcaaggggctgtggtgtgcctcatggagaacacgtgtctgagaagcttccctcaagcacgagtgatgaatcaacactgcatagtgaacaaggtgtctaaacagaaacacgaagcacaaggctgtgtgctgatccatggatgaaatgctgtgaccagagctgagccctgcgtttccccaggagcaggggtgtccgtcggctcgccgtctgcagactctagtatgtagccaccctgagtggtggggaccgactgcacttctcagcagtactcggctaaaagcctgcgtgcaacttagctttatgtgtcctgagtttggtctttgtttcacaaagggaagggggttggatgttgggtttcccaggacatggtgcctgtttagaagtgcccccagggcctcagagccagcgggaggcatccacccaaatgctgctgacaaaccttcctgtggcagctgccactccacacggaggtgcagggaagccagctgccagggcacacacacaaacacatgcatgtgcacacacaccatactgtcacacacacctcaacatgcacgtgcacacatgccacactcacacgtacacaagcacacatacctgaatatgcacatgcacgcacacatgctccactcacgtgcacaagcacacacagccacaccggaacacacatgccacactcacaagcacacactggaacacacatatgcacacactcatgccacacacagataagcatacacacatcagaacacacacaccacacctacacacaagcacacacaccccaaaacacacatgcacacacacatgctacacacacacaagcacacacacacacaggcacacatgccacataaacacatactggaacacatacatgtacacacaccacagaagcacacacactgaaacacacacatgcacacacatgcacacacacacacaccagaacacagacatgcatacgcatgccacacacacacacacctgaacacacatgccacactcacacgtacacaagtgcacacacaccagaacacacacaccacactcacacacaagtgcacacacacacaccggaacacacatatggatacacacatgccacgcacaccagaacacaggcacatgctccatgctcacacacacatatactggaacacacacatgcacacaccacacacacaggcacactgaaacacacgcacacacaccagaacacatgcacacac

SEQ ID NO: 781 - DNA, 9967 bp, Homo sapiens
ggactacaggcgcccgccactatgcccggctaattttttgtatttttagtagaggcggggtttcattatgttggcaaggctggtctcaatcacttgacttcgtgatccgcctgcctcggcctcccaaagtgccaggattacaggtgcaagccactatgcctggccgtaaactgctcatttctttgtgacattatccccataaactttttgtagagcatcagcaattataccattcttctacccaagcttcaccatacatttgatgtttgttcttacttcaattttagcataattcaagttgctttaatagaggctcttttcaaactgatgtcttattcttctcagtgccttcaactggatcctgtttagacatgttataacaagctagtatacatttatttttgtgcaaaaagttgaaatttatgcatagttttttttataatacatatttccataaactttttggaaactcctcatttctgcaatggacagattatcaatcaatatgaatgattaaaaatataaagtaggtgcaatataataaacctttcatggcatccaaaaccaaggctgctcttcacagaaatacacaaaaattaaaccatgaagaaatatcagtaattattcaaggtaaaaatcacagtaagaccttggaaatacaaggcctaagatttactatgaggaatatatatatttcttcttgaatgtatcagaaaagagccaaatgtaaaaattaattaactgaggaattaaataatgtaaaaaatacacttcctgaaaaaataaccaaatataatttctaatgcataaaatatgtgttagttaaaaagaaaaataagcaggcacaaaattacaaaatcctaattcttgtactttttatttttttataattttaattttaattttagatataggggttatacgttcaggtttgtttcacagatatattgggtgatgctaaggtttgggatatgaataatcttgtcacccaaatagtgagcacagtacccaataggtcattttttcaacacttgcaccccccctagtagtttccaatgtctattactcccatctttatgttcataaataataaatatttatttcctacttataggtgagaatatgtggtatttgggtttctgttccttcatcaagttgcttaagatgatgaccttcagctccatccatgttgctgtaaaggacatgaattcattcgtttttacaggattctgtcctatgctttgagcaaccctacattgtggtctgaaaaatgtcttcaagtcaaaaactggaataactatagagctcactcagttgtgcactggagactactcataactttctcaagttctgattatatgctccacattcttttcggaaacatgaattggaaacatattcaatcatgttagtgggtgtaccagttcacaatcccaatagaaatgatgtaagaagcaggacacaactccagaggtggggctcagacatggaaccagattgaggacaagttaacacagggcctgagtagcagcagcacaataaaatatctgcatgagcttttgtgacttgccaaaacagccatgctagagattgtttagcaccacaaaaagaaaataatggaagacacagtggagaagaggtggagcaagatgatggaatggaaaaccccaacaattctgccctccacaggaacaccaagttcaacaactatctacacacacacacacacacacacacacacacacccacacacacatcttcgtaagaatcaataataaagtgagcactcacagtacctggttttgacttcatatttttcaaagaggcactggagagggaaagaaagacagtcttcaactgtcaatgctaccccttcccctatcatcccacagtgccctcatgctgcagagaaatctgtgcacttggaagagggagagtgcagcaattgtaagactttgcattgaactcagtggtgcccggtcacaagggaaaatgaaactgggcataactcagctgatacctgaccacagagagagcattcagaccagtcctagacagaggggaattgcccatcctagtggtcagaacttgagttccagcaggtcttgcaaatgtgaactgaagtgctctggggccataaatagactggaaaggcagtctagtccacaaggactgcaaataaactgaaaggcagtctagtccacaagtcctagagctgaactaggctcagagccagtggacttggagggcatgccaactactgagataccagccagggcagctaagggagtgtttgtaccacctctctcccaggcccaggtagctcatggctccaaaagagacccctttcttcctcttgaggagatgacaggaaataataaagaagactttgttcttgcatcttgcacacttgttcagccacagtaggatagggcatcagtcaaagttgtgaagccctaattccaggtgctagttcctggatgacaattctagacacacagtaggccagaaggaaacccactaccttggagggaaggacccagtcctggcaaaaaccatcacgtgctgactaaaaagcccttgggacctgaataaacagcagtgataatgagatagtacaacatgggctttgggtgagaatctgagatggcttcaggtgagacccagcacattcccagttgtgatggctgtggtaagagactccttcttcataagaaaagcagagtgaaaagtaaagtagacttcatcttgcaccttagataccagcttggccacagtagagtagcataccaagcagactcttgaatccccttattccaggccttggctattagatggcatttctggaccttccctgggccagaagagaacttactgccctgaagggtgagtcccaggcctggcagcattcaccaaaagctgactgaagaggctttgagccttaagtgaacatcggtggtatcctggcaatactccctgtgggcctctggtggtgttggccatgtggtgaggctcttttgcctgtggaaaggggagggaagagtaggaaggactgtgtttcatggtttgagggccagcttagtcacagtggaatgaaacaccaggtagatttctaaggttgttggctccagtccctagctcctagaaggcatctctggacctgtgtgaaatcagagggaactcactgccctgaagaaaagcacgtaaggctggctggctttgcttcctgatgatagtagagccctaaagccttgagaaaacatagacagtagccaggtaatggctatagcagaccttgggggagatccagtgttgtgctggctttaagtctgacccagtgcagttttaagggtggtgatcacaggagtacttgtgtcacccaatccctagcaccagatggctcgtcacagagagagagtctgtttgtttgggagaaagtaaggaaagacaatgagattatgtttctggtaatctggcaatttttttcggatcttatctaagaatatcaaggtggtacctctaagggtcttcaagaaccacagcattactgcatttgggctgccctgttactgtagacatgtctagattacaacacccaagtcttttttaatacctggaaagcattcccaagaagcatgagtacaaacaagcccagacagaagataacaataagtgcccaaacaccaacaaacatcaacaggcatcaagaccattaaggaaaacatgttataaccaaacaaactaaataaggcaccaaggacgaatcttggagaaacagagctatgtgacatttagacagagaattcaatatggctgtattgaagaaactcaaggagagtcaagataacacagagaaggaattcagaattctatttgataaatttaacaaaaagatggaaataatatttaaaaatcaaacagaaattctggagttgaaaaatgcaattgacatattgaataatgcatactagtctcttaatagcagaattgatcaagcaaaaaaaaaaattgtgagcctaatgacatggtatttgaaaatacacagaggagacgaaaaaagaatttaaaaaacgacttatgcctacaaaatctaggaaatagtcttaaaatggcaaatatcagagggccttaaagaggaagtagagaaagagttaggggtagacagtttattcgaagaaacaataacagagagcttcccaaacctagagaaagatatcaatatccaaatacaagaaggttacagaatgccaaagagattcacctcaaagaagactacctaacagcatttaatattcaaactcccaaaggtcaaggatttaaaaaagatcttaaaagcagcaagagaaaagaaaccaataacatacgatggaactccagtacatctggcagcagacatcttggtggaaaccttacaggtcaggagaaagtggcataatatatttaaaatgttgaaagaaaaaaaaatttacactagactattatgtctggcaaaaatatctgtcaatcaggaaggacaaataaagacttttccagacaaacaaaagctgaggacttttatcaactccagacctgtcctattgctaaagaaagtacttcaatcagaaagtaaaggacattaatgagcaataagacatcatctgaaggtacaaaactcattgataatagtaagtacacagaaaaacactgtacattataacattaaactgtggtgtgtaaactgctacacagaaaaacactgtacattataacattaaactgtggtgtgtaaactactattatcttaagaaagactacaagacgaatcaatcaaaaataataaccagaacaacttctcaaggcataaatactacaaaatagaaagaacaaaaagttaagaaatggagggggatgatattaaaatgtagagcttttactatttttttctttcctggttgtttatttatgcaagcagtgttgttatcagctgaaaataatggattataagatattatctgcaagcctctggtattctcaaatcaaaaaacatgcaacagacacacacacacaccagaaaacaaataaaatgacgggagtaagttcttacttattaatgagatgctgaatgtaaatggactaaagtatccaacaaaaagacatagactggctgaatggataaaaaatataagacccattgatctgttgcctatacgaacatatttctcctataaagagaaaataaacggatgaaaaaagatattccatgccaatgggaaccaaaaaagaataggactagctttacttatatcaaacaaaatagatttcaagacaaaagctataagaagggaacaagaagtcattgtataatgataaaggggtcaaattagcaatgggatacaacaattgtaaatacatgtgcacacaaaactggagcacctggatatatatagcaaatattattagagctaaaagagagacctcaatataataataactggagacctcaacatcccattcgcagcattggacagatttttccaggcagaaaatcaacaaagaaacattagatttaatctgcactatagaaaaaatggaccctaatagatattttcagaacattccatccaatggctgcagaatacacattctttttctcagcatatgaatcattctcaaggatagaccatatattaggtcacaaaacaagtcttaaaacatttaaaaaaacaatgaaataatattaagcatcttctcaagacacaatggactaaaactagaaattaataaggaataattttctaaactatacaaacacatggaaattaaacaatatatgctcctgaatgaccattgtatcaagatcaaattaagaagaaaattgaaaacgttcttggaaaaaaaaaagataatggaaacacaacataccaaaacctaatgatacagcaaaagcagtactaagaaggaagtttatagatataagtgcctacatcaaaaaagaagaaaaagttcaaataaacaatcttacaatacatcttaaagaactaaaaaggaagagcaaaccacacccagacttagaagaaaagaaataatgaagatcagagcacagataaataaaattgaaacaaagaaaacaatacaaaagattaataaaagaaaaattgggtttttgaaaagataaagacccacataaataaaattaaagatgaaaagggagatattaccactgatatagcaaaagttcaaaggatatttagtagctactatgagcaattatatgagaataaattagaaaatctagaagaaatggacaaattcctagacacatacaacctactgagattgaatcataaaaaaaatacaaaacctgaacagaccaataacaagtaatgagatcaaagccacaataagaattctcccagcaaagaaaacattaggaccagatgctttactgctgaattctaccaaatccttaaagaagaactaataccagggttactcacacttttccaaaaactaaagaagagaataattcccaatttattctacaaggccagtattaccctgatagcaaaaccagacaaagacacatcaaaaaaacaaaacaaaacaaaacaaaactacaggctaatgtcactgatcaatattgatgcaaaaattcccaaaaaatactagcaaaccaaattcaacacatgaaaaagattattccttatgactgtattagttcattttcatactgctataaagaactgctcaagactggataacttataagggaaagaggtttaattgactcacagtctagtatagctggggaggcttcaggaaattcataatcatggtggaagacaaaggggaagcaagtcaccttcttcacaaggtggcaggaagaagaagtgctgtgtgaagggggaagagtcccttatacaacaatcagagatcatgagaactcactatcatgagaagagcatggggaatacccccctccccagccccatgattcaattacctccacctggactctcccttgacacatagagattatgataattacaattcaatatgagatttgggtggagacaaaaagcctaaccatatcaatgaccaagggggatttatctcagaaatgcaaggatggttcaacatatgcaaatcaatcaatgtgatacatcatatcaacagaatgaagggcaaaatccatatgattgttttaattgatgctgaaaaaaacataataaaattcaacatctctttctggtgaaaaccatcagaaaactgggtatagaagaaacatttcaacataataaaagccttatattacaggaccatagctagtatcataatgaaagggggaaaattgaaagcctttcctctaagatctggaacacaacaaggatgcccattctcaccaccattattcaacatagtactggaagtcttagctagagcattcagacaagaaaaagaaagtgcatccaaattggaaagaaaaaagttaaattatccttatttgcagatgatatgattatatattccaaaaaaaaaccaaaccaaaagattccaccaaaaaaagcctattataactgataaacaaatttggtgaagtcgcaggatacaatatcaacatacaaaaatccgtagcatttttgtataccaacaatgaataatctgaaaaagaaatcaagaaagtattcccattgataatagctacagataaagtaaaatacccaggaatcaacttattcaaaaaagtgaaagttctctacaatggaaactataaaacattgatgaaagacattgaagacacaaaataatgaaaaaatattttattatcatggattagaagaatcaatattattaaaatgcccacaatactcaaagcaatctatggatccaatgtgatccccatcaaaatgccaatgacattcttcacagaaatagaaaaaacaatcccaaaatttatatggaaccacaaaagaaccagaatagccaaagctatcctaagcaaaaagaacaaaattggaggaatcaaattaactgattcaaattatactacagagctgtaatgaacaaaacaacatgatactgacatacaaacagacatatagaccagcggaacagaacagagaaccccaaaataaatccatacatctacaacgaactcatttttgacaaagttgccaagaatgtactttggggaaagggcagtccctttaataaatggtgctggaaaaactagatatccatatacagaagaatgaaactactagaactctatctctctccatatacaaaaacaaataaaaatggatcaaaggcttaaatctaagacctcaaagtatgaaattactgaaataatacatggggaaactctcctggacatggaagtgggcaaagatttcttgagtaatatcccacaagcataggcaacaaaagcgaaattggacaaataggatcacttcaagttacaaaccatctgtacaacaaaagaaacaatcgaaaaagtgaagagacaatccacagaatggacaaaaatatttgcaaactatctgtctggcaagggattagtacccagagtatataaggtgcttaaacaactctatgggaaaaactctaataatctgattaaaaacgggcaaaaatatctgaatagacatgtctcaaaagaatacatgcaaatggcaaatagttatataaaaaggtgctcgacatcattaattatcagaggaattacaaatcaaaattacaatgagttataatttcaccccagttaaaattgcttttacccaaagacagacaataacaaatgctggcgaggatgtggagaaaagggaatcctcatacactgtcggtggaaatgtaaattagtacaaccgctatggagaacagtttgaaggtccttcaaaacactgaaaatagagctacgatacaatctagcaatcctgcttttaggtatataccaaaaaaaaaaaaaaaaaaaagaaaacagtatatggaagagatatctgcactccatgtttattgcaacactattcacaatagccaagctttggaagcaatctaagtgtccatcaacagatgaatggataaagaaaagtggtacatatatgcaatggagtaccattcagccataaaaaagaatgagatcttgtcatttgcaacaacattaatggaacagaaggtcattatgttaagtaaaataagccaggcacagaaaggcaaacttcatatgttctcacttatttgtgggagataaaaattaaaacaattgaactcatggagacagagagtagaaagatggttgccagaggcagggaagggtagtagtgggttgtggggggtagtggagatggctaataggtataaaaaataactagaaagaatgaataagacctagtatttgctagcacaacagagtgattatagtcacaaatgaaaattgtacattttaaaacaactaaaatagtataattgtattgtaacacaaaggataaatattgaggtgatagataccaatttaccatgatatgattattacacaaggcatgcctgtatcaaaacacctcatgcaatccacaaatgtatacacctactatgtatcccaaaaatgaaaaattagaaaaaattaattaaaaaagtaatgggagaaaggatgcttggaaaggcgcagctttttgtggagatataaagacacaaatatacatgtactgaaactctaaaatgattaccctattaataaattttgctggtgtgaatcaattaaaaactcactattttttaaaaactaggattccttattaatttgattccatataattgtggacatgatgctttctggtgtgcatatgtgtgtatgagtatgcatgtatattttgtcaaaagagttaataacatttaaaaaatatttcaaattagccgggcgtagtggcaggcgcctgtagtcccagctactcaggaggctgaggcaggagaacggtgtgaacctggggggtgg

SEQ ID NO: 782 - DNA, 1094 bp, Homo sapiens
cctggctcaaaagctcccctactgagtaccttgtgacccccactcctgcccgccagagaacaacccccctttttcctttacctacccaaatcctataaaacagccccatcctatctcccttcgctgactctcttttcggactcagcccgcctgcacccaggtgattaaaagctttattgctcacacaaagcctgtttggtggtctcttcacacggacgcgcatgaaagaaattactttttttcaagaatgagttcatgtcctttgcagggacatggatgaagctggaaggcaccattctcagcaaactaacacaggaacagaaaaccaaacaccgcatgttttcactcataaatgtgtccgcatttggtacaacgttcgtcaaagaggatgaggttaccgggattgtcactgatgtgtttaaatgactgcgccagcctccagagaataagatctgtattcattgattcatttaaccaatattcaggtgactaccacatgcaataccacactcttatctaggcaacttgagtcactgagctcagtccagaatcttgatgactgaatggaaacaccaaggaggtgggtggctcaagagcacgagagctcttgttccattttcttgcagtttctttgtaagcatggaatcttttaatgtgtcctgtggtgtttagattgctcatagaccctaacattagagttaattcttgttcagttttggtagattttagttccattggagactaatgagaacactgaaaacaaagcaaaaatagaagaatagttattctattggcagaaatggcaaacctagttataagttatcaaaattagaatgtaattaaagttattctgatagtgatactgaagctatttattctcatagtactgttttatttatgaatttgagctattgttattatgcaaagctaatatttacatgtttttgttttgttctgttttactttttccattatttttctaggcaaggaatatcaagtaataatcatctaggcaatggcatctattttttttttccataggtctcatagtgttaagatttcctttatggtcttactcttatctctctgttttg

SEQ ID NO: 783 - DNA, 1442 bp, Homo sapiens
gactctgtcacaatcaatcaatcaataaggaaaatgtggaaatagcaaagaataaattctacataaaaaagttaaggacctcgaatacatgtaaaatatatatatactatgactaacttcaggagtcataggaatgtcttgaaaggatacctgggtttgatgagagtttaaggcaaaattgaacaagcattcctaaggaaaggcaggcactgagacaaatccaatatcgataccaagaagcagtggccacggatgtagcttctggtttatatcgtgttatggccctagtatggagactagactgcccccaaatttagttcagatcttgagatagatgacaccacatgcaaaccgagaggatacgagaagttccgtaactcactagtgagacttctgagtctcattacagcaaaataaacctaagccagtctgaaaatggcacgagaatgcacggatagaagactggcataggtttttatgatgttaaggggatggaactgggtagcagcttcctatgccatgacagcagcatgtgtggtttgaaattataacttgtgtcaaagaagcactcagactttcttaccagcttgcccagaatgagggataaaagggtagtgggagagttgacgcttaaaagccatcagcagccaaatatcaaaaattgaggtcctatatgatacactgaatctgattaaaatgcaggtgtccgcatttggtacaacgttcgtcaaagaggatgaggttaccgggattgtcactgatgtgtttaaatgactgcgccagcctccagagaataagatctgtattcattgattcatttaaccaatattcaggtgactaccacatgcaataccacactcttatctaggcaacttgagtcactgagctcagtccagaatcttgatgactgaatggaaacaccaaggaggtgggtggctcaagagcacgagagctcttgttccattttcttgcagtttctttgtaagcatggaatcttttaatgtgtcctgtggtgtttagattgctcatagaccctaacattagagttaattcttgttcagttttggtagattttagttccattggagactaatgagaacactgaaaacaaagcaaaaatagaagaatagttattctattggcagaaatggcaaacctagttataagttatcaaaattagaatgtaattaaagttattctgatagtgatactgaagctatttattctcatagtactgttttatttatgaatttgagctattgttattatgcaaagctaatatttacatgtttttgttttgttctgttttactttttccattatttttctaggcaaggaatatcaagtaataatcatctaggcaatggcatctattttttttttccataggtctcatagtgttaagatttcctttatggtcttactcttatctctctgttttg

SEQ ID NO: 784 - DNA, 4028 bp, Homo sapiens
gagagagagagagagactataaagcatgaaatcaaagtgaacttcagctactcagttatgtagaaagacaaaaaacattatcatataaggatatgttattcatatatcttagcatcaacaaaaatccatacttgggggtagttatcacataaaaataaatttaaatttattttttaaagtttacaaacttataataattactattttattcttcaagaatacatgaagccgggcacagtggctcacacctgtaatcccagcactttggaaggccgaggcgggcagatcacctgaggtcaggagttcaagaccagcctgggcaacatggagaaaccccgtctctactaaaaatacaaaaattagctgggtgtgatggcacgagcctgtaatcccagctacctgggaggctgaggcatgaaaatctcttgaacctgggaggggagatcgcgccactgccctccaacttgggtgacagagtgaggctccatctcaaaaaaaagagtacatgaaaagttcccaaatcataaatcaaaaaaaattgtttgaaagtttatttacaaccaacatctcatttccccgtaagtctccatttcttctcatatgcactgcagataacaaaaccattgtaaactctatttttctccccttctcactgtgatgtttcataagtaaaacctagattttcccagtgcagacctccattttactcttgaagacataggtctggtaacttgtggctaggaaaatgaggaatagaaaaataaacattttgatgcctgattgtttgatattttaaacaattgattttgagagtattaatatttttaaaaagatagtaaaaaatggaatttatgtgtgccaaatcatttttgtaatcaggccttcttacacacacaataatatacacacatgcacttatatacacagttctagtttttgttcctgtgttgtttactatggcattaagatataatcaaaataaatgatttgaatgtccatgaagagagatgattgactaagtcactagtcacgggatgcattttcattacctattaaaagatttatgttacataaaaataatttatcaaaaaaccagtagggactcattggggaaaaaagtatcacctgtatgcataatttgtagatatttgtgagagactgtaccaaatttttacttgagatttaaaattaagttcatacactttttaatatttcacttactgtaattgcatgtgttacattgacatttaaatgtaaacttccagtaaaaagaaaaataagaaagtaagttaataaatgagtgtatgtgttggaagggaaaggaattttgagagcagtctgagctctctgctgatctcttggtctaacacaatggaatgggatgtgcacccgtggagtaaatctttggacctacctcacctagcacacataacacattaggaattaatcacaacagttctggtccagataatatatcatgatccatatttgaatacaaaatctttcttcccatattagtagggtgtagaatatgagaattgcaccaatgccttgagattttagcaaatattaataacaagaggtctgggattttggtacttggcaccctaggctgacctcagcattatcaaggtgagtatttgtgccagtaactcaagtggttttgagagcagcagataaaaaacatagtggatatatgtaatagctaacaagacttttgtgtgaacacgagggatcttcaagaggtactgcaaaataattagatgtgtgtgtttgtgtattgctgtgtgcctgttggtgtgtgcatcagtgtgttttagtggaaatgaaaatttcacaatactatgtgaggacaagtgtcagtgaaattaagaactatgaagttaatcaacacaaaccaatttcgaactctcagtgggtaggcctaggaaacattgttcacaaatgtaaaattgatttgattgaatttttacttgaaaaagaaatgttgcttttattataaaatgattctgttcaatagaaaagagaaaggaagtgaattcctttacacattgaaaaattttagttattactatttacctggcacttaattccttaatctctaagttattactatattgatttaaatattattatacaattgtgtagattttagaaattcttcaactttgaaatataggaaattcatcaatggaaaagcccagagctgatagaaattttcattagaatcaaccttatttaatttctatttgagtttctactatttgctttgcactgagttgggagctcattatccagtagaatgcaccagacagggtaggctgttatacaaactggaaaacagcaccatcagcattcacggggagatcccagcaaagtgtgtgaggtcaggaaagactactttcaggaatggcctttgagatgaggcatgagtgatgggcaattgtggaggaagagtgctccaggtaaatgaactatcatttgagaaacacaaaggaataaaaaatgtgtgaggcacagggaggggcaaggataaaaacaaggaacaaggaagaagaaccttgggtcatggaggccatactgaagtcactgttctccttcataaaagcaaaatacagaccctgaagagagggagagagagagagaaactctgtgtgtgtgtgtgtgtgtgtgtgtgtgtgtgtgacagagagagagaaagagagcgtagcgtgtgtgtgacatagagagagagagacagagacagagaaattgaaatataatacatagtgtattataggttctcgactaattttcccaagcatctctttgagctgctggggaaatacgtataaaagtttgtcccaagagagagaaaaaaaagtttctgtgtgaggaaaaagaatttaaaaaccacacaaacaccatacacagggtaagcgatacaagaatgatgattcttttaatgaccaacataagtaaagataaagagattatgcgaaatacaggaaagtatctagtattgctgtcagagagaaaactgcatgaaatatgtatttcatagttctattgtttaaatacatcttatctatgtgatttagaaataagcatttaaactacagtgtaacaacttgcgagttattttggtcttgagggtgcatgtgtcttaagaagttgccaatgttatgcattccactttactgcttgtgaggcttagagcaaattatcacatttgcttagagcaaattgattttttcattcatattaatagtatctatttaataaatttgatttaatgattagacatattttaagaaaaatgcacattacgtaggaggcacttggtgtatgtcaggtgtactattgctttattaattaaaaaaatatttttcctagtactgtcttgatctgagtggtataattacttcttatgcataaacatagagaatgaaaattttgcagagatgttatcattttatcccactacttttccttacatgttttataaaactgtataaaatatttattttatcactctactgtttaaatacatcttatctatgtgaattatgaatatgcatttaaactaaacactgtaacaacttgtaaatcattttggtcttcagggcacatgtgtcttaagaagttgccaaaaaaatgcataaggcttttctagcatctcaggtgaaattaggaatatttaattacatgtcattgaacattaacaaaataatgtaaaggtatgccatgcaaaatgcacttaaattgtattcttgctttatatagaacacaatatccaaatagggaaaactgcttaaattaaccaagtaactagcattcatgtatcataacatttatttttcctatttattgtttggaattagaagttttctcatagtataaaaatgttaaatcatagtgattttgcttttgcatgtggaaacataatcagaatctctaactaccaacaaagatcaaaagtgccattttctctcaaaagtctacatatgtttgtaaggagggaattttcatgaaggcatgaattttac

SEQ ID NO: 785 - DNA, 11693 bp, Homo sapiens
cctggctcaaaagctcccctactgagtaccttgtgacccccactcctgcccgccagagaacaacccccctttttcctttacctacccaaatcctataaaacagccccatcctatctcccttcgctgactctcttttcggactcagcccgcctgcacccaggtgattaaaagctttattgctcacacaaagcctgtttggtggtctcttcacacggacgcgcatgaaagaaattactttttttcaagaatgagttcatgtcctttgcagggacatggatgaagctggaaggcaccattctcagcaaactaacacaggaacagaaaaccaaacaccgcatgttttcactcataaataatacatgaagccgggcacagtggctcacacctgtaatcccagcactttggaaggccgaggcgggcagatcacctgaggtcaggagttcaagaccagcctgggcaacatggagaaaccccgtctctactaaaaatacaaaaattagctgggtgtgatggcacgagcctgtaatcccagctacctgggaggctgaggcatgaaaatctcttgaacctgggaggggagatcgcgccactgccctccaacttgggtgacagagtgaggctccatctcaaaaaaaagagtacatgaaaagttcccaaatcataaatcaaaaaaaattgtttgaaagtttatttacaaccaacatctcatttccccgtaagtctccatttcttctcatatgcactgcagataacaaaaccattgtaaactctatttttctccccttctcactgtgatgtttcataagtaaaacctagattttcccagtgcagacctccattttactcttgaagacataggtctggtaacttgtggctaggaaaatgaggaatagaaaaataaacattttgatgcctgattgtttgatattttaaacaattgattttgagagtattaatatttttaaaaagatagtaaaaaatggaatttatgtgtgccaaatcatttttgtaatcaggccttcttacacacacaataatatacacacatgcacttatatacacagttctagtttttgttcctgtgttgtttactatggcattaagatataatcaaaataaatgatttgaatgtccatgaagagagatgattgactaagtcactagtcacgggatgcattttcattacctattaaaagatttatgttacataaaaataatttatcaaaaaaccagtagggactcattggggaaaaaagtatcacctgtatgcataatttgtagatatttgtgagagactgtaccaaatttttacttgagatttaaaattaagttcatacactttttaatatttcacttactgtaattgcatgtgttacattgacatttaaatgtaaacttccagtaaaaagaaaaataagaaagtaagttaataaatgagtgtatgtgttggaagggaaaggaattttgagagcagtctgagctctctgctgatctcttggtctaacacaatggaatgggatgtgcacccgtggagtaaatctttggacctacctcacctagcacacataacacattaggaattaatcacaacagttctggtccagataatatatcatgatccatatttgaatacaaaatctttcttcccatattagtagggtgtagaatatgagaattgcaccaatgccttgagattttagcaaatattaataacaagaggtctgggattttggtacttggcaccctaggctgacctcagcattatcaaggtgagtatttgtgccagtaactcaagtggttttgagagcagcagataaaaaacatagtggatatatgtaatagctaacaagacttttgtgtgaacacgagggatcttcaagaggtactgcaaaataattagatgtgtgtgtttgtgtattgctgtgtgcctgttggtgtgtgcatcagtgtgttttagtggaaatgaaaatttcacaatactatgtgaggacaagtgtcagtgaaattaagaactatgaagttaatcaacacaaaccaatttcgaactctcagtgggtaggcctaggaaacattgttcacaaatgtaaaattgatttgattgaatttttacttgaaaaagaaatgttgcttttattataaaatgattctgttcaatagaaaagagaaaggaagtgaattcctttacacattgaaaaattttagttattactatttacctggcacttaattccttaatctctaagttattactatattgatttaaatattattatacaattgtgtagattttagaaattcttcaactttgaaatataggaaattcatcaatggaaaagcccagagctgatagaaattttcattagaatcaaccttatttaatttctatttgagtttctactatttgctttgcactgagttgggagctcattatccagtagaatgcaccagacagggtaggctgttatacaaactggaaaacagcaccatcagcattcacggggagatcccagcaaagtgtgtgaggtcaggaaagactactttcaggaatggcctttgagatgaggcatgagtgatgggcaattgtggaggaagagtgctccaggtaaatgaactatcatttgagaaacacaaaggaataaaaaatgtgtgaggcacagggaggggcaaggataaaaacaaggaacaaggaagaagaaccttgggtcatggaggccatactgaagtcactgttctccttcataaaagcaaaatacagaccctgaagagagggagagagagagagaaactctgtgtgtgtgtgtgtgtgtgtgtgtgtgtgtgtgacagagagagagaaagagagcgtagcgtgtgtgtgacatagagagagagagacagagacagagaaattgaaatataatacatagtgtattataggttctcgactaattttcccaagcatctctttgagctgctggggaaatacgtataaaagtttgtcccaagagagagaaaaaaaagtttctgtgtgaggaaaaagaatttaaaaaccacacaaacaccatacacagggtaagcgatacaagaatgatgattcttttaatgaccaacataagtaaagataaagagattatgcgaaatacaggaaagtatctagtattgctgtcagagagaaaactgcatgaaatatgtatttcatagttctattgtttaaatacatcttatctatgtgatttagaaataagcatttaaactacagtgtaacaacttgcgagttattttggtcttgagggtgcatgtgtcttaagaagttgccaatgttatgcattccactttactgcttgtgaggcttagagcaaattatcacatttgcttagagcaaattgattttttcattcatattaatagtatctatttaataaatttgatttaatgattagacatattttaagaaaaatgcacattacgtaggaggcacttggtgtatgtcaggtgtactattgctttattaattaaaaaaatatttttcctagtactgtcttgatctgagtggtataattacttcttatgcataaacatagagaatgaaaattttgcagagatgttatcattttatcccactacttttccttacatgttttataaaactgtataaaatatttattttatcactctactgtttaaatacatcttatctatgtgaattatgaatatgcatttaaactaaacactgtaacaacttgtaaatcattttggtcttcagggcacatgtgtcttaagaagttgccaaaaaaatgcataaggcttttctagcatctcaggtgaaattaggaatatttaattacatgtcattgaacattaacaaaataatgtaaaggtatgccatgcaaaatgcacttaaattgtattcttgctttatatagaacacaatatccaaatagggaaaactgcttaaattaaccaagtaactagcattcatgtatcataacatttatttttcctatttattgtttggaattagaagttttctcatagtataaaaatgttaaatcatagtgattttgcttttgcatgtggaaacataatcagaatctctaactaccaacaaagatcaaaagtgccattttctctcaaaagtctacatatgtttgtaaggagggaattttcatgaaggcatgaattttacttttatgattatcacttgctgtataagaaactactttattcatatatttgttgtctgcataaatgtcttcttttgagaagtgtctgttcatatcttttgcccactttttgatagggttgtttttttcttgtaaatttgtttaagttctttatagattctggatattagccctttgtcagatggatagattgcaaaaattttctcccattctgtagattacctgttcactttgatgatagttgttttttttttgttgttgttttttgtttgtttttgttttttttggctgtgcagaagctctttagtttaattagaccccatttgtccattttgcttttgttgccattgcttttggtgttttagtcatgaagtctttgcccatgcctatgtcctgaatggtattgcctaggttttcttctagggtttttatggttttaggtcttaggtttaagtcttgaatccatcttgagttaatttttgtataaggtgtaaggaagggatcaagtttaagctttctgcatatgactagccagttctcaacaccatttattaaatagggaatcctttccccattgcttgtttttgtcagttttgtcaaagattagatggttgtagatgtgtggtgttatttctgaggtctctgttctgttccattggtctgtatatctgttttgttactagtactatgctgttttgattactgtagccctgtaatatagtttgaagtcaggtagtgtaatgcctccagctttgttctttttgcttaggattgtcttggctgtgtgggctcttttctagttccatatgaaatgtaaagtagtttttttccgattctgtgaagaacgttaatggtagtttgatggggatagcaatgaattttcacaatatttattcttcctaaccatgagcatggaatgtttttttcatttgtttgtgtcctctcttatttctttgagcagtggtttgtaattctccttgaagaggtccttcagatcccttgtaagttgtatttctagctattttattctctttgtagaaattttgaatgggagttcactcatgatgtggctggtcattagagaaatgcaaatcaaaacaataatgagataccatctcatgccagttggaatgacgatcttaaaaagtcaggaaacaacagatgctggagaagatgtggagaaataggaaggcttttaccctgttggtgggagcgtaaattagttcaaccattgtggaagacagtgtggtgattcctcaaggatctagaaccagaaataccatttgacctagcaatcccattaatgggtatatacccaaaggattataaatcattctactataaggacacatgcacacatatgtttattgcagcactgttcacaatagcaaagacttggaaccaacccaaatgtccatcactgatagactggattaagaaaatgtggcacatatacaccatggaatactatgcaggcataaaaaaggatgagttcatgtcctttgcagggacatggatgaagctggaaaccatcattcccagcaaactaacacaagaatagaaaaccaaacaccccatgttctcactctttggtgggagctgaacaatgagaacacatggacacagggagaggatcatcacactccagggcctgtggggggtagggggttaagggagggataacattaggaaaaatacctcatgtaggtggcgggttgatggtggcagcaaaccaccatggcacatatatacctctgtaacaaacctgcacgttctgcacatgtaacccataacaaagtagaacacacaaaaaaagtcaaaaaataaaagatgctggagaggttgtggagaaaagagaacacttacacagtcttggcaggtgtgtaaataagttcaaccattgtgggaagaaatgtggcgcttcttcaaagagctaaaaacagaaatttgacccaacaatcctattattgggtctatactcaaaacaatataaatcattctactataaagacatacacatgaatattcattgcagcactctttacaatagcaatgacaaggaatcaacccaaatgctcatcaatgacagactggataaagaaaatgtgtacatatacaccatggaataatgtacactatgtagccataaaaataagaggccaggcgccatggctcacgcctgtaatcccagcactttgggaggctgaggcgggtggatcacgaggtcaggagtttgagaccagcctgaccaacacggtgaaaccccatctctactaaaaatacaaaaattagccgggcgtattggcgggtgcctgtaatcccagctattcaggaggctgagacaggagaatcccttgaacccaggaggcggaggttgcagtgagccaagatcatgccattgcactccagcctgggccatagagcaagactccatctccaaaaataaataaataaataaataaataaataaataaataaataaataaaggaagaagaacaagagtatgtcttttattgaaacatggatggaactggaggctattatccttagcaagctaacacaggaacagaaaaacaaataccgcatatcttcacttagaagtgggagctaaatgataagaacacatggacacaaagaagggaatgacagacactggcgcctactggagggtggagggtgacaagagggagaggaacagaactaaagttaagcctcaaagttaagcttcaatcacccacagtggtagctgttttcacaaattcacttacattagccattatttttctgtctcttctcatatcaccttcgctcccaaagcattatatatcccacctttgtaacagacgcatttcacacagatctttgcttctgggaaattcaatcatagacacaccctctgtactctttcttttgtgggccattgattaagatctgctgggcagcttaatactgttccgtggattatcaacagggaagctctactggtccctgaggatctacattcaagttgactatggctggcagctgtttgctggattgactcttccagtaggcagcggggaggttcctctccatagggatttctctataggctgcttgtgctttctcacggcatgatggctggactccaggagacagaactgggcctggaaactagcacagagtcacttctgccataaaattctcacagcagtccaaaactctgatcagattcaagaggaggttagagaaaacatcctgaatgccactgtgaacactcttattgacttctctcagattttctcattgttacataaagggatgtattgttacatgaagttctttcagccttcgttaaaactctctagaagcattctgtattaggactacaatcagcagtcatggtttgtatgcttcataatcatttcactgggtttacttttcaatatccctagggtattaatcttttgaaaactcacttgcagtggagatgattccattgtaaaatgtttcttcattcccaatagcacaatatagtaagtagtaggtctattttcatgctgtatcaactaatttgcaatcatagcagatcttaagatttcttcttccaagatgtcttaacctgccaggggttatattcattcaattaatgtttgctgtgtgaattaattccattgtggttttgctaactcctattttactaaaagtctccttgaaccagagtgtcatgttgtttgtttcttgacatctaatgagaggtcagaggaaatgatttctgagataccttcttaacctttcaaagtccaacatattttatgctactgtctcaaactaatttttttaaccaaggcattaaattgaaaataccacagagggttattatgaaaatatttacttttctcaaaacatgtgaaaatatgatgttttaaactttgtgggaaaggtattgtttacagcaggattgagaggaaagcaattagatttttaatcctgctctctcactccctttataaaattggaaaatttatttaaaaattttgtgcctcagtttcttcatcagcaaaactgttaacacatacaactctgtgtatgtacatgtatgtttataatcagtcacactaaataatgcacctatgaatgcaggatttatttattaattatttcacagtttacaagaatatgtagttcattcaaaattattacaaatgaaaaataattcatatagacacaggatcatatagtctgacataaattgacaacagatgtgaagatattgttgatgcttggttctgacaatggacaaagcaaagctaaagttaaatctaatcttcgattatttcatgttgctgtgctttcaaaggcaaagcaggggaagtcatgccacagggcaagagctaaagcaagacagagaaggggaaggtccagactccttaaaccaccagatctcacatgagctaactgagcaaggactcactccttatcttcgggataggactaaggcattcatgagggaccagttgtcatgacccaaacacctcccactaagcccactgccaaattggaggtcacatttcaatgtaaaatttgaaggggacaaaacatccaaacccatctcattaatatccatacccattctgttcttcagacatctgctgatataaattagaaaattcaagcagttcttttggagcatagacctgctcgtgggtagcgctcttagccacacttccacacttccaggggcctgctgggacttgagtctagttacaggtctagaagcaaagaagggtgatgggggtggtccctgaggagaatcagcattgacttgtctggcaactgtctcaggggaagctattactatttcctcaggcaatgcagggttaatatcctcagaaaaaggtggaaaagctgataccattctgggtcagggaggggatgttgccatcatggaatgtagagaggtctcttcctctggcaaaattagctcatcagaatttaggagctctgtgtccccagcttcatcagggtcctcccatatatctccattccaaattacagggtccatttttttcccagccaatgctctcactttaacagtaaacactcagcaaggctgagagttcaccatttgttgttagccagccactcacagataagagcttgtgtttgatttttcagaaatttaaaccctttgtctacagaagagaagattctcactgggcacccttagaaacttttaggctaggtatgtgcctctgcagcaaggagttagaatcccttagctcatctttatctttcttcactttgtccagtgaacttaggaccaaccaacttcattatttcttggttttccacaaatgttcgaaagtatcacgtatacagtcactaaattcctttcttctcagtagtagtgaaccaaaagtatcacatgcatttattttgcataactctaaaaacagctcaagctagggactgtcaatgttctctgtactattagaagcagagtccttagagtttttaggtttagtcaaattagagagccaacttctaaaacccaaaaccaactaaggaaattcatccttaaacttctatttccctagaacctgtataagccagttcctcatatcaaaatctgtattagtcacagttctccagagaggcagacacaataggatgtacacacacacacacacacacacacatatatatatatgtttattaggtaatagatttattatataagttaaaggtctacaggcaaagaggtgtggtgaggttgaatcctgaggagaagcagcattatcttgcctggcaactgcctcaggagaggctattgctattttctcaggcaaacatttatatatatatataaaagtttattagggagaattggctcacagaattacaagataatgttccaaaataggtaatctgtaagctggggaaagagagaagccagtagcctggctcagtccaagtcccaagtctgaaagccttaaaaccagggaaattgactgtgcagccatcagtctgaggtagaatgcccaagagtcatgcacccgagatgggtgcacttctcagcatctgaaggtcaaacaacctggagtctgatgcccaagggcaggaggagaggaagcaaaccatctggcacagtggggaaagagagatagcaagcagacccagcaagcaagctacttatcaccttcttctacctgctttattctacatgcactgggagccaattcaatggtgcccacccacactgagggctggtcttcctttcccagtccactaactcaaatatcaatctcctccagcaaataccctcacatacacacccaggaacagtgcttcatcagccatctaggctccctcagttcagtcaagttgatgcctgttattaacaactacagtcttctttgtccaaaattgctcacaattgctttataataaaaattgagtcaactttcaacaggattttgtaattgagttctattcactaaatcatctacagaaacagtggaaatgtaaataattaggcaatgcttagataaataattgctcctctgagcaattgtctttcataaacccatcaaaagcaatgttttataaagtacataatgccataaattacatgaagatgataacttatgaaaaagcaagaaatatgtcatctgaaaaggttttaaatgtatacagagccaggcacagtaatagaaatttcacatcttcttacttatgggggtctgactcacagaccctgacccaacaacagatgaataaagtacactgacacacagatattctgctttgtcagtccaactgagcgtccgggccccttaacagattccaagcagagtgctgtaaacagttgcaaccacagccctgaccagccagtgagactcacatttatttagtaaggattaattgacaaaggcttgagacaaccccactagagggtaattgatattgcagacttccggagtagaaagcaattaagcacccgtggtagatcaaaggttagtcttaggaccacatgagtaaacaagctagttagacaaactccccacattcctttgtttctactctaatttatttaattaaagggacaaggctgccttcagccaagtactatatgtaaaaactcccaggccttcctaaagggtttgtgtatattctctgtagctaaaatttttcccaccatcatgactgaacccccacaatcacttatttgttggagctaaaaattaaaacaattgaacccctggtgatagagagtggaatgatggttagggatggtcaatgggtacacaatataattaggaagaatgaataagatctaatatttgataacacaacagagtgactgcagtcaacaataacttactgtacatttaaaaataactaaaagagtataataggattgcatgtaacacaaagaatggacaaattcttgaggtaatggatactctatttacccagatgtgattattgtgcattgtacacctgtataaaaatatctcatgtaccccataaatatgtatacctac

SEQ ID NO: 786 - DNA, 749 bp, Homo sapiens
cccactcctgcccgccagagaacaacccccctttttcctttacctacccaaatcctataaaacagccccatcctatctcccttcgctgactctcttttcggactcagcccgcctgcacccaggtgattaaaagctttattgctcacacaaagcctgtttggtggtctcttcacacggacgcgcatgaaaggtaatgtttttcatatattttaaaaaatacacaaaagttaattgtggtttacaaaaatacctaagtaaggtaacgtttttcattctacatattctaaactgtttatactgtattgaatgtattagccctggggtctactcatggtctcctttgaaaaaactgaaacatgcctttacagtgaggtatggcggtgttcaggggaatgaaggaatggagggtcaaaaggaagtaaggcgagtcccacatacaattttccatgatctcaaaaagagcagaaatctcttgccagggtgggtggaagatgattgaacagctggatataagaataattggctttagagagaagctacagaagaagtgattcaggagaagattcaagtaaatatttctgtctacaaaaatagtaaattctggaagatgatgttagaatggtaggtagctccttgctttagttacctaaaaatgactaaggcagaaaacggaggaaatctttgtttttcttgaatgaagccattcatatacaacttttttgaacaacaaatgtttttatgatgggtta

SEQ ID NO: 787 - DNA, 2559 bp, Homo sapiens
aaagctggtatatttaggtcaatttcatattcctaggattgttccatgtttatgctacccagaaacttgccctgcctgcctttgcttttcatacacacacacagcttctgccatatatcacatgccatttatttttatttgtacaaatttacattaattttactacatacatatatattttaagcgttcataacaaacttagaaaatagcggatgaaatccagtacaccaatcatctagtcttagcaaatactattattttaccataattattccagatccttctttaaaaaaaaaatgttactaacataactaaagtaaccaaacataaccaccaaaccactgtctcaccccaatgctatccacttcctgccttattatactaacaatatcctgaagcgtatagaacttttagttaatatttttatattttaccacacatgtctatgccattaccaatatagataatgttctttggagtttttaacttacataagtgagaggatactgaccatgttcttcaacagcttgcttttatctcccaactctgttttcaagattcattcgttagtatatttataaatttcacttatttatgcagcattttatatgaacatattacaatttatctattccttcattgacagacatttagaggatttccagtttgcccctattctaaacagtgctcaggcaatgacctcttacataccttcttgtgaaccacagtaagaatataattagggtattgacctagaagtgcggttgctgtgtcacagggcatgttcatcttcagttgcaccagatactacaaagcagcaatccaaagcggttgcaccaatttaaatgcctgcctgcagggtacaagagctcccatttccccacatcctggatgatacatgttatttagacattctaatttcttttccaatccagtaagaacgacatggcaactcattatattcatttgcatccactctattgctattgagattaagggcttttactgtttttcttatatttcttggccacatggcttcattttctgtgaattgcctttcttatggtcctttcatggttaaaacagccctttagaagactcggattttaaggttggattagggcttgggatttgagagttttacaccatggccatgcctcgtttccctaagttatcattaaaatgctcagcctccacagcccatatccatgcatatcacccaggttgtcccagaacattcagaacttactgctcttgctttgaatgtcctggtaggttcccacttaggggtacctcctccctttctttgtccctctcttcctttcttcgagcttagtcacacttccaacttccacataaacaatttgaaactgtatgccaatctccccactctccaaaagaaaaaaaaaaaaaaaacaaaccttcataaccaacctaaaatccctggcaatctattgaattacaaatgaattttcatacaattatccatttcatatggttattcattatcgcaacagatatattcacacacaaatagcaaattcacaaagaatacctaaaaaggaaaagaataaacagcatgatttcctcaagtaacttataaatcactagaaatattcatcttattttttactttatcgaatactgcctcattctgttggttatattgaagtacgtatcaagaacatatttaagtattgtatgaaatttgacagatactattaatacaaaggaccttccatttgggaagcaagaaatcaaacaaggagagtgacacttcctttggagagttgttttgaaaattaaatgacattactgcatacgattaagtacttttggcatgtagtaggtacccagcaaatgttagcgtccctgctctttttcacaaggtagaggaagtaattaggtgaacagctacacaaaggcctaattctaatcagtaaaaaggaaatgactggggcagtaaaactgacaaatctcttggtaaaaagataaccacagaatcttaaagttgatgttggccaaatcgggaaaagttaggcattatgtttttgactttgggaagcaaatttccaaaatgtcagagaaaaatataggtgtcaaacctccaataggaaaagaaaaaacaaaaaacacaaaaaaaaaaccctcaagaacagaagaccctaaaatatgtacttatgtactttgacctgataaaaagaaatggagaagattcctaaatacttagggtattcaattaggataaaaggaaatcaaattgtccctgtttgcagatgacatgattgtatatctagaaaaccccattgtctcagcccaaaatctccttcagcaactttagcaaagtctcaggatacaaaatcaatgcacaaaaatcacaagcattcttatacaccaataacacaaactgagagccaaatcatgagtgaactcccattcacaattgcttcaaagagaataaaatacctaggattccaacttacaagggacgtgaagggcctcttcaaggagaactacaaaccactgctcaacgaaataaaagagtatacaaacaaatgg

SEQ ID NO: 788 - DNA, 2559 bp, Homo sapiens; identical to SEQ ID NO: 787

SEQ ID NO: 789 - DNA, 2750 bp, Homo sapiens
acagctgggttctaatagagctttatttattgacaccaaaattcaaattgaatacaatgttcttgtgtaacagaatagtgttcttcttttgatttccttcttaatcatttaaaaatgtaaaaattcttaactattgaggctgcacagaaacaggcaaaggcctggatctagcccatggcctgtggtttgctgacccctgggctagaagatcaagtaaacaaatcttgaaaaaataccaaaagagaaattgtcatagtgccccatccagtgccttgatcacagtaggtactcaatgaatgaatgaacagatactgagttccaggagagacagaagacacatgcaccccacatatcctagagctgagtctgctgctgtgggtaaaatacaaacactcccatctctccttttgaatgtgagaccgggcataatcacaggacgttcaggtgacccagagctcagactccagcgccttccacatttccctcaggctccaaagcaaaagcacggtataattacaagggccatgttgcagtttaggtcaatccagcgcatgttatctgataaatgaattccaaagccaagcgaaactctcagcagtctttccccaagatgctgggctcagcatcagcgttcagttctccttaattacaggttggcttgttttgttgcgcaatagtgccccagcccggatgaatgtcatttcctttcttggtaggtgaaatggatgaggtgagaaaggcccggaccacaccgagaatcgaatgcatggtaaacatagggccacggggaagtcttgacaccgctcggcaagatctctcaccgatggatccaccctctatgttttctgattggacacatttcctgagatgggaaggatcatgctattggctgaggctgcatcaggggagtaatatttactctggaaaatctgggagagggtgtcccagtctgtgaactacccagacccccacgttcacagaatactaggatgaggaggatcccaaggaacacctgcatcaactctcatgttctacaagggaagaagccaggtctcagggacattaaatcactttcccaaatgtaccaagctagttagagtgaagaaagatcctatttatcccagttcccagtgaaatgccatttctgctccataccttctcttctccatgtgtcctatgctctcgcactttttgtgctgcttagcgttttgcccagaggtgtgccagagattattgctcattctttctccttccacggtcacaacacctccctgggctggtgtcacctcttactttgcaattcaaaacgttgaagaaggtgcgacctgtctagattttcgtgtagccttctctcctgattgctgtttcagataacacattcagggtgttggtaaatagctgtgaatcagagcctcggggacagcctggtttggtgtgtggatagtctggctaatgtcatagcagtccctgccttaaatatcaatgtccgaggaaggtgggatgctgtttccaaaagattgatttgcacttctgctaatatatggctgagtgttctttaaaatggagtattctgcttgccctctgccaccttcacaacaccctaaatctttggaagaacgtgcttcttgttggacctacaagtggggagcatcttgccttgtccggcctgtcccagtttctcgggaacccttgaggtttctgtccctgttccacatacttagccccatctccaggcttcctgtccatcagcctgagagaccatactctaggagtcttaagtgctgagttccctagtgggaactcactggactgcaacgccccaagtccctccttctctctctgtgccttgggatgggctttgtgccagctgtgcccatcctgctgttctgcagcttggtgccccttcctaacgtgatgggcctctgctaaggtcatgttctttcaccaacccagggtccttccagctcctccaccaaaacagtgccctggttgtcctcacttgtcccatcttcagcagggaggcacttgattctgtggcatttggcactgctcactgggctttcttttcttttcactgtaagactcatgcattagatctgtcttgctatagtcctaacaatgtctctgtgtccccactcccattcaactcttgccattctccagccattgctcttgaagaatgtgggactaataaccctgggtagggtcacaaggctccaaccaagagcagggaagggccttgtgggaggtgagtgcattttggatatggggagcaaggctggtgggattctgctaacgaaactgatcacaggtgacagggctctcctttgaacttgattatttttaaagttcacctctccctgatccataacgaggtctggtgagacttgtcatagtcccagaattatttcgatcattccagctcagccgaaacaatgagagaacatcaatatggcaactcctcagatgtctgggaagagggatcatcacccaggcctgggagctctgcgcagttttgtctgccttggctccaaagtgctctttgcccttaacactgcaccactgtacagattcacacagctggcactagctccacagtggctaaggttgtgctgcttaggactgacctggaggagaggggagaaaaagatggtattagtggctccctttcatgtcaacaggttcactgaaaaaggagcaaagggcttagtcatgttttaatgctctcaaagcttactatgtatccagga

SEQ ID NO: 790 - DNA, 2750 bp, Homo sapiens; identical to SEQ ID NO: 789

SEQ ID NO: 791 - DNA, 2750 bp, Homo sapiens; identical to SEQ ID NO: 789

SEQ ID NO: 792 - DNA, 12569 bp, Homo sapiens
atttcaaacttagttatcaacatcttataaatttttactaatattttgagtctaatgaatcagtctctttacttaccttaaaaagcagaaaaatatacacaaaatactataatggttacaaaacttatttctagataaaatttatgactagacataacttagcttgtcttccaagggtctttgaaagtatgtttgttttctggcaataagaagatatttccagactcatcttgatatttcctgccgtaaaacatgcaatgaatttttctccagggagcccagtgccctcagggtcttctggctggaatgcagattagatggattggcaaagcagctgctggggccacaaggggaaaccagaaatccacagtaatctttgacctgacgtccttgagctgctgaaccaacatcccaggtttttaagtccctgtggtccatttgtcaaatgcaattccttactgatataatggttatacaaataaagaagcccagagaaagcactgcatatggaaaggaaagattgacctaaaggggaagatcttgtggggaggggaggcagtgaagaaaagaggaggcaggaaagggaactggggagagaggggagatctggcagtttctgtgaaagcaaattagtaaggattttaagaaaagtttgcctttattccattgccataatggggattagaacagtaacatccataggatcattgtgagaattatgccaagcacacattaagtgttcaataaacattggctatcattattattttattatgctgggcctccagaatggattagagttgcagactggaacattataaggaaatccaggaagtccattcattcttactctttccctccctctcctctcttccacaattgctcctctgcacagctgttttaatcctatatctttctgcagattggctttctttctatgtctgtgatgcttaaaacagtcactaacaacatctttcaagtttccaaactccttggttcaagacagcagccatttcgaagaaatttccagaaagacactgattgtccagcttagatggaaagtccactcttggatcaattaactgaagctatgacaggagagttgtatggaaaacacatggctgctcctactagaaaacttcccaaaatatgaaggagggaaaagcagggaggaggtgccgctgtgaagacgtaatggtaggtaaacatttgggtacatttcctttgggtccatgtgcacacgagtacgtttatgcatgtgtgcataacttggatagcactgtatataggttttgtttgtttgtttgattgttttagagacagggtctccctctgtcactgaggctggagtgcagtgatgcaatcatagctcactgcagcctggaactcatctgctgcactcaagggatcttcccacctcagccttaagagcagctgggattacaggtgtgcatcaccatgcctggataagttttaaaacaatttttttgtagagacagggtctcattatgttgctcaggctggtcttgaactcctggcctcacgtgatcctcccaccccagcctcccaagtagctggaattataggcatgagccactgtgcctggcaacagctgtctaaattattttttacaaggcattcagaacacattcaataagatatttttctacagcactgtatttattagctaggttaacatttccatatatagatgttctaagtgaatttaaattatttctattattttgcttttatgaactctatttgagtgatattcttgtaactgaatagttgaaactattattaactccttagggaaattccttaaattggaattgcgaggtcagaaggtgtgtcattttttaacagttttgatacattttgctaaatgtgccaggcaatttaagccacactcccaccacaacatacaaaatgcagtcttcctcaatatcgtcttcagtgcttagttgaaaattaatcaccatttgataagtgaaacaaaatttccttaattactagtaagattgaaggatagtttcatgtttttttgaccaactgtttttctattatattcttattggtttataagagcattttagccggacttggtggctcatgcccaatcacgctttttcaaatagtaaaggaaggccgacccagaaggtggagttaggaagtaaatcaggtccagctgtgtgtggataaggctccacagggatggctctgtgggtgcagggacccaagaactaaaaagacaagttatctgcctcccacattccttgtacaatgtgaggaggaaaaagataactacaatagagaatccctttcaaaaagtaaggatgagtgtatgaaatctgaataaggtttgcagtgcagtttaaacagttcatagtgtccagtgcttctgataggtcaagtaaagtaaggacgatggacgtggcaacatggaagtcacccatgacttcgaaaagcagttttcaatttaagtgtgtgaaagctttattgtggcgagttcaagtgtgaatggaagagatgggggcaatgatagaagcatagtttttggatcttcctgaattgctacataaaaatagcaactagatagcacaatcaaaaatcaaaagctgggagagctgaagactatcagtatctatgtgggaagaagcagagggaagaaaaaaaaaaaagcaaatgatgaattcagagtcagaaagtaggatgacggttgccacaggagaggggaagtggggaacagggagttccttaatgagttgttttgcaaattgaagagttctggagattggctgccaaataatgtgaatgttctatgcacttcctactactgaactgtacacctaaaaatggttaagtgcccggtgtggtggctcacacctgtaatcccagcactttgggaggccaagagagaaggctcacttgagagcaggagttgtaggcccaagccctcgggaggctggggtggaacaatcacttgagctcaggagttggaggctgcagtgagctacgatcacaccactacactccagcctaggcaagagacctcgtctcaaaaaaacaaaaaaaaatgctttactctaattctcatatatcaggacagggtgtcaccagcataagggcaggaaaaaggaagtgcggtccacagctttcagaggaagaagacaagctcggggtttcatatttatattctcaacaattagcacaacaatgggagaaggaatgtctttttaataaatggtgctgggaaaactggatagccacatgttgaagaacggaattagacttttatttcataccatattaaaaaatcaacttacaatgaattaaagacttagctgttaaaacccgaaactaaagctaggcaacaaaaatgtagacaagattacatcaaactgaaaagcttctgcacagcaaaggaaaccacaaagttaggagacaacctacagcatcagagaaaatgctcgcaaacaacatctgataaggggttaatattcaagatatataagaaactcaaaactgctcaatagcaagaaaacaacccacttaaaaagttgacaaagcacctgaataggtatttctcaaaagacatacaaatggccaacagatacatgaaaaagtgctcaagtcaggctgggtgcagtggctcgcgcctgtaatcccagcattttgggaggccgaggcaggcagatcacttgaggtcaggagttccagacgagcctggccaacatggcgaaaccatctctacccccaaaaatacaaaaattagccaggcattgtgacatgcgcctgtaaccccagctactcatgaggctgaggtgggagaatcacctgaacctggaggctgacagaggttgcagtgagctgacatcgtgccactgcactccagctggggtggcagactgagaccctgtctcaaaaaaaaaaaaaaaaaaaaaaaacaaaaaaaacacctaaaaacctgaaagtagaaataccatatgatccagcaatcccactaatgggtatatacccaaagggaatgacatcagtatgtcaaagagatatccatacccctatgttcactgtagcattattcataatggccaagatatagaatcagcccgagtgtccacaaatgaatataaagaatatgtggccaggcacagtggctcacacctgtaatcccagcactttgggaggccaagacaggcggatcatgaggtcaggagttcgagaccagcctggccaacatggtgaaaccccgtctctactaaaaatacaaaaattagccaggtgtggtggcggccacctgtagtcccagctgctactcgggaggctgaggcaggaaaattgccttgaacctgggaggcagaggttgcagtgagccgagatcatgccactgcactccagcttgggcgaccaagcaagactctaactcaaaaaaaaaaaaaagtgagctgggcgcagtggctcacgtctgtaatcccagcactttgggaggctgaggcaggatgattgcttgaggtcgggagtttaagaccaacccgtgcaacatagtgagaccctatctgtataaaaaatacaaaaattagccaggcttggtgttgtagcctgtggtcccagctgctcgggaggctgaggcaggaggattgcttgagtccaagaagtcaaggccaaaataagccatgatgtcactgtactccagcctgggtgacagagtgagactctgtctcaaaaaaaggaaaagtggtatatatacacaataaaaaattcagcctcaaaaagaaggaactcctgcaatatgcaacaatttggaggaacctagaagacacggttaagtaaaataagccaggcacaaaaagacaaatgcttcatgatcttactgatccatgaaatcttaaaaagtcaaacttcctaagtttgacttaagagatgcagagtgtaaaggtggttactaggggctggaggtgggggactgggcgaggggggagttcagggtgatgttggtcaaagaacacaaaatatcagccagaagttcaggagatctactgtgtaacacggtgactagagttaggaacctggcactgtaccttaaaaattctgagagtaggccgggcacggtggctcacgtctgtaatcccagcactttgggaggctgaggtgggcagatcacctgtagtcaggagttcaagaccagcctggccaacatggcaaaaccccatctctactaaaaatacaaaaattacctgggcatgatagcacatgcctgtaatcccagctactcgggaggttgaggcaagagaatcgcttgagcctgggaggcggtggttgcagtgagccgagatcgcgccactgtaccccagcctgggtgacagagcaagactctgtctccaaaaaaacagaaaaaaaaaattactgtgagtagattttaaatgttctcagcacaaaaacatgaggtaatgcatatgctaattagcatgatttggctattcctgaatatatacatatttcaaaacatcatgttgcacaccacagatatatatcttttatttgtcaattaaaggatcagcatagactccatgaaacttgagagacctgattaacatctgaaggcaacatctctgcaaaacaactaacttgagtactttaattatatatgtatctagcagaagagaaaaaaacaacacagttttaattttaaattttattaaagtacagagttaacaagttttgagttttttatataggaaaagcctagtcaattcagatgctttctagaaaaattaacattaaaaaacaaatagaaatccatgactaaagggggaaaataactttcaaaagttaccaaaattcgaatcatatcagagaccattataaatttcaaacagtagatttaccacacatattgcattttcaaattctaatgtagcaaaacgtaaccacataatttggctacagctaatcgtttcagaaaagtttaaaaaattagcaaagttatatctataaaacttttgtagttttctttttgcaaagtaaaaaggcttaaatctttaataaaggaaaacaaaacaatcctcttaaatttcttataaatagctctccagacatatattacaaatctgctgtaagctttctttacctgagagaacttcccaggatcctttatcccaaaggattaccttaaagagttcttccatcattttactcatgtgaatatgattaaactcctatagaagtggattgggacatatgcattcttaatctgcccttccccatttgtttctttctgaaaggattttgcttaaggaaaaaaaaagctctttggtaaaggccaaatatttcaacctttcaaaatgactgcctctgtgaaagagttgttgagaaagaagaaaagagagagagagagaaaggtctaaacatctgtgtgaacagctctccagtactgtgaagtcaaaggcccaacattacagagcgcacctctgcctgaaatacaaaactaagttaactagcaagttacaggaaatagccttcagtaaattccacaagccaagtggctactgcattgtccctgaagaaggagggcccagtgttctttctgggtgtgtaaggtcttacttagttcaaggtttgtcccttcttagttgtaggttgggccctctttcgtttccaagaggtataggacactagagtacaccaaatgagatactatttggaaaggcaataaagggagtgtaaaagcctaggtagcttaaatacaggctctggaatttccttcgcaggaaggtgaagcaccaatgatggcaaaaattaaataaatacatcatcttaaaaaggcagagggtaggctgcgtgcagtggtttacgcctataatcccagcactttgggaagccaaggcgggcacattgcttgagctcaggagtttgagaccagcctggacaaccccatctctacaaaaaaataaaaatcggccaggtgtgatggggcaaacctgtggtctcagctacttgggaggtggtccttgagcccaggaggtcaagcctgccatgagtcaagatcatgtcactgcactccagcgtggctgacagagtgagcccgtctccaaaaaaaaaaaaaaaaaaaaaaaaaaaggcttagggtgacaattttgacatggggacaggaaattaacattacactgaggttattcataataaaggatcttctgaggaatcggaaataaacaatgttgtatggaaacagaaccccaaaaccccaataactccaccctccccacaacccacccccactctatctccccttcaaagaggctccaaatacctctggcaaataatttctttttcagacaaaatgaagaacctttttgcccaagaaactgtgggcaaaaataaaactaaccaatcagtatttaaaaagctagacacagtaaagacgtggttgggtttctgaaggcttataatggaaatagtctctagtctccagtcaggtaacatgccgcggtatgacactcccataagaacccccacccccctgccacccacttagtgtttttactcataaaaatgaggggaaaacttttctacatcagacaaatcacacagaggaaatattcacatgcagctttaaaaaagtcctcttcaactgtcatccctaaatgtgtctgaccagcagcttctgggaatatactctttaggtcatgtacaaaaaggtgtaggaagcaaatgtctattatttttaaaagatatcagtgagttaatcaaattaacaccgttgttataggaactcaaagccattggcacaatgtttccagtttctcaaatcacaattgcacaaaactgtagattctttaaatccaggaatgttgactcctcacctgagtattgtatatcacaattaataaccattaacattaactctgcattgatagtccctcaatcctcagatacatccacatctgttttgttcatccagatacacgtgctaacattttcagctgagaataaaattcagagcaactgtaactcttcctcttgcatcagaccaaccggcagaagggaacgggatgtcacaaaccagactcacgcatctggaaaacgttgtgtggctgggctggctccagaaggaagcgacgagggccttctaccggccacactcccttgcttgggcttccctaagctgctttctgcagaggaaagggccaatcacggccagccaaggaatacaaggccttgtcagctggaccttgactgcgcgtaaggtcagtttctcaaatcacaccagctggcagccagacccagccgagaggacaaagcaagggctctgctagacctcagcaggaggaaaacaatgaaactagtcacaatactgcccaggctctttacctgcttcccctcagggtgtttcctaaagacaacccccaaggccctaggccactgcaacacagctactgtgtgtgacacgcagccccactccctgagcccattcctggcccacggaactcctgtcccctaactgattcctcaggttagaacacggcttttcattttgcgactccagatgaatcttttaactgctgagtacagagctcctgccctaaaaaaggaaatttaatggaatttacaaaacaaggctctctaaaccacacacacagatggagtgccttttgaaactgaatctcaaacactctaagtagggaaagttctaaaggaattcatcccctgtaatttgtttccccatgggttttcttgggagaagggcaaaggaatgaatagaaagaatttcactaatttcacccaccagcattttggcacacagaagcccagcttaggtggcactcaattctgcccaactcatacagtagggcacagaaaaaaatgactaggctgagccttttattcttagatcctcacttacagagagctcgagaagattctttccaccccgaatgaaattctaacaggagtttccaccaagtaaaccttttccctgcctgaatacatcaacactgaaaataggcatcatcttgggtagctgccgaaagtcacgtttctgtattactttgcaagtacgtattttggaaattcctgtgcagcgtgatctcggctcactgcaacctccgcctcccgggttcaagtgattctcatgcctcagccttcgagtagctggcattacaggcacacgctaccatgcccggctaatttttctatttttaatagagacagggtttcaccatgttagccaggctggtcttgcaactcctgacctcaagtgatccgcctgcctctgcgcacctctttttaagtatattcggccacttccacacattgcctaacaagcttcttctggtcagtgtgtctgagatcctcacctcagaaattctcacattagcaaacctactccaaggatgccagcatgaacctgaacggtatggtcacgttacagatccagaacacaaaacgacttccgcttttacagtttcaaaggcctcaaggtggagaaaaaactgaggggctgacctcaacaactgaaagagcagtgcatgcagcaggcttcaacacgaagcagcttttcagttaaggtcctaaaagtattatcattatcaacagcacaaacaagtaagaatgatagccctccattgcttaggcagagaaaacatgaatcttgttctataatcatgtgaataacaccataaataagcgccgtacttattgcagtaactcggatcaggtagtgataataaggtggggaaccacctggggggtgatcagacaaattgtgctttttcacattattacaaagatgtgggacccagaaaagatgagacctcggggaagggtgcaggcagagagtgaagtctgtgattcccagcatcacaacctcaaagggaaacgtttaggggccgtgaagaggcagcactgagggtgcagttgaaaagcaggtgcctcctcttggaccctataaataccaggggccctgcaggctgagtcctgtcctcaaagccccctggggacaaggctctaagaggcggaagtgagtgagaggggtctggattctgttaggcgctggggactcaagattttggcatgtttttctattccgaggatgagaatgactggccccacaagatatttttatccctgtgaaaagatgctgtgccccaaattctgttttggcaaaaacatgcagaaggaagtcaacataactggtatccagttcctaggggtaagatatttcaaccatgatcagtttggttgaaaatttcaattcctttgggacaaactggtagtttctttttgaatttcaaaagtaaaaagctaatcaggagatttttttttttctctctcaaagctttttcagacccactcaggcacagggcgccagtccctgccccggggacactgttcaaaagatggcactttccaggctgtaggcccacaaagcccaggggaccgccgatatcatcacacagagaactcccgggtggggcagcagaggggagcgaccagcgtacacaggtacaacagcacgcatatccagcaggaggccatcttgacccagaagatggaccagctcccgctgaagaagctctcgatgttggcactttcgtagctgtggaaacaagacacctagccgcggtcaaagcaggaatatattgagatacaattcactaattcacatccatttataatgtataattcaacggctttcaatgtattcatacacagacttgtgctaccatcaacactacccatttccaaacattctcatcacccccaaaagaaatcatgcaccccttaggtgctctccccttccccatggccccctcagcccaccccccgcattcaccaatctactttctgcctctatgaatttgcctattctggacagttgatataaaaggaatcacatggtctcttgtgtgtggcttttttgcctggcatacaatttccaaggctcagccacgcggcagcatgtgtcagtccttcattcctttttactgctaaatagtatcttattgtatggatagagcacattttgtttaggcagtcaccagctgatggtcatttgggatgtttcccctttttgattatcaccaatgatgcttgtatgaacaccgctgtgtaagttttgtggacctagttttctttttgtcttaggtatacgctcaggagtagtggaagagctggattacattgtaactcaatgtttaattgtttaaggagatgccaaactcttttccaaagcagatttcacattcaaaccagcaatgtaagagggttccaatttctccacttcctcgacatttgttattatctgcctttttaattatagccttctccatcttttcttaagctttccaagccaaaaattcccaggagttcccaaagcatcactgggaagcattaaagctcccttctcctctcctccttcaggaagaatctctccaatcactgtgcttgaaaccaccactcccaccacccctaccccaattccctctcctaattttatttttctccccaatactcatcaccatctaacacaccatatttgacttgcgtcatagtctgtctctcctgctggactataaatcctgcctcatagaaccgtgtggcacataggagccacttgcacatctgttgaatgaatgataaaaggaagcacaatgagcctacatgtctaagcttaacttagtggtcaaaaaaattatgatacaaccaaagctgtggacctgtagaaaaagtatgaacctctgtgtagtgccagggaaggccaggtcaatcatgtactgccaagttaaaaaaaaaaaagcctccaggggaaaacatgtataatgacatttatgttaaaaaaaaaattagctggacatggtggatcatgcctataatctcagcactttgggaggctgaggcaggtggatcacaaggtcaggagttcgagaccagcctagccaatatggtgaaactccgtctctactaaaaataataaaaaaaaaaattagccagtgtggtggcagcacctgtaatcccagctactcaaaaggctgaggcaggagaatcacttgaacccaggggcggaggttgcagtgagccgagattgcgccactgcactccagcctgggtgacaaagcaagactccaactaaaaacaaaaaaaaactacagaggtttataaatgcacagaaaaggagaaggatacacatcctagcagtggttatctgtgtgggggaagtagaggcgggggggtaccacattgttacttttcataattccacatttagtttgtattttaaaaaaagatgtttccaatttttgtaatgaaaatgaagaaaaatggggaaaaagatacacaaaatttgaagtagaaaaaaaagggatattttctctttctgaaaggcagatgaatgcttaggagttcctatttttccttcattaccatgttttccagactgtccatatagagctaactttccattttcttaaagttgccataagcatcaccagtttccagggttaaaacatacccatccactgttaaaactcagaactcgcttgtaatcccagcactttgagaggccaaggcag

SEQ ID NO: 793 - DNA, 12569 bp, Homo sapiens; identical to SEQ ID NO: 792

SEQ ID NO: 794 - DNA, 12569 bp, Homo sapiens; identical to SEQ ID NO: 792

SEQ ID NO: 795 - DNA, 4267 bp, Homo sapiens
ctcggcgggggaagagcccggcgggcgccagcgaagcggaaccaaacggagccgcggcacgcaggcgcaaaggctggcgttcgaggttcgtttacgcgccgcttcgccgtgcaggtggtggcgaagcgctcctccgaaaggtttcggaagctggtggtagctctgaagataacgctgcgttagggcatactgcggcggaggatggaactccgattgaaagcagttgctggagtggagcacgaatttcaacagttggagccgcatgttgaagtgtgaggcgtgaaagggtatgtctgatatttgctttaaaatgctccagcaaagaaattaagggatggatgaagcaaaagagccaggtatggtggctcatgcctctaatctcagcactttgggaggccgaagcaggcagatcacctgaggtcaggagtttgagaccatcctgaccaacatggtgaaactcgtctctactacaaacataaaaaaattagctgggcgtggtaccacgcacctgtaatcccagctactcctctggaggctcagacaggagaactgcttgaaccgggaggcggaggttgcagtgagctgagatcgcaccaatccattccagcctgggcaacagagtgagactccatctcataaaaaaaaaaaaagtaaagaaaaaaaagaaaatgtctttatttcattttctttcctaaagaatatatttgctggataaaggattctgtgttgacagttttgttgctttttaaaagcactttataaatgttgctccatggtttctgatgagaaatctgccatcactgaaatctttggttctcctatatacaaagtgttgttttcttccagttgttttcaaagtattttctttacagttggtttcatcactttgattatgacgtgcctgggtgtggttttcctttttgggatttgctgtgccagcagaccggctttaaatagaatgctatgtaaatgtatgtgaatatttgttttttgccagatgtttggaagtttttagctattatttcttcagatatttttttcttccaattgttctttctgggctcctaagacatgaatattagactgtttcatattgtcccacagatccccaaaggtcttctcatttttttcacttttttctctgtcattcagactagataatttctgctcatgtatcttcaaatttactgactcttccctcagtcatcttcattgtgttgagaccttccagtaaattttgttattgtattttcagttctacaatttccacttgtttctttttatagcttctatgctgagacttttagctttccatttatttcaacagtgtttccctttatatatttcctttggagaaatgtcttctttgtgtagcatgattaaaataactagtttaacggccaggtgtgctggcttatgcctgtaatcccagcactttgggaggcccaggcaggcagatcacttgaggtcaggagtttgagaccagcctggccaacgtggtgaaactctgtctctattaaaaatacaaaaaattatctaggcgtggtggtacacacctgtagtcacagctactcaggaggctgagacaggagaatcacttgcaccctgggggtggaggttgcagtgagccaagattgtatcactgcactctagcctgggtgatagagactgtctcaaaaataaataaaaaaaataaaataactagttttaagtctttttctgataattctgacatttgggtaaccttagagttggctcttgttcattgtcttttccctagagagttgcttaggtttcacaagttctttgtccaatcattttgggttgtttctgggatatatttggaatattatgatattctctatcctgtttaaatcttcataagaatgtttttgttttgttttgttttagcagaccatcaattcagttaagtttcagagcacacatcctggccactttttttggtggctgtggttccaatgttagttttcactgcctttgttaagctgttctttgccccagttgtgcaccatctagtggccaatctgaaacttggacagtggcctacactgtaattcagtgttcagaacctttgctcagctgcttctggttagtttcacacatacacagcttgtgagatgatcccaggattttattgacagatttaagggttccttttcttcagttccctcctatttgtgatcttacctatactctggtttctagaaccccattcttggtttttggctagaaagtcagggcgttagcctccccattgccagtgttctgccctgcaatgtctgccactagtgcaccagggggaagagaagagtgatacctctttactgctgcgggattgatgtagagcaaggaaagtccagaaggttccaagtcattacccatggttctcctggtggggcggtgggtcttactgcatctttcctgaggctctcttagaatactgcaattaaattaaaaagggttttgtcccatagcctccaacctcctttctggtcctctgactagaaacagcaaattgttccttggactatttttctctctgtcagctagcatttccagttttcctgttaaatgtcttttttctttttccttttttttgagacaaggttttgctctgttgcacgatcacagctcactggagccttaacctcctgggctcaagtgatcctcccacctcagcccccgtgaagctgggaccacaagtatgagccaccacacctggcaaaatttttttaattttgcagagacagtgtctccctgtgttgctcactctggtctcaacctgagctcgagtgatcctcctgccttggcctcccaaagtgctcgattacaggtgtgagccactgcacctggccttattatgtgtctatgtgtggattttctagtttattctgtttgggatttgtctggcttctagaatgtgtggggtcatgtctttcatcagtttttaaaattctgcattctatctaagtatttgctctgtcctattcttgcctctcctctcacagctaatgaagcacttaggatttttcactgtattctctacaggtcttctgtttttttttccagctgtttctcccatggtgcactgtgaatagtttctcctgagttatcttccagtttataaactaccccaattggctacattctattacatctatttactgagttttaaagtgcagtttttatgtatattcttgtaatgtttatattcagttcttttccagattagctccacaactttttatcgtatagtttcccatttcctgcaagtacattcacacaccttatttccttaaacaaagaaaacaaatctaatacctatatctgtgagtttgttttcattgcttcaagtaattcttgcctctggaatctagtttccttatatgactactttttactatgtgttactagacatatttgaaaagtaatttgaggcctacaatgaaattacttttccatgaaaagtatttacattttattttctctgtcacctggaggcattactagtgtgggaacaccttaaaggaagctcagtgcttaagattctttagatcactggggcaattctaaacttgcctgttcttttacattggttcttccacctctgattcattatcatcctaaaggtgaaagtatttgggagtctcagcctattgtgtggagggtctcctgttaggttcatcaccttatatgggccctgaactttaatttctgtccccctcactcataaggttgtcagagtaagggtacatgcttgcttctcttattctctttacttttggacttggcattccttattgtctggaaaatctctttgatgttttaagattattcttgtattttaatcaggaattgttttcaacaggaacatgatgtaaatatcctagcatgcaattttcagaaacaagtagtttcccacaattgaatctttgctcctacagggccaaatcctactctttctcttggcatgctctgcacttaagcgcatactacttgtggcatggaatccataaatgttgataaagaactacgcctaattctgtcagaacaattaatcatttttagaaatttttgcttagaaacctggtaaagtgctctgcatgtagcaagtatacgaacacacaaagtttgttgaatagctgcataaaacaaatgggctagattttacttcatatttcaaaattcagagaaagagagtagtattaaaagacataagccaaaaatagatcattgcagactgagt

SEQ ID NO: 796 - DNA, 827 bp, Homo sapiens
ctcgccatagcgcagcggccgatggtacagcccgctcccccctcgcgctctcggacagtgggtccttccacttgtagaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgacctgaaggatgtccttggtgaggattttgaaaatttgatcttcacaagagttgcctggatcatttgaaatttctgggagtctgaggagtactgacataattacctgctggagtctgtaaatacacatttaagacagtgaaacgacaaataatgtatagaggtattcaaaaaatttattgaaagcactgtactaggagctgagaacacgatgatgagcacaacacag

SEQ ID NO: 797 - DNA, 827 bp, Homo sapiens; identical to SEQ ID NO: 796

SEQ ID NO: 798 - DNA, 1282 bp, Homo sapiens
tttagccgggatggtctcgatctcctgacctcgtgatccgcccgcctcggcctcccaaagtgctgggattacaggcgtgagccaccgcgcccggcccatatgttgaaatcttaacccccaatgtgatgatattaggatgcggagcccttgggaggtcgtaagcatggagcccacgtgagtgggattagtgcccttatgaagagatcccagccctctttctgccatgcgaacacacagcaagaagatgcctgtctatgaaccagggggcccttaccagaaacaaacctactagcatcttgatctcggactttccagttcccataaccatgagaaataaatgtttttaattcaatgtatggtattttattatagcagctctacctaagacagtacatgtatagtgtctatttgaacattactgataatgttgaacaacttttcatgtttattagttattaggtttcttcaagtgttcttattcatacaaattttaaaatatgtacacaagttctttgttatatattttgcaaatatcttctgtggcttgtcttttcactattttagttctgtcttttgataaacaggagcttttaatttttatgtcaaatctatcaagctttttctttttgatttatgttttttatgtcttatttgagaaatccttctataccccaagatcatgaggatgtttcctgtgttctcttctgaaagctatatagtctttgtcatttaggtttatctttatacgtggtatgaagtgtaaagttctacttttaattttttgcatattttattaggataggatgggctttttctgtagtaataatccttaaatctcaggggcttaatatataaaattgtctcatgcaaaaaaccactgggtctagggcaattgctatctactgccgtctaatctccctctagtggcttccattggtagaccctaacaggaagccagctgataagggaatctgggaaatgtagtttacagagtggcagctacagtagaacagtagagactacaaggatgagcttgcagctgagaatagaaacgtgactggcacactaggtggtttgtttgtaggttttttcttttcctgtttgagacttttttggattcttgaatttgtacaatggtatccttaatcaattgtggaaaattaaatgattttttctttcagcattgtctgtttcttctgtaactgattaaatgtaagttggatcatatcatgatattatctcttaatctgtctttcatatttttatatatatgctatatttg

SEQ ID NO: 799 - DNA, 1282 bp, Homo sapiens; identical to SEQ ID NO: 798

SEQ ID NO: 800 - DNA, 1282 bp, Homo sapiens; identical to SEQ ID NO: 798

SEQ ID NO: 801 - DNA, 1282 bp, Homo sapiens; identical to SEQ ID NO: 798

SEQ ID NO: 802 - DNA, 2598 bp, Homo sapiens
gaagtgagcagttcagactcctgggaaaggagacacctccccactcaatccaactgattgcacacctctgtcctggccacctcgcctttccagacctgccaagggcaggggggcaactgccagcgccatgtcctccttttgcccctctgtgcccaggcagaataggcaaaagggagctgaacattcttgcacacggtgcgggatgcacacagaccggcaggacgcagccggagaggacacggggcccacagaatcagtcctggcttgaacatgcttgtctgggagcgcgtctgcacacccttggaggtggtgtgcccggcctgcgctacccagcagccagtgggcactcggaacaaaccaggccatgcctggagggagcctgtcaaggaggataatgaacgcaggtgtgcacgctcagctgagctttgtctctgagttggtttgcttacctcaacggtttgtccctgtttggcgtgtggctctgttcataggtctgtaactgtgtctttgcccgtcagtcttcctgtgaccctgtgcttttctctctttctctctctctctctgtccctgtctctgtccctctgtccctgagtgatgtgaggccgggctgggggcagtcgcagccgcgtcctctcttgccctcattggttcgcagccgctcccccgggcagccgccgccagtcccgcccctcccccgaacccccgcccgggacacgagcgcgctcagagccgccagaaagctcagtctcctgctcaaaacaggagcgcagcagccggagggagtggggacaagctcgctgaacactgggcgtctcgacagggaccagagcctgcaggactgttccgagacgctgcggtggcggcggcgccggaggacgcggaggactccctggccacccgccctccgtgcgctctgccaccgggcgctcagcagagaccccgggctgcggctgcacttgctgagtgcctctccccgccgccgcagcccagaggcgcccagcacctggagctcactggagctgagggtccgagctgagcgggctgttgtaaagccgaaaggcgagtcagtgactgggacctctgtcctggcaccgactctcggtcagttgggcgcggcagggcgggaggggcgcgccatggaggcgccgggtcgcgccagtatgctccaggccaagtgaagcggtccggctggggtcggcgggacccgcgggccatgtacggcgacatattcaacgccacgggcggccccgaggcggcggtaggcagcgcgctggccccaggagccacggtcaaggcagaaggcgctttgccgctggagctggccactgcgcgcggtatgagggacggcgcggccacaaagcccgacctgcccacctacctgctgctcttcttcctgctgctgctctcggtggcgctcgtcgtcctcttcatcggttgccagctgcgccattcggccttcgccgcgctgccccacgaccgctcgctgcgcgacgcccgcgcgccctggaagacgcggccggtgtagcttgggactgagccacggccgccgggcgccccgtcccgacctagccaagagcagccagcttgagcctggtagggagggcacgacaccggggatcgctggcccctgggaacacggtgccctgacccaaagacccttcctgaactagagtggcaacccgagaggaaagggagaccgaggcgtcgggagcctgtgtagggtctcgatcccagtacctgtaggtaccgtgattctgatcccctggccaaatctttcttcctctggacagagggtccagtcgggaaaccttcccgaaagacggcggtcgggtcgggaaaccttcctgaaagacggcgcgccagcccgtcttgcttgctcgccgcctgctgacttccttactttgcacacggaaggggcaggaaccgcaagcgtgcaactagcctggagctacccgtctggactcgcaggccctgtggctgtttcccacagctgctacggcctctcttgctccttgacaccgaggaggaccccactaggatccgagcgtcgtgaactcacctgaactttggaaggttggcactggggggccgcatccccctgggaaatgactgaacgcggggtttcagtgggtcccgcctgggtctaaggacccagtttcttctgtgagcacgggcagtgggaggccggtggaaaggcgcaggggcccacctacgcgtctcacatcttcaggggcgcatttctacaataaaaactcacccaattagacctagcgctgagaacgtgctgcttcactttccatgaggacaagaacaatgattccagccctactgccctgcctaccataaagttggacctgtgttaatcactcaattggcaagtaagtattaattaggttacagtccaaactgctataacaaagccatccgccacgcaagtttctttctcacagtactctttcaggtgtagcacagtactctttcaggggtagcacaactgtcatcctcatccctcggcttccatgtccacttcaaggtatctatgctagatcctgccttcatatctgcattccagccactgagaaggggaaaagagcaagg

SEQ ID NO: 803 - DNA, 2544 bp, Homo sapiens
ccaaagcggcgcaaacaattaccagcacgttctcagcgctaggtctaattgggtgagtttttattgtagaaatgcgcccctgaagatgtgagacgcgtaggtgggcccctgcgcctttccaccggcctcccactgcccgtgctcacagaagaaactgggtccttagacccaggcgggacccactgaaaccccgcgttcagtcatttcccagggggatgcggccccccagtgccaaccttccaaagttcaggtgagttcacgacgctcggatcctagtggggtcctcctcggtgtcaaggagcaagagaggccgtagcagctgtgggaaacagccacagggcctgcgagtccagacgggtagctccaggctagttgcacgcttgcggttcctgccccttccgtgtgcaaagtaaggaagtcagcaggcggcgagcaagcaagacgggctggcgcgccgtctttcaggaaggtttcccgacccgaccgccgtctttcgggaaggtttcccgactggaccctctgtccagaggaagaaagatttggccaggggatcagaatcacggtacctacaggtactgggatcgagaccctacacaggctcccgacgcctcggtctccctttcctctcgggttgccactctagttcaggaagggtctttgggtcagggcaccgtgttcccaggggccagcgatccccggtgtcgtgccctccctaccaggctcaagctggctgctcttggctaggtcgggacggggcgcccggcggccgtggctcagtcccaagctacaccggccgcgtcttccagggcgcgcgggcgtcgcgcagcgagcggtcgtggggcagcgcggcgaaggccgaatggcgcagctggcaaccgatgaagaggacgacgagcgccaccgagagcagcagcaggaagaagagcagcaggtaggtgggcaggtcgggctttgtggccgcgccgtccctcataccgcgcgcagtggccagctccagcggcaaagcgccttctgccttgaccgtggctcctggggccagcgcgctgcctaccgccgcctcggggccgcccgtggcgttgaatatgtcgccgtacatggcccgcgggtcccgccgaccccagccggaccgcttcacttggcctggagcatactggcgcgacccggcgcctccatggcgcgcccctcccgccctgccgcgcccaactgaccgagagtcggtgccttggggccggcggggactgcaaagaccccgggacgcgtccgctcactcgcctccgcgctcagctgctttccccgccggctggcggaccccagttctcggagctggacagttctgtgcccgcgcccctcgggctcactgtttctctccgtcgccaccaggacagaggtcccagtcactgactcgcctttcggctttacaacagcccgctcagctcggaccctcagctccagtgagctccaggtgctgggcgcctctgggctgcggcggcggggagaggcactcagcaagtgcagccgcagcccggggtctctgctgagcgcccggtggcagagcgcacggagggcgggtggccagggagtcctccgcgtcctccggcgccgccgccaccgcagcgtctcggaacagtcctgcaggctctggtccctgtcgagacgcccagtgttcagcgagcttgtccccactccctccggctgctgcgctcctgttttgagcaggagactgagctttctggcggctctgagcgcgctcgtgtcccgggcgggggttcgggggaggggcgggactggcggcggctgcccgggggagcggctgcgaaccaatgagggcaagagaggacgcggctgcgactgcccccagcccggcctcacatcactcagggacagagggacagagacagggacagagagagagagagaaagagagaaaagcacagggtcacaggaagactgacgggcaaagacacagttacagacctatgaacagagccacacgccaaacagggacaaaccgttgagcagttgggaagatgtggcaaaacaggacttatattccttatggcaacgatgggctgagctgagtgtctgcagcctgctttaggcagggcacggctgtgcagtctgtcatcgtccctcgtcactcccatcaatgctggcaccaacctcacttctatttatcgcctcatctgatcggctgtttcttatagcagacccccctctagaacgtctgcaaggcatgtgaatttgtaaccatcaccctcctcacagggttgctgtgaggatccggtggactgatgcatgcaaagccccgagcacagtgcctggtctgggcacaggaggaggggcttggaggtggaggctggagcttctgggggtcctggctgcatgactctaaggagggtggtgccttcgtccccacccaacccccaccgcatcggcccattctcctcccgaagcatccctgggccacaggttcccaaggccacctccagactgggcccgcgagtggggcggccctggtagcgtatccacagaagttattatgag

SEQ ID NO: 804 - DNA, 949 bp, Homo sapiens
aacatgtgaaaacttaagaaagatccctggctgtctcccaccctgccttctccctacttcccaaagcctacaaaccaatctagacaagttcctgactgtaccataaaccatttctcagggagctggaatgcattcatacttgacttcaacttgctggaagtgagagtgacagcaggcaggaggagacaagtataactgccagggaaagagagaccaaaccagactgccaaaaataaccaaggccttagcagaagcctgggccacagtataacatcctgccatggccggcaaagggcctagggtccaaatactgcccctttttgaaaggttgacccacatcttagatgaaggggctggaacagttaggtggccttctaccctgcttcttccttgtctttgtggggaagggaagaagacactgtagtacacaaggttgcttgggaaaatggattattctaataaaactttattttttcaaacacagccacagaggcagaacctcatgtttaacacacacagacttatggatttttcttttaatataaaacaaagtttacgaaaatttttttccactttttgtatttgtaatcccattagcacagggactttggcagcaggtgggagtgaagggcagctgagctgccactgggcagtcactgggcacaggaggagagcaccagcctggggagtggcttcactcacacacacagggatactcacctactggccaaccacactacacacacagcacagatgcagacattgacccagtgtcagccacatgccctggaggtgtgctccactctgggtaagcccaatatgtgaaaattcaaatagtcaaaacagctaaagtggagggagaagatttccagctgccctgagtcggagccctccactcacccccattcccaggctcggcccccagccttggggactcgacacttgttag

SEQ ID NO: 805 - DNA, 1601 bp, Homo sapiens
acgaccttaaagtggattagttggccttgtggtcagtcatagtgaccccgaacaatgggagaattcattggcgccataaagtgtcggtcactttgtcgcgggacgtcgcgtggtacaattggcctgtgggagtaccattgatcccgccctcatctgaggtgacgggaaagggccgggaaatttccacttctgaataaaatgactgctgaagtgatgacccgcaagaattggtcaaatttggagtagacttcaccctgcgcttggtgaaacttctacgtcaaggatgcaagaggcgccgaagtaacgcagctcccacctgtcgctctccgctgggcgccgagactatggccggagaatagctgcaccgggattggagaaaggaagccatcagtcttaggaaggctccaccttcctgccattgcctggttggaggagcgtagcgtcagtcactagagcagtcaccacctctgggacaggtgaagatgtgtaacctatttgccgggggctatttgggagggaatagaggacggggagcgatgaggggacagtcgaggggcaaggccgatctcgcttcgcgcctcccgcctttctgagttgagcctagcgcgcgggtctgagggacatccggggagctgcttgggatggccgccttggggagactcgacccgcccgccaggacccggccgcgcgccgcagttcgggcgccttcgggcaggatcgcccagcggggccgcgttctcctgcttgcggacggctgcgggcctgagggctggacagcgccatgcctcagtaccgggaactgtcccacgtaggaaggtgggaatgccgcgaacggcgtgcggaatccgacctcaaggtggaacggggtggtgaagagtgcatgctccgaggcagtttcgagttctggtgctgccacttacttgctgcctgacttcggcgcgtttgctgtttcatttttgtgactttcaactcgctcctctgtgaaatgggagtaatattagtaccttcctcattgggttgttgttatgaataaattagatgataatatagcgcttagcaaagtcccaaacttacaggaaagactcatttttgctagttattgtctcctcttccttcaggaactctctgctcgcccctgggtcctgccagcccaactaattctagttctaatcagatctgtgtggtgcaaaacaaggctagctgtggtggtcttccctcctctaaggagatctcttcctccctatatgcatctctctatctctgtctttatcttgtcagtaaagaggggggttaaaaatattcagattctatagcgggcgccgtggctcacgcctgtaatcccaacactatgggatgttgaggcgggcggatcatttgaacccagtagttcgagcccagcctaggcaacatggtgaaatcccgtctttaccaaaaatacaaaaattgggctcggcgcggtgactcacgcctgttaatcccagcactttgggaggcctaggtgggcggatcatttgaggttaggagttctagaccagcctggccaacatggcgaaaccccgtctatactaaaaatacaaaaattagccagatgtgatggtgcg

SEQ ID NO: 806 - DNA, 8677 bp, Homo sapiens
gaaactcagcctgcgcgcacttgaaaagccaacaggctcattgggcagccgataaagctctcgggatttccccgcggggctgcggagagtacagacaggaagcctggggacccagcgcctgaccagaacttcctcgggggaggctgcaggggagcaggcgcatcctgcacagaacgctctagagcgcgcaggccaaagcaccaggctgctcctgacacgtgctgcaagagggtccccgacccgggggtccagaccctgcacgcatgatggggaaggtggaggcttccccctcagctccgcggagagaagctgacactgccaggctggaaccttccattccggcccagcctcttcctccctcgctgtgccgaggagggatctagaagggactttccagagagggttagcgtgcagggtgtggaaatggaataaaagcatatgcaaataggccttagctgccttcctctaccccagcaaataagagtctctccagaaagatgctctttctccaagacgcttgaccgctcttcctttcctggatggcaccagcagggccgattggagtggtaaaccctgggccggaaggcatgccaaagggtggacaggatggacaggagacagtagcacaacgaggagggggagaacagcggctgaattggaaatgataaaataaaatgaaattttaggagctcgctggctgggacaggcctggactgcaaggaggggtctttgcaccatctctgaaaagccgatgtgtatcctcagctttgagaactgaattccatgggttgtgtcagtgtcagacctctgaaattcagttcttcagctgggatatctctgtcatcgtgggcttgaggacctggagagagtagatcctgaagaactttttcagtctgctgaagagcttggaagactggagacagaaggcagagtctcaggctctgaaggtataaggagtgtgagttcctgtgagaaacactcatttgattgtgaaaagacttgaattctatgctaagcagggttccaagtagctaaatgaatgatctcagcaagtctctcttgctgctgctgctactcgtttacatttattgattacttacgatgattcaggtactgttgtaagtgctttacatgctgttatacgagactcttgggagaaatcactttaatgaagcttgagacacatggcattgccatgcaatgatttttcccccctcttcacgggatcagagggaactaatagaatgtgacaatgattctttagcagggactgctgaggcttctggttcctttttaagatctgcagtgaaagaagatgagaaacatggatatgcccttcttttggtccccctcttcctttatttgatctctacttccttctataaatatattagggctacattgtccctttgtatttcaaacaaggcaaaaagaggttgtaattacactttactgcaatcctcagtttctccagggaacaggaatgcaaaggctttgaaggcctctctatttgctgacatggtcagctgggtgccatgggccaagtccttctgttgccctcctctgtcaccaagtaagctaggtcctttctgaggctcaggtttgctgtgatgatgatcacttttaggcagaaggttagaggcctcatgagtgctatatggactttattaggctttagatttgatggggaataagggatgtgatttgtcttttgggaactcatctttgattcatcattgtctcttggtatcttggaatttccatgtcattacagtctacagaatgaaagagtaacctgtcccagaggagaggcaggtgaaagactccacagcatgctcattctcattctgtcttctcagtgacaccgaggtttactgagtgcccactatgtgccaagcactgtgctcagggctttctttgtatgcatgatctcagtgaatctcaccaagcctcatctggaaaacggggacaaattaacaacaggatggcaaattgaaaaacacgtaaccatgttctacagatggaaaggggtgcttggttattatgaaggccccctcgcaagcgtgtgggacatgggtgtgttctctgggttgtactgatcagatcaaggacctcccccacccttctcacactctgcccacttccgccctttgcttatcagacccttagccagtgactcattccagaaccagaaccttggtgaaatctcaaccgacaccagagatcggtgtcttcagtcctagactgatggagaaaatccagaatatatactagaagctccaaatgctctgggtttcagctcctctgtgctgtggacactgactttggctcagaactccgatttagtacaaaaggctcatttttatttcaggggcactcttcctaaagcaaacctaataaatgaaatatggaattcacagatacacacacacattaaaaaattaacctagtgtatctgtgaggagtaggcagaaattcactgtataaaagaatgcttcatttcatagagaatttgtgttaagattccattagatagtacatttctcaaagatttttgaggttgtatttgctttaccaaaacttggtttatgtaagtggaaaaagcatgttgcaaaataacttggtgtctatgattcagtttatgtaaaataataaatgtatgtaggaatacgtgtgttgaaagatgtacatcaatttgctaacaatggttatctctgacgtggtgggatttgagatgtgtttttctttttggttgtatttttctctattgtttgacttaacacagaacatgtttggttacaacaataaagttattgaagacaatataacacccaattgtgatgagtccagacagtactcatgctgtgcatttattagacagtatgccatagaggtgggtcatggaggagtggagagagagccctgatttgttgtcccatgaagaagataggcacagggtaatatgtagtgtgattctttttttttttgcacgaggagaagtgtgtgtgtatccgtgtaagtgtatggatatccagtgggtagtgggtgttaagattgcaagtgatttttttcccctctcccttaatcatgcttttctgcctaaataaaaaaagaactctctccaaaaatccatccatgtgtgccagtggtttttaaatgtgtttcttggagcagcagcatcagtatcacctgtgacttttttttttttttttttgagtcactctgtcacccaggctggagtgcagtggcatgatcttggctcactgcaacctccgcctcctgggttcaagcaattctcttgcctcagcctcccaagtagctgggattacaggcgcctgctaccatgcctgggtaatttttatatttttagtagagacgggatttcaccatgttggccaagctggtcttaaactcctgactgcaggtgattcgcccaccttggcctcccaaagtgttgggattacaggcatgagccaccacgcttggcctgggaatgacttttggattagctaaccaacctgtgaactttttagaaatgtaaattttcaggccccactcaagacctcctgaatagaaaactctaggggtagggcccagcaatttctgttttaccaaccctttggctgacttttatgcacactaaagttttagtactgatagggtcaatcaagggacatctgcattcccctggaactgaaatatagctgacattgacatgaaagatgctggcccactcctacaagtatgcatgcaagtattccgcaaaacttatttctgagagatgaacagcaggaccccaaaacttcaagatggttacaagtgatatttccaccggtgaatagtagatttctaggtttttaatgtgcaaactttaggtgcataaaaccgcttgaagaagttgtcaattaaggcaggtcatgcccctgacccacagactaggcatttccaaagtatctgtcattttaaccatcactcactgaatgtcatcaaggaggtcctaggacgacacttagagcaactattccaggctttttcaaatgctgttttccccctccgtactattatgtttcttcttcccaattcatcctttctcttcctgttgtgattgatggggtctcagaagcagattagccatcctttcggctctgtgcttgggagagaatagctcacatgctgctagagaggtgccttgggagtaataataatgataatggaagtattgatttgccatcctctgataacaaaggaaggtcatgatttatcagctcacattaatgggatgaggtggaaagttggacacactacctcacagtctgcctttcccttgtgctaggttgctgggattcactgatttagggacacagtggtttcctaagtcctgccagcagtcaaacctttgttagttaaaatggaaatttctttttttcatattttctcacatctagactcttgccctcttttctaataatatttcagagaggcagctcccagtttgggtgtccaggtggtcagagagtctggaaaaatgctctgggggcaggaaaccagggtacaagccatcttgtctagttcctctttgctcttcttagcactaaggtgatttcacaacagttttttaaggatgttctgctcctatctcctgcggaagcccttccaagtagaagagttaattttgattattcctgggaaagtgcagaaaatataattacaactttattggatatttacaagatacacaaggtatcttgtaataatgaaagatttctctattttctatatctgaaaactgaggctcagggaggttacataatttgcttaaatttcacacacaacatgttaagtgtcacagctaggatgttaatcaggactgcacagtaagaacctatgttcctttcactaaagtttgtactgtgttaggatttacaatttgtaaagcactttaacacacattagtatatttgctgaacaccacattcttccgtgaaatagctcttctttttttttttctctttgagacagagtcttgctctgtcacccaggctgcagtgcagtggtgtggtctcagctcactgcaacctccgcctcctgggttcaagcaattctccctgcctcagcctcccgagtagctgagattacaggtgcccaccaccacgcctggctaatttttgtattttttactagacagggtttcgctatgttggccaggctggtctcgaactcctgacctcaagtgatctggctgccttagcctcccaaagtcctgggattacaggcgtgagccactgtgcctggccatagctcttttcataatcctaattttagagataggaaagtggaattttcaaaagattttgcaacgtatctgtgccccgtgccatatagctggtaactggtgacgtggagcctcaaaaccaaaatccctatagcaaaaagatcatttttacttaaaaaatgtatacaaatatacatgaacttagaaggaaggaaagaaaaaaaatcttttgcctctgtttctgcagtgtgactgaaaacagaagagcatgcattgaggcccactctgacttattcctccacctgtgcctttggtcagcaggagtgagcccccgtccatgaccaattccaccccaaggacacagttatactttaaaatatgtgacaattgagaagccatatgtgctttttctttgggtcctgcaatgctcctaagactggtcagattccactgtctctgatcagcacatgtttatttatttatttatttattttatttctgagacagtctctctctgtcacccaggctggagtgtaacggtgcgatctcggctcactgcaacctctgcctcccgaattcaagcaattctcctgcctcagcctcctgagtagctagaactacaggcatgcaccaccatgcctgactagtttttgtatttttagtggagatggggttttgccttgttggcccggctgctctggaactcttgacctcaagtgattcacctgcctcagcctcccaaagtgctgggattacagttgtgagccaccacacctggccatatttccttattttaaaacttatttttcttcttatatatgtaatatgaatttatggcaaataagtttgaaaatatgggaaagtataaaagagaaaatttgaagttattaaaatttttaaattatgaaattatgattttttttactggaaatttagagaattcagaaaatcataggagaaaaaagttatctatacacttatagattaccattttgggttatttcttttcattttcacttttttttcttttacacgattgggattatctttaatttgtgtatctgtgttctgtgttctgttgtttaacattttatagtatgcttttcttcatgtccttgcatggtctttttatttattttaaatgggtgcatatgcagttcatgggctggatgcgcctttgtttacatgatcatttccttattatcagacattctgaacctgggtctcctgactctaaatctgctgctattttttgtccccacatatctgtctctatttcctttagcttcttgtttgcatttatttgagaattaattgtgatgattttaggagtgtaaaaaacagtataaataaatgtgtcttgtattactacataacggtgctagtgttgaggatttactatgtgccaatctctatttcaatactttgaacagcttctcattaaagcccccgcctcccacaacaacagtagatagttattattcccattatatagatgatatcacagacatacacagagggtaagtatcatagcacattcatttgtgtctagcaaaacttcagcttacagagccatatacaaataggcatttatttgttcttagccagtctgaatatgagcaactactactagcatttgggttagagtctcagtgacatcaaggctgttgtcactgcagaaattttctcctgtgcctcttggttttaaagtggctgcaaaagccatagatatcacatcctgattcaggggaggaagagagagaaacagatggtgtggactggtcacatccgctccttttatcaagaaagcacattttctttccagaacccccttcatctccccagcagaattccactcatgcattattgtgtttttcatgaccactgccaactccagaagagactgggaaaatgaatgttttaactttttcagcctctggagtggaagagaggtttgggaatgacttttttctttttctttttttgacacagagtctcactctgtcacccaggctagagtgcagtggcatgatcttaactcactgcagcctccacctcctgggttcaagtgactctcgtgcctcagcctcccaagtagctgggaatacaggcatgtgtcaccatggctggctaatttttgtatttttagtagaggcaggatttcaccatgctggtcaggctggtcttgactcctgatgtcaagtgatccacctgcctctgcctcccaaagtgctgggattacaggcttgagccactgcacctggcctgggaatcacttttgctctggattaagttatgtcccccagaattcatatgttgaagccctaaccccccagtgtgactgtatctagagatagggtctaggaggtcattatggtaaaatgaggtcataagggtggggccctaagacccataggactatggccttataggaagaggaagattcaatctctctctctctctctctcctaccccatcgccacccccaccccccatggtgacacagtgagaaggcaccaaacttgaccatgttggcatcctaatctcagacgtctagcttccaaactgtgagaaaacaaatttgttttttaagccacccattctatggtattttgttatggtagtacaagctgaccaagacaaatagccaccacaagatatcagcgctggtcaagtgttggtcttatttttcctagcagccaatttcatacaggggccaaccattggctaagaattggtgtatatcacatctctggcttggattatggttggaagtggcccagtgcctgtcaaacctcatctctcactgaatataacaccatctaatacatgccaacattttcatcaatattactgtcaccacaaagtgccattaaaatagaagtggtttcatacattatttatctgcagcgtgtctactgagtcattcttttgctggagagctgtctccttggcatttataaacttggtaacaaatctgcagctcactggattcctatcttcaggctgtgacagggaagaggaggctccatgaactgtttgggctgaaagtagttgctgtatctcttccaccagcccagaacacatttattaagtgcctggttgcacgtgatctgaacgaggggctacacagtggacattctgaaaatgattggctgtaacccactttcttttggttagagggggttctaaaaggatccattatttattagtgattttcagttgtgattatttttaaatcagaaattcaaaatggcaattctaatcagtgggaatacattaatgaataaaatagtcattactgtcttcatggaattgacgttctagtaaagaggatatttcatatataaaactagatttctggctgtttgaagtaccaaaagaactgacaactctgggctgcct

SEQ ID NO: 807 - DNA, 5635 bp, Homo sapiens
atgcattttatcatagggccggacagctatatgcacaagatgctacctgcagagattggtttttgcccagatgtgcaggagagatgcacagagaggaagaaatgcatacatgtgtgcaggttttggcgtgtgcacaagaagcctggaaggattttctttggatctacagtcaaaatggatttccgagaggaagctgtctgaaaacacacctcttccctgtgctacatacggtcccatctctgccagccaggttgtcaggaaagtgatcagcactggcttcaactctggctagagctctttggccaatgtgatgggcagaaaactggaatgaggacagaaaagcacctcagaggtttgaagagtctagtctctcaccaccttgctgtaggttttctgaatacttctgagtttaggagcattttttctcaacaggcaagtcaggagctgctaagataaaccatggcagtaagctcgagccagtgttcgtatttgccattgatcggccaccaagtgcttgctatgtgccatgcattgtgctaagcactatctcatttaatatttacagcaatcttatgaggtagatgctactgttatctccattttacagatggggaaactgaggcacagagttccacagctggtaacttgaggaataggaattcaaccactggagagtctggctggagttttttgtggtaggagaaaatatgctgtctaaatttgccttgggaaaccatcatggtggtcacaaaaccacttctacggcttgccttgacctagcaggaatgaagatgtaaagaaagaatgagcgcgtcatggttatgatgggatgatgatgtctgttgtgttgtttggtgtcagtttctgtaacgcctttctatttcaatcaaggctattatcttttcctctgttttagtgaagtttccttgaagtagaaaatgggagtgtattgggcatctcagagttttcagctgaactgaagggtctgatggtaactttacccccaaatctctgagagaaaagcagggagtccctgcttcagctctgctcagaagagcctccctcacatggtggtttctgtgtcactagactggttaaccaaatggttcttctaaatacccaacttttaatagaaactcctgcggcttggattattaaagtcctaacatgcttatttaatcgtgtttcaagtccatctatcttttttgagtctaaggaagactcactaggtcagaaggagtagagggaagaggattaatacatgattttctttttcccctttttcttttaacttaggctgagacttatttgaatgcctgtttcatatggagcttttaagtgtaacagttgtgagtgaaattgccccttttcaagcgctccgagtttgcttctgcatggaaggggaagatggactagagctgatacctcctgcaccctggtgaagaaatgcaccctgaggccagaaaatagtacaaacccatctggctgcaacagtccagcagcatgaagatcaaagtcacagtagagccagagagaaatttgccctgggcctaatattcatgaagcctttccaattcagactcggtattattgccaagtcggtgtgtttgggagaaatcagaagccaacacactagaaaagttgcaagagattcctaggggaacccacaaattcagttccttgccagaaacctgctcctccagatgaatctagtgcatcagatgggctcagaagcacaggtggcgcaggcagacctctactgagaagaacaacagtggaaggcagatgaaactcacattttggagtctgagagccatgcgggcccaccccagttacgtctacccctggtcggtgaccagagaatcctttagcagcaacagcagtgatgtttatttcactggtatgtataaagcgactgattgaaaacaagctgtatgcccaacaacttggaactggttaaatgatttttggttcagccgcacagtggaatatcatgcggccattaagaataaataaaaaatcctatactttccatgttcaactttagactgcaaacaactgaaaaaacaccttcataattaggcttcctcagattagaacgtgaagtcaaatcaacgtgtgtcagaaagttaacaacagctaactgtttgttgtggtgttctgagtaacttgtattatttttcagtttttttcccattcctaatgtgcaaatgtactatttttattgtaaaaaaaaatacatgtttgtaaagagcaataacataaatctctgcataggcaaattgaaaggaaatcagacaaaatgataccttttggtagtggaattctaaatcatttttttcttcattagagtttctgaattttctgcatttgatatgtttacctttataaagggtcaatcatatttaagatgattttttaaaagacaagtggacagggaaagagaggtctgctgttgcaaaaccaaagctggaggctctccgaagcccacttatgttagtcaattgatatttcatgaaactctagaatgtgcaaatcactttccacggggattgggggggtgagaaatacagagatgaaggagatgcaaacactttaatcaaagaaatccgtctggttgggaagagaaggttctgcattatataagttgcaaggtcttatccaagaggttagtctgtcaagagtaatagcaataattacacaacaatatgtcagagaggctgggagctccagcttcaaagccaccttgcctggggagaaacttaaccatattgggcctgagcctcagttacctacctcttctgtaaatgtaaactacctcttggggtccttgtgaggattaaatgaaacttgagcctaaaggggctgagctaggtgctttgcaaataacccaaccttagcatgaggcacgttatcatcattacggctgtggtgtttgtggtcacctatctgcaagtcacgctttcatagatatggctgagctgggatttgaacccacattgatctaattccaaagccaatgattccaccccaaccagacactgcatttactctctatgcctaactgaaatttgttctaaacctcaccctaaggtcttgccagaaagaaaagctaaattttcattaaaagatgaaaggagaaatgaatctgtttcaaaggacatgagaggaagaaggaaatatcccttcatgaaggattttgcaactttgtccatgcttctgcagggtgtaaaagtaaaaatcctatacttcccatattcaacgttagattttaaacaactgaacaagcactttcacaattagccttcctcagattggaatgcgaagtcaagccaacgtgtacctcttactgcagaagatttctgcactgtgaatgtgataggatttgcctccttaaccagagggtgctggtttttcctggctggagggtagaaggtcatgaatagaggacaaagcacagggaaggggcagcatgtcgggaagagccccaaggatctcagtatgaaaataaagaggtgtgagccaactgcccataggtttgggctatgagtctggggaaactgtttcaaaatcaatggaggcccaaaggcagagggaaaattctgtgtatggacttccatgtcattcagaaatgttaactccttgaaaagagttaatatatttttttcttttttaaacatttcaataggtttttggggaacaggtggtgtttggttccgtgggtaagttctttagtggtgatttctgagattttggtgcacccatcacctgagcagtgtacattctacccattgtgtagtcttttatctttcactcccctcccacttagaataatgttctccaattccatccaggttgctgcgaaggacattatttcattcctttttatggctgagttgcattccatggtgtatatatatataccacaatgtctgtatccactcattgattgatgggtatgcaggctggttccatacttttccaattgcgaattgtgctgctataaacatccatgagcaagtatctttttggtataatgatatgttttcctctgagtggatacccagtagtgggattgctggatcaaatggtagttctacttttagctccttaagtaatctccacactgtttttcatagtggtggtactagtttacatttccaccggcaatgtaaaagtgtttcttcctgtccctctggtcatctgtttttttaagggatctacctaaactcaaccataacccattccatccacctcatcttgcctcaagctaagaaataggagtgcagagaagaaaacagtacagataagaatgctagaaggttgtgtgtttgaataagaaggaacatggatcaggtttcaagtacagtacctgaggcaggtatgaggtagtagctaatggggtgaggtaggcagaaaaggcttctaaagaagcaggtacttgagttgggtcttcaaggccatagtgagtggtttcccggtggatctgagaaaggaaggtgagtttagagaaagggaagagcccgcagtgaggcatgaaaatgtacactgtgccttcagcgagcttggtgggtggcaatgtctggatccaagtgcgtgtggaggagactttgcacaataaggccactaggcaggtaggacggcccccagagggttttggctgacaagctgagggacatgctataagggtaggggccaggggaagagatggctccctggcagtgggtcccctgtgtgctcggcagctcatggataacagaggataacaggcctgtacctccatattgcccaacatgttatcacatcttcagtttggagagaagaattaaattcgtctaagtttataatttaccagatgactttggataagcacatatttggaacctcagataattcatccattcatttgctcattcagaacagttcttgcgcatcactttatattcagtgctgctgaagtttctttgggggctacacaggttagtaaggcttggttttcatctcaggaaccttatagccagaatgagggagaggtgagtactaactccacagtgttatcccagtcgctactcatttcccttaccaccacgccttcaaacacttcagtgtactttcagctctcaggaaaaatgcaaactttcatctgggcctaagaatctctatatgaactacccctgctcacctccggagaggcatccccttccaccaccctcccctccttcttctctatcctcattgctcctttcaatggtcctgacaggatccctttcagccacaggcccttagcaaatgctgctctcacggcccaagtcatcttccctggttcatgcctacttcggattaaagttacccctccggagagtgttcccgatcaatctgaattgaccaagtccttattacacactctcaaactccatgagatgtccttcatagctctcatcccagttataattagtttgcatttatttacacaatggctgtattaatttctgtattctccaccagaatgagagcttcatgagagccaggatgtgtgttttctcaaaatctgctttattgtggtctaatttgtgtataataaacacacccatgttaggtgtacccatcaatgaatttttagaaatttattaaaaat

SEQ ID NO: 808 - DNA, 5635 bp, Homo sapiens; identical to SEQ ID NO: 807

SEQ ID NO: 809 - DNA, 5635 bp, Homo sapiens; identical to SEQ ID NO: 807

SEQ ID NO: 810 - DNA, 4481 bp, Homo sapiens
ccggacagctatatgcacaagatgctacctgcagagattggtttttgcccagatgtgcaggagagatgcacagagaggaagaaatgcatacatgtgtgcaggttttggcgtgtgcacaagaagcctggaaggattttctttggatctacagtcaaaatggatttccgagaggaagctgtctgaaaacacacctcttccctgtgctacatacggtcccatctctgccagccaggttgtcaggaaagtgatcagcactggcttcaactctggctagagctctttggccaatgtgatgggcagaaaactggaatgaggacagaaaagcacctcagaggtttgaagagtctagtctctcaccaccttgctagtagagccagagagaaatttgccctgggcctaatattcatgaagcctttccaattcagactcggtattattgccaagtcggtgtgtttgggagaaatcagaagccaacacactagaaaagttgcaagagattcctaggggaacccacaaattcagttccttgccagaaacctgctcctccagatgaatctagtgcatcagatgggctcagaagcacaggtggcgcaggcagacctctactgagaagaacaacagtggaaggcagatgaaactcacattttggagtctgagagccatgcgggcccaccccagttacgtctacccctggtcggtgaccagagaatcctttagcagcaacagcagtgatgtttatttcactggtatgtataaagcgactgattgaaaacaagctgtatgcccaacaacttggaactggttaaatgatttttggttcagccgcacagtggaatatcatgcggccattaagaataaataaaaaatcctatactttccatgttcaactttagactgcaaacaactgaaaaaacaccttcataattaggcttcctcagattagaacgtgaagtcaaatcaacgtgtgtcagaaagttaacaacagctaactgtttgttgtggtgttctgagtaacttgtattatttttcagtttttttcccattcctaatgtgcaaatgtactatttttattgtaaaaaaaaatacatgtttgtaaagagcaataacataaatctctgcataggcaaattgaaaggaaatcagacaaaatgataccttttggtagtggaattctaaatcatttttttcttcattagagtttctgaattttctgcatttgatatgtttacctttataaagggtcaatcatatttaagatgattttttaaaagacaagtggacagggaaagagaggtctgctgttgcaaaaccaaagctggaggctctccgaagcccacttatgttagtcaattgatatttcatgaaactctagaatgtgcaaatcactttccacggggattgggggggtgagaaatacagagatgaaggagatgcaaacactttaatcaaagaaatccgtctggttgggaagagaaggttctgcattatataagttgcaaggtcttatccaagaggttagtctgtcaagagtaatagcaataattacacaacaatatgtcagagaggctgggagctccagcttcaaagccaccttgcctggggagaaacttaaccatattgggcctgagcctcagttacctacctcttctgtaaatgtaaactacctcttggggtccttgtgaggattaaatgaaacttgagcctaaaggggctgagctaggtgctttgcaaataacccaaccttagcatgaggcacgttatcatcattacggctgtggtgtttgtggtcacctatctgcaagtcacgctttcatagatatggctgagctgggatttgaacccacattgatctaattccaaagccaatgattccaccccaaccagacactgcatttactctctatgcctaactgaaatttgttctaaacctcaccctaaggtcttgccagaaagaaaagctaaattttcattaaaagatgaaaggagaaatgaatctgtttcaaaggacatgagaggaagaaggaaatatcccttcatgaaggattttgcaactttgtccatgcttctgcagggtgtaaaagtaaaaatcctatacttcccatattcaacgttagattttaaacaactgaacaagcactttcacaattagccttcctcagattggaatgcgaagtcaagccaacgtgtacctcttactgcagaagatttctgcactgtgaatgtgataggatttgcctccttaaccagagggtgctggtttttcctggctggagggtagaaggtcatgaatagaggacaaagcacagggaaggggcagcatgtcgggaagagccccaaggatctcagtatgaaaataaagaggtgtgagccaactgcccataggtttgggctatgagtctggggaaactgtttcaaaatcaatggaggcccaaaggcagagggaaaattctgtgtatggacttccatgtcattcagaaatgttaactccttgaaaagagttaatatatttttttcttttttaaacatttcaataggtttttggggaacaggtggtgtttggttccgtgggtaagttctttagtggtgatttctgagattttggtgcacccatcacctgagcagtgtacattctacccattgtgtagtcttttatctttcactcccctcccacttagaataatgttctccaattccatccaggttgctgcgaaggacattatttcattcctttttatggctgagttgcattccatggtgtatatatatataccacaatgtctgtatccactcattgattgatgggtatgcaggctggttccatacttttccaattgcgaattgtgctgctataaacatccatgagcaagtatctttttggtataatgatatgttttcctctgagtggatacccagtagtgggattgctggatcaaatggtagttctacttttagctccttaagtaatctccacactgtttttcatagtggtggtactagtttacatttccaccggcaatgtaaaagtgtttcttcctgtccctctggtcatctgtttttttaagggatctacctaaactcaaccataacccattccatccacctcatcttgcctcaagctaagaaataggagtgcagagaagaaaacagtacagataagaatgctagaaggttgtgtgtttgaataagaaggaacatggatcaggtttcaagtacagtacctgaggcaggtatgaggtagtagctaatggggtgaggtaggcagaaaaggcttctaaagaagcaggtacttgagttgggtcttcaaggccatagtgagtggtttcccggtggatctgagaaaggaaggtgagtttagagaaagggaagagcccgcagtgaggcatgaaaatgtacactgtgccttcagcgagcttggtgggtggcaatgtctggatccaagtgcgtgtggaggagactttgcacaataaggccactaggcaggtaggacggcccccagagggttttggctgacaagctgagggacatgctataagggtaggggccaggggaagagatggctccctggcagtgggtcccctgtgtgctcggcagctcatggataacagaggataacaggcctgtacctccatattgcccaacatgttatcacatcttcagtttggagagaagaattaaattcgtctaagtttataatttaccagatgactttggataagcacatatttggaacctcagataattcatccattcatttgctcattcagaacagttcttgcgcatcactttatattcagtgctgctgaagtttctttgggggctacacaggttagtaaggcttggttttcatctcaggaaccttatagccagaatgagggagaggtgagtactaactccacagtgttatcccagtcgctactcatttcccttaccaccacgccttcaaacacttcagtgtactttcagctctcaggaaaaatgcaaactttcatctgggcctaagaatctctatatgaactacccctgctcacctccggagaggcatccccttccaccaccctcccctccttcttctctatcctcattgctcctttcaatggtcctgacaggatccctttcagccacaggcccttagcaaatgctgctctcacggcccaagtcatcttccctggttcatgcctacttcggattaaagttacccctccggagagtgttcccgatcaatctgaattgaccaagtccttattacacactctcaaactccatgagatgtccttcatagctctcatcccagttataattagtttgcatttatttacacaatggctgtattaatttctgtattctccaccagaatgagagcttcatgagagccaggatgtgtgttttctcaaaatctgctttattgtggtctaatttgtgtataataaacacacccatgttaggtgtacccatcaatgaatttttagaaatttattaaaaat

SEQ ID NO: 811 - DNA, 4481 bp, Homo sapiens; identical to SEQ ID NO: 810

SEQ ID NO: 812 - DNA, 6941 bp, Homo sapiens
ttttgcattccctgaaacaaacgacactatggtgtattttcttttggggggcagtaaataaaagtcttttatgttgacaatgataatattatattctacaatctatttgcatttctctatcctgtggattttattgcttagtataaatccccaggctgaggtgcattaagcttcactcagagagaaacaatgcattttatcatagggccggacagctatatgcacaagatgctacctgcagagattggtttttgcccagatgtgcaggagagatgcacagagaggaagaaatgcatacatgtgtgcaggttttggcgtgtgcacaagaagcctggaaggattttctttggatctacagtcaaaatggatttccgagaggaagctgtctgaaaacacacctcttccctgtgctacatacggtcccatctctgccagccaggttgtcaggaaagtgatcagcactggcttcaactctggctagagctctttggccaatgtgatgggcagaaaactggaatgaggacagaaaagcacctcagaggtttgaagagtctagtctctcaccaccttgctgtaggttttctgaatacttctgagtttaggagcattttttctcaacaggcaagtcaggagctgctaagataaaccatggcagtaagctcgagccagtgttcgtatttgccattgatcggccaccaagtgcttgctatgtgccatgcattgtgctaagcactatctcatttaatatttacagcaatcttatgaggtagatgctactgttatctccattttacagatggggaaactgaggcacagagttccacagctggtaacttgaggaataggaattcaaccactggagagtctggctggagttttttgtggtaggagaaaatatgctgtctaaatttgccttgggaaaccatcatggtggtcacaaaaccacttctacggcttgccttgacctagcaggaatgaagatgtaaagaaagaatgagcgcgtcatggttatgatgggatgatgatgtctgttgtgttgtttggtgtcagtttctgtaacgcctttctatttcaatcaaggctattatcttttcctctgttttagtgaagtttccttgaagtagaaaatgggagtgtattgggcatctcagagttttcagctgaactgaagggtctgatggtaactttacccccaaatctctgagagaaaagcagggagtccctgcttcagctctgctcagaagagcctccctcacatggtggtttctgtgtcactagactggttaaccaaatggttcttctaaatacccaacttttaatagaaactcctgcggcttggattattaaagtcctaacatgcttatttaatcgtgtttcaagtccatctatcttttttgagtctaaggaagactcactaggtcagaaggagtagagggaagaggattaatacatgattttctttttcccctttttcttttaacttaggctgagacttatttgaatgcctgtttcatatggagcttttaagtgtaacagttgtgagtgaaattgccccttttcaaggtaattgaattccatttttcactttccatttccctctagaaaaatcaaaacgttttcagagcttggcttcttagtgggtgattttctaaggtgggaactttagaaccataaaacattctagtgtggcaaaggcattcaggaaccggatgaccaggccccttctccgcaggtgaacagcctccaccagccggtcttggagaacatattgatttcactgtgtttttatttgaaacaccaaaggaatgcccatatcttgtccttgggccagggctgtgggttaggggagctgggtttctgtccagaatcttgtcatctgtagggcagctgaggggcattattacccagaggtccctggaaacctgtgctaaattggtttggatcagtgtccgtgaaaatgttggacaaaggagagtcgattttagctgacacctggacacgactttaaataacactgtatcacggagcaacacaatgtcctcccaactctttttcggtctttccgattatgttagggacaaagtctcagtttggtgctgttgtggtcgaactatcttctcatctctgttttttaaagtcaggcagatcaagccttactcctagggctttagaaggtaatagtttctgatttggatttaatcacattgttttatttcctttttaacatttttatgacaacttttgctttatagcagttttaaaggtaggaaaaaattttcgtttgaaaacaagttggtttgagatgtttttcactcttacataaaagacccaccttcacagcgtatgagcttctaaagttggggaagcagtggcttaggtgggcaggcaggaaattcaagcaggttggtttctgccaaagtcagagatgattgccacttactggaaggctgtgttggaacagagtgggcacaggcattgggagcagagctgatttccaatcttcctgctgccctcgctgcctgtgtgtgccgtggccttcttgagctttagttttctcacctgtggaacaggtttcatgagcagttggaaggaagcaaatgagcttcattttctacaacagggtgggtggtgtagttgatattcaccccaaaggtgcaggatccccacttctgtttattgccagcgctccgagtttgcttctgcatggaaggggaagatggactagagctgatacctcctgcaccctggtgaagaaatgcaccctgaggccagaaaatagtacaaacccatctggctgcaacagtccagcagcatgaagatcaaagtcacgtagccagagagaaatttgccctgggcctaatattcatgaagcctttccaattcagactcggtattattgccaagtcggtgtgtttgggagaaatcagaagccaacacactagaaaagttgcaagagattcctaggggaacccacaaattcagttccttgccagaaacctgctcctccagatgaatctagtgcatcagatgggctcagaagcacaggtggcgcaggcagacctctactgagaagaacaacagtggaaggcagatgaaactcacattttggagtctgagagccatgcgggcccaccccagttacgtctacccctggtcggtgaccagagaatcctttagcagcaacagcagtgatgtttatttcactggtatgtataaagcgactgattgaaaacaagctgtatgcccaacaacttggaactggttaaatgatttttggttcagccgcacagtggaatatcatgcggccattaagaataaataaaaaatcctatactttccatgttcaactttagactgcaaacaactgaaaaaacaccttcataattaggcttcctcagattagaacgtgaagtcaaatcaacgtgtgtcagaaagttaacaacagctaactgtttgttgtggtgttctgagtaacttgtattatttttcagtttttttcccattcctaatgtgcaaatgtactatttttattgtaaaaaaaaatacatgtttgtaaagagcaataacataaatctctgcataggcaaattgaaaggaaatcagacaaaatgataccttttggtagtggaattctaaatcatttttttcttcattagagtttctgaattttctgcatttgatatgtttacctttataaagggtcaatcatatttaagatgattttttaaaagacaagtggacagggaaagagaggtctgctgttgcaaaaccaaagctggaggctctccgaagcccacttatgttagtcaattgatatttcatgaaactctagaatgtgcaaatcactttccacggggattgggggggtgagaaatacagagatgaaggagatgcaaacactttaatcaaagaaatccgtctggttgggaagagaaggttctgcattatataagttgcaaggtcttatccaagaggttagtctgtcaagagtaatagcaataattacacaacaatatgtcagagaggctgggagctccagcttcaaagccaccttgcctggggagaaacttaaccatattgggcctgagcctcagttacctacctcttctgtaaatgtaaactacctcttggggtccttgtgaggattaaatgaaacttgagcctaaaggggctgagctaggtgctttgcaaataacccaaccttagcatgaggcacgttatcatcattacggctgtggtgtttgtggtcacctatctgcaagtcacgctttcatagatatggctgagctgggatttgaacccacattgatctaattccaaagccaatgattccaccccaaccagacactgcatttactctctatgcctaactgaaatttgttctaaacctcaccctaaggtcttgccagaaagaaaagctaaattttcattaaaagatgaaaggagaaatgaatctgtttcaaaggacatgagaggaagaaggaaatatcccttcatgaaggattttgcaactttgtccatgcttctgcagggtgtaaaagtaaaaatcctatacttcccatattcaacgttagattttaaacaactgaacaagcactttcacaattagccttcctcagattggaatgcgaagtcaagccaacgtgtacctcttactgcagaagatttctgcactgtgaatgtgataggatttgcctccttaaccagagggtgctggtttttcctggctggagggtagaaggtcatgaatagaggacaaagcacagggaaggggcagcatgtcgggaagagccccaaggatctcagtatgaaaataaagaggtgtgagccaactgcccataggtttgggctatgagtctggggaaactgtttcaaaatcaatggaggcccaaaggcagagggaaaattctgtgtatggacttccatgtcattcagaaatgttaactccttgaaaagagttaatatatttttttcttttttaaacatttcaataggtttttggggaacaggtggtgtttggttccgtgggtaagttctttagtggtgatttctgagattttggtgcacccatcacctgagcagtgtacattctacccattgtgtagtcttttatctttcactcccctcccacttagaataatgttctccaattccatccaggttgctgcgaaggacattatttcattcctttttatggctgagttgcattccatggtgtatatatatataccacaatgtctgtatccactcattgattgatgggtatgcaggctggttccatacttttccaattgcgaattgtgctgctataaacatccatgagcaagtatctttttggtataatgatatgttttcctctgagtggatacccagtagtgggattgctggatcaaatggtagttctacttttagctccttaagtaatctccacactgtttttcatagtggtggtactagtttacatttccaccggcaatgtaaaagtgtttcttcctgtccctctggtcatctgtttttttaagggatctacctaaactcaaccataacccattccatccacctcatcttgcctcaagctaagaaataggagtgcagagaagaaaacagtacagataagaatgctagaaggttgtgtgtttgaataagaaggaacatggatcaggtttcaagtacagtacctgaggcaggtatgaggtagtagctaatggggtgaggtaggcagaaaaggcttctaaagaagcaggtacttgagttgggtcttcaaggccatagtgagtggtttcccggtggatctgagaaaggaaggtgagtttagagaaagggaagagcccgcagtgaggcatgaaaatgtacactgtgccttcagcgagcttggtgggtggcaatgtctggatccaagtgcgtgtggaggagactttgcacaataaggccactaggcaggtaggacggcccccagagggttttggctgacaagctgagggacatgctataagggtaggggccaggggaagagatggctccctggcagtgggtcccctgtgtgctcggcagctcatggataacagaggataacaggcctgtacctccatattgcccaacatgttatcacatcttcagtttggagagaagaattaaattcgtctaagtttataatttaccagatgactttggataagcacatatttggaacctcagataattcatccattcatttgctcattcagaacagttcttgcgcatcactttatattcagtgctgctgaagtttctttgggggctacacaggttagtaaggcttggttttcatctcaggaaccttatagccagaatgagggagaggtgagtactaactccacagtgttatcccagtcgctactcatttcccttaccaccacgccttcaaacacttcagtgtactttcagctctcaggaaaaatgcaaactttcatctgggcctaagaatctctatatgaactacccctgctcacctccggagaggcatccccttccaccaccctcccctccttcttctctatcctcattgctcctttcaatggtcctgacaggatccctttcagccacaggcccttagcaaatgctgctctcacggcccaagtcatcttccctggttcatgcctacttcggattaaagttacccctccggagagtgttcccgatcaatctgaattgaccaagtccttattacacactctcaaactccatgagatgtccttcatagctctcatcccagttataattagtttgcatttatttacacaatggctgtattaatttctgtattctccaccagaatgagagcttcatgagagccaggatgtgtgttttctcaaaatctgctttattgtggtctaatttgtgtataataaacacacccatgttaggtgtacccatcaatgaatttttagaaatttattaaaaat

SEQ ID NO: 813 - DNA, 6941 bp, Homo sapiens; identical to SEQ ID NO: 812

SEQ ID NO: 814 - DNA, 6575 bp, Homo sapiens
ttttgaaatgttaacttggcagaaaattgtcagctggaaaccttataaatttcagaaatgatttacaagttttgttttatgaaagtcaaaattttatgctatctcattcattggcagttactgattctttacccacgtgtgttagaagacataaatgtgagaaatgtttccatcaaaccatgcatgcaattttacattttgtgatacaattaaataatctgcactgttacacatgaatttagtcttcttcggtaatctaaccaagtaatccattttacgatagttatgcagtatgccaattgacataagtctacttaatactaatttaagacttataattgattctatggggttcctgtactaaacaattccacttgaatgcctgagcaggaaaatgaaagaatgagttataggctgtaagaatgtgtttccgaacataccatcatcttcatcctgggaaggggaagaaaaaaaaagatattaagctatcatcaaaatacaattcttaaaataaaaactgcatttctcaatcaaataaatcaaataggtatctgtttctttctctggcagttatacatcttcataataaatatactgtggagaataatagaagttgctaagtgttttacaatttcttaatacaaacagtcatctaagggcattccagtatgagactctcctcatatactcagcatgaaatagattctgaggtgcctaaaagggcccaaagatgtaataatattgacaatatctacaatgtgtccaaaagattcatacacaagatttcattcagttcccctagtgaccccccaaaaatttaacatcctcattttacaaaagcatgatgctgaggaagcttccttagcttgccaggagttgcagagatggattcaaccccaaatatgtctgaccaaagctcagtcttctttttggctctcttttgcaatggccactcttcttaagatcaataagaccatatttatacggtggcttacaaggttcatctacaaccctcaccatttttatcttcagagcaaccttgggaaattagacaagggaggggctattttctcttccactcagataagaaatgaggttcaaagagaaaaaatgatgttgccaccaactagtagaccaaaagggccagcttgaacttgtttggttaggccagatctgtaatgatgaaacagcatctttctcaaagtgttgttagaaggattaaattagctactacttgtgtctggcttatgttaagtgctctttaataaaagtttgccatcatcaatcctatcacacactgagagaaggcgaaaaaggccacagtcaaaatcattcatcccagttggccaactgggagtcccagcaaagagctgcataaataaacacacatgggctcataaaccccacacaacaaaatcacttttcaatacttttgcaagtatattccctctggttccagaaaacacaactcccagattctcatgagcacaagtgtcaatccttccagagacagggaacctggaatgtgatgttatcctcactgtccagccttacctctgccttgttcctatctctgcagccaagccactgttctcactgtccctgcagcctccgtgggcactggtatccacctgctcaggacactcctgaggggaatccccatgggctttctttaagaatgactctattctgtgtcctccctatcattgaatgaccagcataaatctcacctcctctaggaagtcactgctggctccttgagccacatggcacactttcttccctcagccccacagagcatcccgtgattgcatgctgtctggcatgaggggttgtgagtgtgcctgcctccataagatctcagcacttcatcggaacaagcacagcatctagcacagagctgcaaaaatagcaggcgcttttgggctgagcccttgaatgacagcaggggtctgatggccttcagagggcttatggtgtagagaaactcagcagatctgggttcagatcctggctctttataagcatgcaatttgcaaagagtatcttattccttctgagcctcaatttcctctccgtaaaagagaaaagatgtttccttatgggttcattatactcatatgtaaagcgagaaatactcaactatcctggttttcctaggatggagatagttcttgggacaggggacttttcagtgctaaaactgacagcatccctcgcaaacagggacaactggtcatatttaactggcatggcaatgtgcatatggtaagcattcaagaaatgctatttcccctctttttcaggttgtggaagtattgaaaaggaaaacagtagccttggaaatttaggcatggtccaaacttctggccttcccttactttatcctctttttctccttgtgccctgtaattaccggcccctggtaatggagctgcaattaagccagccactctgggagctcttagagggacatgagctaaacaacacagcatgatgggctccagacaatgaccaaggcccaaagacagaggcaccagcccttaagagacgagacccctgggtgcaggacctgctccaggttctgggccaaggccaaggtggatggagtcccaacctcctaagagcctatgcttcttttccctgtatcaagcacttacaaactgacattttgtacttacattctctcttctgtctggtccccatccatgcctgaaatgaattagggcaaataaaaagaactgagcatgaagagtttcaaagagccagccttagaatacagttttgcttcattgaataatgagaaatcgaacccactgagcctagggaagatgggaagcaacagacccccacagagcaggggagagggggtggaagggagatctggttactccatgttctgccatcattgcaagctgagctaggcaaacctttgttctgcataactaatgcagcaaataattatgtgtgtgtgtgtgtgtgtatatatatatatatacacactctatatgtatatgtacacacacactatatgtatatacacacacacacacacacacatgtggtttagtcagcaaactaactctttagtagctattaaattttactgagctgttgtttttcccaagaaatgaaaacattttaggtaatattctcccttgctcttgctttaaaacagccctctcagggcccaccttggtgtaaagagaagacaattagaaaatgttgctgctttgggactattccaaagggggcttggtacactttgcccagatgaatgagctagtcaaacagacttggggacagctgccttagggctgcgacaggcatctgcactgcctgggccgtataatgtcctctctggggagaaggggaagagctggacaatttgttgaacacctcctgtgtgtcagacgcttcacacatcatcatctcattctgtgtttatttaaaattttggaattttgttccttatgagtttgctgcatttattttgattttttaaaaacattactctaaaatgttatcaaactccattactgaggaggttttttggcacactttagccctggtcctaatttaatcctcacaacagccaagcaagggtgatagttatgacccctgattcacaaatgagatggaagctttggttgtattctttgcaagtagcaaggttggccttaaccccaggtacatgcgcgccatttggtaaataggctgaaaactacttcacagcaaagttaaaaatactaaggcagagctcagtattctgcaattatcaaatgtggttgagcagtaaggaagacacttgcggtgacctgaaaaacctcccccaaccatttcctgtctgctacctgtattgaaaaataaaatggtgagtacagttcctatgcactgtgaaggctttgctataacgaggttggaaaactcaatgaaatatttgactggaatctctaaaaacagcagtcaccccttactcttgattagatgtcactctactcatttctcagtagagtccatttccttcaaagagaccctgatccttcatagccaacctgtgaagcctgaacatccctcaagccacagcaagaaaaggcccaccctgcccgggagcaccgaggagcctcggttcccactgcagagtcagcacagggcagcctgtctgccggccactgtgagtgacaagctcaagcaacaccagacaattactttggcacaggtggcttcttccctggcagggggctgctcctttcatgtctttccgtggtcggtggtaaaggaggcttttgaatcttgggtaaatgctccccgagtgacctgtggagttcaggaaaaggatgtgtaagaaacaaactttgccgaggcagagttctacagaacgtcccatgtaccctcatgtagatgcaacagtcttaccttcccgctggaatcgagggctgcaagacaggaggaaaaatgtatgagtgtccaagcacttttcaaagaataaggacaagatgtgaaacaaacaaacacaaccaaaaaacaagttcacagcttaccttgtcagaaaatggtggtttctttcctgtaaatgacagagagcagatgggccatgagttcagaacttcataagcatgaggtttaaaaacacagtttgatgaaactatgagtctgaaccctcttgggggttgatggggtttaagcattaaagaatcagaaacttcagactaggaagggtccgttagagaccaccaaattttataagctcagagaaattaaatggcttgaccatttaatttgaaggtcacacagctttgtgtacatacaagtagtgttgtggattctgtgctttttttaaataaaatcacattttcttttatataactgatgatcaaaaggattaatgtttccttgggattttatgcctctttaattggccaaagtatttcttctgcagcctaagttttatttttatatctgaaataaatccacttgccacggagagggtaacttttatccaattctgtgaaacacttgatattaaatgaagcactccacttagtttctgaagaaacttttcacttggggagagcatttcaggagactctcctggtatgctgcaaatcttttttgtctgcttgtttttagttagtattgtttgttttgcttttcttctagaacggatgatattcaggctccctgaagaaatgccaggtgtacttgataattgtgcatcacaaagttattcaaagtaatttaatttgtattctatctaaagtcccctagaataaatatgccctttgtcttcaatgtgatgaaaatattactaacaaaattcaaccaggtctagaagcaaatcccacatgaccaagaacaagttatttaaggtttttgaatcccaatgttatcatctcaaaatgaagattatagactaaaactctataggtttgccataagaattgggtgacaatttgcatgcaggatcaggcacttgattgtgaaagttggtcatacaaattgggaattttatcacctccaaggaaaacagagtcgagaagccagagggaaaagcactcaggacacataacattgctccagaaatgtgattctatgtgaggttggctgttgtaacctgaaaccagtttcatctagtagttgctgaaataatctgctgcaactcgaagattaattttgccctctgccattgctcaccaatcaaaacttgccagcccccagaaccgatgaactttctcaaggagcgatattgtaacacttctcctttttataaaacctccaatcttctttttgttcttcagacatactgaagaccctgaagaccaattgccccaaattgcaattctttcttcctaaataaaacaaatttagagattttcttctacgtttttattttgactttgatatggtccatgtgggctgacaattgttagttaactcgcctttctttcccttccttccacacccaggcacagttagtgccctatggcgaatggtgatattatctccctggagttgtattttcacaacgtgatttattctttaaggaccaagtacatgccaggcccatgataagaatattgcctcactgtgaagagcttactgacactgagtgtggtggctcatgcctgctgggaggccaagacaggagaatcacttgaggccaggagttcaagatcagcctggtgaacacagggaaatcccagtctctacagtatatttaaaaattagccaggcatggggacatgcacctgtaacctcagccccttgggaggctggagaagaaggattgcttgacccgaggagtttgaggccgtaacgagctatgatgctgtcactgcactccagcctaggtgacagagtgagaccctgactcaaaaaaaactaaaaataaaaaaataaaaataaaaaggagcttgctggtaatggggagagttttgacggtataaaagatgcttataaaagtttggtttggggtggaacctctactttagaggggcacccaggaaacttaaatttatattctttggcctgaataagtatttcaaaatttgcctttttttttttttttttttttt

SEQ ID NO: 815 - DNA, 6575 bp, Homo sapiens; identical to SEQ ID NO: 814

SEQ ID NO: 816 - DNA, 6575 bp, Homo sapiens; identical to SEQ ID NO: 814

SEQ ID NO: 817 - DNA, 10675 bp, Homo sapiens
tgtttcgatagttttattggaacacgatggtaacacaaacatggatttggggtcccaccacagatgttcctcctccaggcagcatgcaccccacttctgcagccagcagaggctccaggaggcctgcagaaggtggaggcagcccagagacagacgtggaggcgtcttctgcagtggcgggtggtgcgtgggcccctcgggccagagctctgaccagctgagtctgtgaacagccagactggtttgttttcacttgaggtcatgtggccgtgactgagagacctgcctgcctcagactcctgggaaaacttccaaggagggggattctggggattccagaaggaattcagccaagagactaagcacctctggggggatcaccagggcaaatcatgcctttaggtttattggcagatacactgctgaaagcatctgttttggccactctctgcactctcttttctctgatcattcatccaacacatatttattaagctcctaccatgtgacaaactctcctctaggggttagacagacaacggtcaccagaaacagacaggacccacagcctggtgaggaggagagacagacaacgttcaaggaatcacgcaaacagccatgccagtgccttccaaggagagctctgaggggtgtggcagggggcctggtttggtgtggagggtcaaggaagacttcctcaaggaagtgacatttcagggcactaaaatgagcaggaggagcctttcctcacggaaacagctttgagcatggaatgggcagagtgagttaatcaaactaaaaggaaaagaacagcagggccagagtgaagtgacggaggaggcctggtgcagggagaaggcaggcacgcagctgcaggcacgcagctgcagacacgctgagggagagcgcctctgaaactcccaggtggaggtgttgcggaggcggcagtgggtctcaagctcccggaaggagccaagcctgcagttataaatctgtgagtgatttcataaccaaacctcgtgccttgtaactggagttgtgggtgcagacgaggtcacaggaggagagatgctgagtgagaagagaggactctggactgagactgaggaacagccacatctgatggcaggtagaggacaatgagttgcaaaagggacagaaaagggaggtcggggatgtcagggagggggaagatcatgaagcatcttggaaaccaaggaagattgagtgtcaggggccagccaggagatgccactgagaagccctgggggtagaagtccctccacagccccctctctctggggctggcactaccctatctctttgagtctctttatggatcctgtaaataggaacagggggcctaccctcttggacaggggaatcaaaagctgcttagagtggtcaggagacgtgcccaaggtcatacggccaccagagagtgctgggggccaactcccccattcacaaccattacagtccctcaagatccatccctccctccatgatgcctggctgcagacactctctccagcaagtccaccgcataccacttcttgatgacaagcaccagagagggtcatactgtagcaggaagggacccccagagcctgggggtctaagccttgctaggaggaaggtggctgagtcaaggaaatatttgccttctctcctgagaggtggtgtagtgcagtgtcagtagtgtgggcttgaggcctggcttttcacccgttctctcattcattcacccattcaacacatatttttgtgtgcctcctatgtgctaggcacactttctaggtgctgagtggccttgggcaggtcccttacttctctgagcctcagtttccatctctgtaaagtcggggtgtgattcttgctctaaactcatgttgctataagggttacgagagctcatgccagggaagcacctggtacacagtaggtgctcatgaaaagctatttccttcctttctctgtcttttcctttcctttccttcatcctgcagaacccatgagggagtgagaggccaatgctttcttcaataccctctgccttgctcagaggtcatgcacgtccctacacgtatgcacccatgcacacacatgtgcacgcatccccgtctgtcccaccgtctctgctcatgactcccagggccagcaccaacgtgagctttgaacccatgggattcagcccactcgggcccagaggagtcttgcgtgcctgtctgggaatgctgagcacagaataggctgttccgccctaggcctgaggaccccacacccagctgtgtgttctgggagcccccagattcagtccagggtgagtccttggtggctttggagactgggtccttaggagctccaggagtcacatcttggggaccgggagcggtatcttcagtgtcctggggctaggtctagacagcctcagagggcagcgtcctcaccgctttctggggaggtctcttctgtggctcctcagacagtggctcccccgatagctcctccgaggggcctcccatgtgtctctgaaggaacctgagcccccacaggctcttgcagcagctcaggaggttgctggagcacgtagtgcaggacagtgctggcttcctgaggagacacaagcacatgccaggctgaggtggccacagagcaaggcgggggcagaccaggtttagcctctcaattttgcttctactaagccagggcctggggagggtgggatggggtggggaggggaggggaaccgccctttgccacccagagcagcctataggcaacaaagacttcttccctcaacccacaagaaggagtattcaggagacttgctttgaaatcctaactctgtttctaacatgttgtgtgcctgtggtcaatttacttactgtctctggacttcaaatgaagataaaaatatccaattcacgatttttgttttgtttttgtgtttgtggtttttgagacagggtcttgttctgttgcccaggctggagggcagtggcgtgatcatagcccactgcaacctctaactcctgggctcaagggatcctcccacctcagcctcccgagtagctgacactataggtgcgtgccactatgcctggctagttttttaaaattgccttttttatagaggtgggttgtcactctgtttcctgggctggtcttgaactcctgggctcaagtgatcctcctgcctcggcctcccaaagtgctgggatgacaggcatgagccactgcttgcagccctcacttttcctactcctgaaagaattcagtgttacagaatacatataaaagtaagcacacacaggctgtctggtagtaggagccccgtcaaagtgtgccatttccgaatcttagtgagatgattcctgagcatctgcagcatgccccgagttggggaagaagtttgggagaagtctgagttactccatctggcattcaaatcagctgtgaacacctcggccaccaagggaatcaagcgtactgctccctcccccttccacatagagagagggaagggaaccgtcatgcctttagcgtccacctgatgatagctgtgggtttggaggcctgactttgtaaagctttgtgaacaaggacatagctgacatctgcgcttccttccatgtgagggcatgtgccggccaggccattgcagaaggcctgggtgtggcccttcctccctgaacaccccacctgcacctgggcctcaaggtcatccctctggcatttcagagcctgtgggcgtcctttaccatgttagcagtgtacatatttgaccaagcaggcaggtatttgcccttgcattaacattccagatgcagcctgtggctctgagaaggcaactctcattgcactcggtgaaattatcaaagaacagctagctctaggctaggaaataaccacctcccttcttctaaggggcctaaaaatccctaaaaataatgctattttggaaataccgcatgttcatagtaacaaattcagaccatagagattaactaaaaagaaaataaacatctcaattcttcctctattcagtcatatctctttgttacatgtcaatttactcattaaatatttttaaatgaaatgcattaagcatccaaagagacgctatataaaacacatatacatggcttaaggactattgaaaagcataccagtggaaccacctgtcagattaggaaactgaacttttccagcccctgatttctttcagcaaatatttctgtatccctaaacaatctatcgtgttgttctacctgtatttcacttgtaggtatataaaatcgtgttttatgatcttttctctgtagctaaccttttgttattgtttaacattatattgttgataggtatagctgtagctcattttcacagttttaaagtacttcagggccaggagcagtggttcatgcctgtaatcctagcacttcgggaggccaaggcaggccgatcacttgagctcaggagtttgagaccagactgggcaacatggcaaaacctgggcaacatggtgaaaccttgtctttacaaaaaaaatacaaaaattagccgggcctggtggcatgcacctatagtcccagctacttgggaggctgaagcaggaggatcgcttgaacctgggaggctgaggctgcagtgagctgagattgtgccactgcactccagcctgggggacaaagtgagaccctgtctcaaaaaaaaaaaaaagtctactctgggcacactacctgtaggggtaggtagtcctgctccataagaagcagttaaaaaacaaacacacaaacaaacaaaagattgggcataagttgataactatttacatctgtgtgaggggttcagggagccttactatgtatatgtttaaaatgtgccataattttttaaaaaaaggtatttcattgtatgaatagacttcaatttatttatgcatttatctgttgaaggacatctggattgtttcgagttttttaccattacaagaaatgctgcttaggacttcactggacctgtcccccggtgtataggtatttgagtgctagttgaattctctatccttttccactggtctatttgtctattcttgcagcattaccaccaaggacttaattgctatatcttattttttcctgtttggaaaagacttggctattcctgagcctattctcaaccatacagattttagaatcagcttgtccatttctatgagaacactgtttggattaatgggaattgttctgaacatacagattaatttggcaaggagaaacatctttataatattgagtcttttcctccaggatctatgagtcatttgaattaatgttagggtataacaagggtattgcacataagatcagtatacaaaattcagttgcacatatggagtccaattctctatgtatcagaaagaggtagcaagaaaatgcaatttataaaaggataccacacttacaacaacaaccaaaatcacaaggcacccaggtactcatctaacaaaagacatactagatttttatgaagaaaagtatataatcattgaaagatttatttagctcttcttcaatgtctaattttctgattgttcttataagtggtagttttcaaaagttgacaatgtacgttgattttatgtctggcaatgctgctcaactttctcattcatgacaacaatttgtagatactttttggtttctgtatagaggatggttattagctgtgaatagtaatagttttgttttctcccccttatttttttaaatttatttttcttgtcttactggactgatctccggtaatatgttgaatagaagtgtgatggccagctctgctccttattttagaagtggtttgttagtgtttcctcaggttaaggaagtttccttccattcagaatgtgctcagagattttgttttgtgtttcaaatcgtgaataaatgcttaaacttactcagtgtttttttttctgcttcgattgatataatattcacagagttttttcttctttaatttgttgatgagctgaattacattagtaacatttctaatattaaagcaaccttctatttctgtataaatctaacttggtcatgaggaattatatttttcttttaaaatattgcatgattatgttttctaatgctctgaaatttttgtaagtatgttcatgtttctgattagcttgtaatttcctttttgatacttatttttgaatctgctctcataaaataaataggagagtttctctctttttctctcctctgagagagtttatataggactgcacagtgatctcttttctttgagtgtctggtagaactcatttgcaaaaccaaatactattggtgttttattcatattatgtatttatttttaaaatatggaattctcatgaatttgcatgtcatacttgcacaggagccatgctaatcttttctgtatggctccagttttagtgtatgagctgccaaagtgagcctgccattttatttatttttaatggttatatggcaattcaggttttctatttcttcccaagtcagttttggcaagttctgtttacttattcacttcaccttagttttttcttgttttgggcataaaattgatcataatgttcttattatcttttttgatctctgcaacatctgtattaatatctcccctttattattcatagtctttacttatgttttttattctgttatcttaacaagttttgccagaactctttaaagtactaaagtttggttttgttgctcttctcattattaaatctttgtcttctgtttcattaatttcttcctttgtctctactgtttcctttctttaattatctttgagtttattttgttgttctttttaacttcctaaattggctgtttaaatcgttaaatttcaaatttgcttttaaaaatatgagccattatggctatatatttccttttgagtagcgttttagtggcatcctataagctttgatgtgcagtattttcattgtcgtttactttaaaatgttttctaatatccataattactttttcttcatcccatgatctattaaaaaatgtttacaactatgtaagagttttgttatgatttaattttgttgtagtcagataattgttctgtatgaagcatattcagtgccttgaaatatgctgatacatacttcttaacctaacacatggccagctttttaaatattccatgtgtgcctgaaaggaataggtactctctagttattagtgacagtgtcctaagcgctttgtgtttcccaaatattaattactaattttttacatgcttagtctttaaattttgatagaggtatattatacattttctgctgtaatgattatttgttaatttctctttgtagttctgtcaactttacatatttttgaagcagggttatttggtacatacaaatttaaaatttatctttctggtgaactgaactgtttatcaaaatatggtgatcatatttatctttaaagatggtatatttggttgggcacagtggctcacgcctgtaatcccagcactttgggaggccgaggtgggcggatctgaggtcaggagatccagaccatcctggctaacatggtgaaaccccatctctactaaaaatacaaaaaaaaaaaaaaaagaaaaaattagccaggcgtggtggcgggtgcctgcagtcctagctactcaggaggttgaggcaggagaatggcgtgatcttgggaggcggagctttcagtgagccgagatcgcgtcactgcactccagcctgggcggcagagtgagactccgtctcaaaaaaaaaaaaaaaaaaaaaaaagatggtatactttttgcttatagctactcagatttctttcagttagtatttgctgagtatatcttttttttccttcctatgctttcaaaaattatgttctttatattttaagtctcttgtaaaaacatttgtttggatttaaaaaaccaagcctgacaatctttgtatttttttaattggccaatttattccatttatattcactgtaattactgatttattttcattcatttcttccatctgtttttgtgctttaaatttgtcccatttttttctaaattttcctcctcttttcttgttttaagttgatttctttttctcattctctttcctccataccatatggaatctctaccttctgtattttaagtgattatccgaggcattttgacatgcatatttagctttaaaaagcccagtggcaggagcccctctctctcttacttgccccccatgccgtgcataagctgggatgagacaccaagctgggattcccatgctgtgtagactctagtacagattacccttaatggcaaaaaccgcaattacttttgcaccaacctaccacttgcagagattctagtaggtttaatcttcttcaacccccttcacggtcccacggcccgtctttgccctgagccagaacactggaagctattttagcggatgttaacggggttctaggtgtgtataacgcgatatctgccgagcagtaagtgtttgtgagaaacacctcgttttcacatttccatcctcagttccccttctcatgctaacagcaccttgattcttcttcagaattcgaccttccccactttttgtccttgtagattaggtggagttgacctatttccctttgccctggcttcagggttgggcacgtgacagttggttgagggatagacacatgacccaatccaatgaaaccaaagcctggagctttttgttagaatagtaggaaagggacatacttttcccttgggtctgcaaagatgttaagatagaagcttggacctgctggtggctctatgggaagactccggctgaggattacagcggcaatccgagcgggaagccgagttgaaagttggagaaagacaaattcctgaggacatttgagcccttgggtccgaccatgcttgaagctactcttagtctcttcagttctatgagtcagttacctatctcccaaaccccatcctcttttaactgggtttctgctccttgcagttaagagagctcagactaatcatattcctaaataaatgtcatttgaatctgactcccgtgtttttacatggaccgtgttataatatgttcagccaccaggggacaggacccagtttcagagctgcttgggtagctttgctcagccccgctctgagcctcggtttcctcatctgtgaaatgagttaataataacgacctcacagggctaatgtgaggacaatggatgatgaatgccagtgccccttcccatttccctccactgcttatcctacaagtgatcagacagaaccaccatctgtatgtgttatcctgctatttcttgcatctgtgcttttgcacagatttttgttattcccactgctttaaattcctgtattttcttctttgctggtcaatttatcctgtttttcttttcttttcttttttttgagacagagtcttgctctgtcgcccaggctggagtgcagtggcacgatctcagctcactgcaaccttcgcctcccgggttcaagcaattctcttccctcagcctcctgagtagctgggattacaggtgcatgccaccatgcctggctaattttttttattatttttagtagagacgtggtttcaccatgttggtcaggctggtctcgaactgaccttgtgatctgtctgcctcggcctcccaaggtgctgggattacaggcttgagccactgtgccaggccaatttctcctgtttcaatattctgttcagtatcatctcctctgggcagctgtctctgaggtctcccagaattactggttccctcctggctcctgcagcccctttgccgaggcacttatgtccctgggttaggtgtcagcttacttgtctgtctcctggactaaacaggagtgtcataaaggcaggcattggatctttcatcatctaccttgtccaagtttatagtaggtgttcatgtgtgttttggatagtgattctcctgtcttctaacttcccaaattcacagatggtcagaggcagtccagcttctccccggctgtctccggtagccggtacccactttctggctttatttcaccatctaccttctcaccgccagcctgtaagagccttgtgggcaggaacccttgagggagacagtgagggaggtttaccacttcaacaaatatctgagcagcaactgcatgctaggagtgaataggaggaggtgtgagattcggaaccaggagttccgcgttctgtctgagccttcctcatcccctgctgctgggtctcacacaactccgtctctctccattcttcagtccctctccacatctgtacaacagggacagtcctgaagaagaggctgtcagagccatgagatgagatgggagaagtggaatgttttgaaatttcagggaatcctccttctctttctcctcctttgtaaatgctttgtccctgagggtccctaaaagctgacagtagatcacgcctctaatcccagcactttgggaggctgaggcgggcggatcacgaggtcaggagatcaagaccattccggctaacacggtgaaaccctgtctctactaaacatacaaaaaattagccgggcgtggtggtgggcgc

SEQ ID NO: 818 - DNA, 2922 bp, Homo sapiens
atggaataaccgaggtatgaatgaacagttttgagcactaaaacacactaagggctttgttatggactgaaatgtgtcctctccccagagtcacaggattatgaagccataatcctcaatgtgactatatttggagcaggggcctttacagacataattaaattaaatgaggtcataagagtggggccctagtctgataggactggtgtccttacaagaagagggagagtcctcagagagtcctctctctcggcatggacacaaaagaaaagccatgtgaggacacagagagaaggtggctgtctacgagctaggaagaaaggcctcaccggaaaccaaccctcacagcagctccatcttggacttccagcctccggaactgtgagaaaataaatgtttgcaattcagggagctccacccagcagcagcgtttgacagagctgttcacttcctcttcctggagctgtggcttccagagcccatgctcagcagttcccctccttcttcgactgctcctctcttaggctcagagccactcagacattgggaagcaagtttgtcaagatgacagagaaccgaggtaatggattcgagtgatgaaacaggaagttcattcatgagtttttggccacacctccaaagtgacgacttagccagaaatgggataactgggtttccctacttctcttttatcatcctcaatgagagtgaccaaatattagagctagatggaaccttagtgaaaatctggctactcgtcccgtcccaccagcctgccacccatttcaagtttgaagagacaaagacacatggaccttatgtaattactggggattaccccaggagtctgtggcaaaagtcagcttcttccctccctgcttccccgccctgtctctggtactttctaccaacactgggctgtttctgtgatcacacttaagcgtacctaacctgcgaatgctgtatagaaggtgctaatgaacatgatttagctttaacactcagttttctaaagggacacgtgggggcagcaaatgtttaggcaaaaacaattccagttctagcctctactgtctacatatgtgtatacatttgggaaacgtttgggaaagggatatttgagagcttctttttcttttttgtggtttagttatttgatgatattgagattgtttctgagccatgtgcttcaacatcggattggggatttcagaaaaagttttagtcactgtgattccatttagcttccaaatgtgtctctgctaagagacttaaaagcactcataaatagcacgtgtgtcttctttgcagtgtttgctaattttgagtcacatctttttagaaaatcatgagatttggtgtcacagagactggaataaatatagtcaaacttattggtgaagatttcctttagctgttttcataatccatttccattgttatgattattgatgaataaaacattttctttaggtagatacttcttttttccccccaccttgatttaatgtttccactcttattgtcaagtttcttattactccctaataactctcaataaaataatgattcctgggagattattcctgctttcctactatcacctgttgatttgaaaagacagaacaataccgtagaagcttcactaatacattgaaagataaaatgataatactaaatactaaaatatgaaaagtgatactaaaagtggagtcctggcactagtatttttttttttgagtctttaaattttatttatttatttttgaattttttaaaattatatgttatgttctgggatacatgtgcagaacgtgcaggtttgttacataggtatacaggtctggcactagtattttgttgccacaaaatatcaagcatgtatccaaactgctcaagacacattaaagacacaggtaatctgtaggcatattcaggcttgtagtttgcattttttggttttcttgtggctttcagtgcaagttgaggtaattcatgggaaacagtcaccaaagaagtgccagtattagaaatccaagagccatttctctagcttcttccagaatcaagactttagaggtaatttctatcaacactggacatttcctgtctgcaattaacaatgaacacatagcattatgtttaattgcaacctgtttaaagcagattggatgctaaggtttaagaacactcttcagtcaaaaaggtcttttaatcaggtttttaatcttgagcacaatctaggacacagcatcatagactaactcattcgagaataggtgttgtcatctaatcctaaccacccccaccaccaacaagctgaatagctctgggctcagtatatacatttgtactgggctcagtacacacacctaagctgggttcagtatatgccactttatagtgagaggcattttgtaatgagagctctgggttcactatatacatttgtactgggctcagtacacacatctaagctgggttcagtatatgccactttatagtgagggccattttgtaatgagagctctaaggctctaaaattctgtgtttctgctagtttcttcctcaagataaaactgtggaactcatagtgaattccctctctttgggcagtttgagccaggccgctatttaatcacaacatcacaagtcagatttttcctacctagtgttggcagtggaacacaccagaactgctaaggccaaggaaatcccattttttgaagaggctttcctttgttagcttctctttctagtagtaaaggtaaaagaaaaatagatgttaaagatataaatatcttagggggtttttattggtataaatatttgtacacaaaaagaatatgtaatgtaaactggatatgtattttttacattttacttaacctgaattttacacaatctttgcttgaatgctcc

SEQ ID NO: 819 - DNA, 3083 bp, Homo sapiens
gctctatattgtaaaaaataacaaaaaccctgaagtggtaatatcgtaggcaataataatggaataaccgaggtatgaatgaacagttttgagcactaaaacacactaagggctttgttatggactgaaatgtgtcctctccccagagtcacaggattatgaagccataatcctcaatgtgactatatttggagcaggggcctttacagacataattaaattaaatgaggtcataagagtggggccctagtctgataggactggtgtccttacaagaagagggagagtcctcagagagtcctctctctcggcatggacacaaaagaaaagccatgtgaggacacagagagaaggtggctgtctacgagctaggaagaaaggcctcaccggaaaccaaccctcacagcagctccatcttggacttccagcctccggaactagctcaccagcctgaggtaggaatcattccatctgtgttactaatgagaccgctgaggatcaaaggggttttccaccacatccactcacctctacatggcgaaaaccaagggttcactctctgtcttcagggagctccacccagcagcagcgtttgacagagctgttcacttcctcttcctggagctgtggcttccagagcccatgctcagcagttcccctccttcttcgactgctcctctcttaggctcagagccactcagacattgggaagcaagtttgtcaagatgacagagaaccgaggtaatggattcgagtgatgaaacaggaagttcattcatgagtttttggccacacctccaaagtgacgacttagccagaaatgggataactgggtttccctacttctcttttatcatcctcaatgagagtgaccaaatattagagctagatggaaccttagtgaaaatctggctactcgtcccgtcccaccagcctgccacccatttcaagtttgaagagacaaagacacatggaccttatgtaattactggggattaccccaggagtctgtggcaaaagtcagcttcttccctccctgcttccccgccctgtctctggtactttctaccaacactgggctgtttctgtgatcacacttaagcgtacctaacctgcgaatgctgtatagaaggtgctaatgaacatgatttagctttaacactcagttttctaaagggacacgtgggggcagcaaatgtttaggcaaaaacaattccagttctagcctctactgtctacatatgtgtatacatttgggaaacgtttgggaaagggatatttgagagcttctttttcttttttgtggtttagttatttgatgatattgagattgtttctgagccatgtgcttcaacatcggattggggatttcagaaaaagttttagtcactgtgattccatttagcttccaaatgtgtctctgctaagagacttaaaagcactcataaatagcacgtgtgtcttctttgcagtgtttgctaattttgagtcacatctttttagaaaatcatgagatttggtgtcacagagactggaataaatatagtcaaacttattggtgaagatttcctttagctgttttcataatccatttccattgttatgattattgatgaataaaacattttctttaggtagatacttcttttttccccccaccttgatttaatgtttccactcttattgtcaagtttcttattactccctaataactctcaataaaataatgattcctgggagattattcctgctttcctactatcacctgttgatttgaaaagacagaacaataccgtagaagcttcactaatacattgaaagataaaatgataatactaaatactaaaatatgaaaagtgatactaaaagtggagtcctggcactagtatttttttttttgagtctttaaattttatttatttatttttgaattttttaaaattatatgttatgttctgggatacatgtgcagaacgtgcaggtttgttacataggtatacaggtctggcactagtattttgttgccacaaaatatcaagcatgtatccaaactgctcaagacacattaaagacacaggtaatctgtaggcatattcaggcttgtagtttgcattttttggttttcttgtggctttcagtgcaagttgaggtaattcatgggaaacagtcaccaaagaagtgccagtattagaaatccaagagccatttctctagcttcttccagaatcaagactttagaggtaatttctatcaacactggacatttcctgtctgcaattaacaatgaacacatagcattatgtttaattgcaacctgtttaaagcagattggatgctaaggtttaagaacactcttcagtcaaaaaggtcttttaatcaggtttttaatcttgagcacaatctaggacacagcatcatagactaactcattcgagaataggtgttgtcatctaatcctaaccacccccaccaccaacaagctgaatagctctgggctcagtatatacatttgtactgggctcagtacacacacctaagctgggttcagtatatgccactttatagtgagaggcattttgtaatgagagctctgggttcactatatacatttgtactgggctcagtacacacatctaagctgggttcagtatatgccactttatagtgagggccattttgtaatgagagctctaaggctctaaaattctgtgtttctgctagtttcttcctcaagataaaactgtggaactcatagtgaattccctctctttgggcagtttgagccaggccgctatttaatcacaacatcacaagtcagatttttcctacctagtgttggcagtggaacacaccagaactgctaaggccaaggaaatcccattttttgaagaggctttcctttgttagcttctctttctagtagtaaaggtaaaagaaaaatagatgttaaagatataaatatcttagggggtttttattggtataaatatttgtacacaaaaagaatatgtaatgtaaactggatatgtattttttacattttacttaacctgaattttacacaatctttgcttgaatgctcc

SEQ ID NO: 820 - DNA, 3019 bp, Homo sapiens
tttggagcaggggcctttacagacataattaaattaaatgaggtcataagagtggggccctagtctgataggactggtgtccttacaagaagagggagagtcctcagagagtcctctctctcggcatggacacaaaagaaaagccatgtgaggacacagagagaaggtggctgtctacgagctaggaagaaaggcctcaccggaaaccaaccctcacagcagctccatcttggacttccagcctccggaactgtgagaaaataaatgtttgcaattcagggagctccacccagcagcagcgtttgacagagctgttcacttcctcttcctggagctgtggcttccagagcccatgctcagcagttcccctccttcttcgactgctcctctcttaggctcaaaacctgtaacaatgcatggcacacggaagatgtgagaatttgctgaataactgaatggcaccatgttgcctcacctaaggataatgactaagaataggaaaaatttactgtgcaaagatcagttcttaatagctgtctacatctcagaacaaaaaaaattagatgtaaaccattgcacaaaggattagatgaaatttttttgaaaaatcagacattggaggctcagagccactcagacattgggaagcaagtttgtcaagatgacagagaaccgaggtaatggattcgagtgatgaaacaggaagttcattcatgagtttttggccacacctccaaagtgacgacttagccagaaatgggataactgggtttccctacttctcttttatcatcctcaatgagagtgaccaaatattagagctagatggaaccttagtgaaaatctggctactcgtcccgtcccaccagcctgccacccatttcaagtttgaagagacaaagacacatggaccttatgtaattactggggattaccccaggagtctgtggcaaaagtcagcttcttccctccctgcttccccgccctgtctctggtactttctaccaacactgggctgtttctgtgatcacacttaagcgtacctaacctgcgaatgctgtatagaaggtgctaatgaacatgatttagctttaacactcagttttctaaagggacacgtgggggcagcaaatgtttaggcaaaaacaattccagttctagcctctactgtctacatatgtgtatacatttgggaaacgtttgggaaagggatatttgagagcttctttttcttttttgtggtttagttatttgatgatattgagattgtttctgagccatgtgcttcaacatcggattggggatttcagaaaaagttttagtcactgtgattccatttagcttccaaatgtgtctctgctaagagacttaaaagcactcataaatagcacgtgtgtcttctttgcagtgtttgctaattttgagtcacatctttttagaaaatcatgagatttggtgtcacagagactggaataaatatagtcaaacttattggtgaagatttcctttagctgttttcataatccatttccattgttatgattattgatgaataaaacattttctttaggtagatacttcttttttccccccaccttgatttaatgtttccactcttattgtcaagtttcttattactccctaataactctcaataaaataatgattcctgggagattattcctgctttcctactatcacctgttgatttgaaaagacagaacaataccgtagaagcttcactaatacattgaaagataaaatgataatactaaatactaaaatatgaaaagtgatactaaaagtggagtcctggcactagtatttttttttttgagtctttaaattttatttatttatttttgaattttttaaaattatatgttatgttctgggatacatgtgcagaacgtgcaggtttgttacataggtatacaggtctggcactagtattttgttgccacaaaatatcaagcatgtatccaaactgctcaagacacattaaagacacaggtaatctgtaggcatattcaggcttgtagtttgcattttttggttttcttgtggctttcagtgcaagttgaggtaattcatgggaaacagtcaccaaagaagtgccagtattagaaatccaagagccatttctctagcttcttccagaatcaagactttagaggtaatttctatcaacactggacatttcctgtctgcaattaacaatgaacacatagcattatgtttaattgcaacctgtttaaagcagattggatgctaaggtttaagaacactcttcagtcaaaaaggtcttttaatcaggtttttaatcttgagcacaatctaggacacagcatcatagactaactcattcgagaataggtgttgtcatctaatcctaaccacccccaccaccaacaagctgaatagctctgggctcagtatatacatttgtactgggctcagtacacacacctaagctgggttcagtatatgccactttatagtgagaggcattttgtaatgagagctctgggttcactatatacatttgtactgggctcagtacacacatctaagctgggttcagtatatgccactttatagtgagggccattttgtaatgagagctctaaggctctaaaattctgtgtttctgctagtttcttcctcaagataaaactgtggaactcatagtgaattccctctctttgggcagtttgagccaggccgctatttaatcacaacatcacaagtcagatttttcctacctagtgttggcagtggaacacaccagaactgctaaggccaaggaaatcccattttttgaagaggctttcctttgttagcttctctttctagtagtaaaggtaaaagaaaaatagatgttaaagatataaatatcttagggggtttttattggtataaatatttgtacacaaaaagaatatgtaatgtaaactggatatgtattttttacattttacttaacctgaattttacacaatctttgcttgaatgctcc

SEQ ID NO: 821 - DNA, 3188 bp, Homo sapiens
ggactgaaatgtgtcctctccccagagtcacaggattatgaagccataatcctcaatgtgactatatttggagcaggggcctttacagacataattaaattaaatgaggtcataagagtggggccctagtctgataggactggtgtccttacaagaagagggagagtcctcagagagtcctctctctcggcatggacacaaaagaaaagccatgtgaggacacagagagaaggtggctgtctacgagctaggaagaaaggcctcaccggaaaccaaccctcacagcagctccatcttggacttccagcctccggaactagctcaccagcctgaggtaggaatcattccatctgtgttactaatgagaccgctgaggatcaaaggggttttccaccacatccactcacctctacatggcgaaaaccaagggttcactctctgtcttcagggagctccacccagcagcagcgtttgacagagctgttcacttcctcttcctggagctgtggcttccagagcccatgctcagcagttcccctccttcttcgactgctcctctcttaggctcaaaacctgtaacaatgcatggcacacggaagatgtgagaatttgctgaataactgaatggcaccatgttgcctcacctaaggataatgactaagaataggaaaaatttactgtgcaaagatcagttcttaatagctgtctacatctcagaacaaaaaaaattagatgtaaaccattgcacaaaggattagatgaaatttttttgaaaaatcagacattggaggctcagagccactcagacattgggaagcaagtttgtcaagatgacagagaaccgaggtaatggattcgagtgatgaaacaggaagttcattcatgagtttttggccacacctccaaagtgacgacttagccagaaatgggataactgggtttccctacttctcttttatcatcctcaatgagagtgaccaaatattagagctagatggaaccttagtgaaaatctggctactcgtcccgtcccaccagcctgccacccatttcaagtttgaagagacaaagacacatggaccttatgtaattactggggattaccccaggagtctgtggcaaaagtcagcttcttccctccctgcttccccgccctgtctctggtactttctaccaacactgggctgtttctgtgatcacacttaagcgtacctaacctgcgaatgctgtatagaaggtgctaatgaacatgatttagctttaacactcagttttctaaagggacacgtgggggcagcaaatgtttaggcaaaaacaattccagttctagcctctactgtctacatatgtgtatacatttgggaaacgtttgggaaagggatatttgagagcttctttttcttttttgtggtttagttatttgatgatattgagattgtttctgagccatgtgcttcaacatcggattggggatttcagaaaaagttttagtcactgtgattccatttagcttccaaatgtgtctctgctaagagacttaaaagcactcataaatagcacgtgtgtcttctttgcagtgtttgctaattttgagtcacatctttttagaaaatcatgagatttggtgtcacagagactggaataaatatagtcaaacttattggtgaagatttcctttagctgttttcataatccatttccattgttatgattattgatgaataaaacattttctttaggtagatacttcttttttccccccaccttgatttaatgtttccactcttattgtcaagtttcttattactccctaataactctcaataaaataatgattcctgggagattattcctgctttcctactatcacctgttgatttgaaaagacagaacaataccgtagaagcttcactaatacattgaaagataaaatgataatactaaatactaaaatatgaaaagtgatactaaaagtggagtcctggcactagtatttttttttttgagtctttaaattttatttatttatttttgaattttttaaaattatatgttatgttctgggatacatgtgcagaacgtgcaggtttgttacataggtatacaggtctggcactagtattttgttgccacaaaatatcaagcatgtatccaaactgctcaagacacattaaagacacaggtaatctgtaggcatattcaggcttgtagtttgcattttttggttttcttgtggctttcagtgcaagttgaggtaattcatgggaaacagtcaccaaagaagtgccagtattagaaatccaagagccatttctctagcttcttccagaatcaagactttagaggtaatttctatcaacactggacatttcctgtctgcaattaacaatgaacacatagcattatgtttaattgcaacctgtttaaagcagattggatgctaaggtttaagaacactcttcagtcaaaaaggtcttttaatcaggtttttaatcttgagcacaatctaggacacagcatcatagactaactcattcgagaataggtgttgtcatctaatcctaaccacccccaccaccaacaagctgaatagctctgggctcagtatatacatttgtactgggctcagtacacacacctaagctgggttcagtatatgccactttatagtgagaggcattttgtaatgagagctctgggttcactatatacatttgtactgggctcagtacacacatctaagctgggttcagtatatgccactttatagtgagggccattttgtaatgagagctctaaggctctaaaattctgtgtttctgctagtttcttcctcaagataaaactgtggaactcatagtgaattccctctctttgggcagtttgagccaggccgctatttaatcacaacatcacaagtcagatttttcctacctagtgttggcagtggaacacaccagaactgctaaggccaaggaaatcccattttttgaagaggctttcctttgttagcttctctttctagtagtaaaggtaaaagaaaaatagatgttaaagatataaatatcttagggggtttttattggtataaatatttgtacacaaaaagaatatgtaatgtaaactggatatgtattttttacattttacttaacctgaattttacacaatctttgcttgaatgctcc

SEQ ID NO: 822 - DNA, 2806 bp, Homo sapiens
atggaataaccgaggtatgaatgaacagttttgagcactaaaacacactaagggctttgttatggactgaaatgtgtcctctccccagagtcacaggattatgaagccataatcctcaatgtgactatatttggagcaggggcctttacagacataattaaattaaatgaggtcataagagtggggccctagtctgataggactggtgtccttacaagaagagggagagtcctcagagagtcctctctctcggcatggacacaaaagaaaagccatgtgaggacacagagagaaggtggctgtctacgagctaggaagaaaggcctcaccggaaaccaaccctcacagcagctccatcttggacttccagcctccggaactgtgagaaaataaatgtttgcaattcaggctcagagccactcagacattgggaagcaagtttgtcaagatgacagagaaccgaggtaatggattcgagtgatgaaacaggaagttcattcatgagtttttggccacacctccaaagtgacgacttagccagaaatgggataactgggtttccctacttctcttttatcatcctcaatgagagtgaccaaatattagagctagatggaaccttagtgaaaatctggctactcgtcccgtcccaccagcctgccacccatttcaagtttgaagagacaaagacacatggaccttatgtaattactggggattaccccaggagtctgtggcaaaagtcagcttcttccctccctgcttccccgccctgtctctggtactttctaccaacactgggctgtttctgtgatcacacttaagcgtacctaacctgcgaatgctgtatagaaggtgctaatgaacatgatttagctttaacactcagttttctaaagggacacgtgggggcagcaaatgtttaggcaaaaacaattccagttctagcctctactgtctacatatgtgtatacatttgggaaacgtttgggaaagggatatttgagagcttctttttcttttttgtggtttagttatttgatgatattgagattgtttctgagccatgtgcttcaacatcggattggggatttcagaaaaagttttagtcactgtgattccatttagcttccaaatgtgtctctgctaagagacttaaaagcactcataaatagcacgtgtgtcttctttgcagtgtttgctaattttgagtcacatctttttagaaaatcatgagatttggtgtcacagagactggaataaatatagtcaaacttattggtgaagatttcctttagctgttttcataatccatttccattgttatgattattgatgaataaaacattttctttaggtagatacttcttttttccccccaccttgatttaatgtttccactcttattgtcaagtttcttattactccctaataactctcaataaaataatgattcctgggagattattcctgctttcctactatcacctgttgatttgaaaagacagaacaataccgtagaagcttcactaatacattgaaagataaaatgataatactaaatactaaaatatgaaaagtgatactaaaagtggagtcctggcactagtatttttttttttgagtctttaaattttatttatttatttttgaattttttaaaattatatgttatgttctgggatacatgtgcagaacgtgcaggtttgttacataggtatacaggtctggcactagtattttgttgccacaaaatatcaagcatgtatccaaactgctcaagacacattaaagacacaggtaatctgtaggcatattcaggcttgtagtttgcattttttggttttcttgtggctttcagtgcaagttgaggtaattcatgggaaacagtcaccaaagaagtgccagtattagaaatccaagagccatttctctagcttcttccagaatcaagactttagaggtaatttctatcaacactggacatttcctgtctgcaattaacaatgaacacatagcattatgtttaattgcaacctgtttaaagcagattggatgctaaggtttaagaacactcttcagtcaaaaaggtcttttaatcaggtttttaatcttgagcacaatctaggacacagcatcatagactaactcattcgagaataggtgttgtcatctaatcctaaccacccccaccaccaacaagctgaatagctctgggctcagtatatacatttgtactgggctcagtacacacacctaagctgggttcagtatatgccactttatagtgagaggcattttgtaatgagagctctgggttcactatatacatttgtactgggctcagtacacacatctaagctgggttcagtatatgccactttatagtgagggccattttgtaatgagagctctaaggctctaaaattctgtgtttctgctagtttcttcctcaagataaaactgtggaactcatagtgaattccctctctttgggcagtttgagccaggccgctatttaatcacaacatcacaagtcagatttttcctacctagtgttggcagtggaacacaccagaactgctaaggccaaggaaatcccattttttgaagaggctttcctttgttagcttctctttctagtagtaaaggtaaaagaaaaatagatgttaaagatataaatatcttagggggtttttattggtataaatatttgtacacaaaaagaatatgtaatgtaaactggatatgtattttttacattttacttaacctgaattttacacaatctttgcttgaatgctcc

SEQ ID NO: 823 - DNA, 3289 bp, Homo sapiens
atggaataaccgaggtatgaatgaacagttttgagcactaaaacacactaagggctttgttatggactgaaatgtgtcctctccccagagtcacaggattatgaagccataatcctcaatgtgactatatttggagcaggggcctttacagacataattaaattaaatgaggtcataagagtggggccctagtctgataggactggtgtccttacaagaagagggagagtcctcagagagtcctctctctcggcatggacacaaaagaaaagccatgtgaggacacagagagaaggtggctgtctacgagctaggaagaaaggcctcaccggaaaccaaccctcacagcagctccatcttggacttccagcctccggaactgtgagaaaataaatgtttgcaattcaggtcggttgtattttgtgaaggccatcctagcaaatgaatactcctaacattgtctctttaagagctcaccagcctgaggttttccaccacatccactcacctctacatggcgaaaaccaagggttcactctctgtcttcagggagctccacccagcagcagcgtttgacagagctgttcacttcctcttcctggagctgtggcttccagagcccatgctcagcagttcccctccttcttcgactgctcctctcttaggctcaaaacctgtaacaatgcatggcacacggaagatgtgagaatttgctgaataactgaatggcaccatgttgcctcacctaaggataatgactaagaataggaaaaatttactgtgcaaagatcagttcttaatagctgtctacatctcagaacaaaaaaaattagatgtaaaccattgcacaaaggattagatgaaatttttttgaaaaatcagacattggaggctcagagccactcagacattgggaagcaagtttgtcaagatgacagagaaccgaggtaatggattcgagtgatgaaacaggaagttcattcatgagtttttggccacacctccaaagtgacgacttagccagaaatgggataactgggtttccctacttctcttttatcatcctcaatgagagtgaccaaatattagagctagatggaaccttagtgaaaatctggctactcgtcccgtcccaccagcctgccacccatttcaagtttgaagagacaaagacacatggaccttatgtaattactggggattaccccaggagtctgtggcaaaagtcagcttcttccctccctgcttccccgccctgtctctggtactttctaccaacactgggctgtttctgtgatcacacttaagcgtacctaacctgcgaatgctgtatagaaggtgctaatgaacatgatttagctttaacactcagttttctaaagggacacgtgggggcagcaaatgtttaggcaaaaacaattccagttctagcctctactgtctacatatgtgtatacatttgggaaacgtttgggaaagggatatttgagagcttctttttcttttttgtggtttagttatttgatgatattgagattgtttctgagccatgtgcttcaacatcggattggggatttcagaaaaagttttagtcactgtgattccatttagcttccaaatgtgtctctgctaagagacttaaaagcactcataaatagcacgtgtgtcttctttgcagtgtttgctaattttgagtcacatctttttagaaaatcatgagatttggtgtcacagagactggaataaatatagtcaaacttattggtgaagatttcctttagctgttttcataatccatttccattgttatgattattgatgaataaaacattttctttaggtagatacttcttttttccccccaccttgatttaatgtttccactcttattgtcaagtttcttattactccctaataactctcaataaaataatgattcctgggagattattcctgctttcctactatcacctgttgatttgaaaagacagaacaataccgtagaagcttcactaatacattgaaagataaaatgataatactaaatactaaaatatgaaaagtgatactaaaagtggagtcctggcactagtatttttttttttgagtctttaaattttatttatttatttttgaattttttaaaattatatgttatgttctgggatacatgtgcagaacgtgcaggtttgttacataggtatacaggtctggcactagtattttgttgccacaaaatatcaagcatgtatccaaactgctcaagacacattaaagacacaggtaatctgtaggcatattcaggcttgtagtttgcattttttggttttcttgtggctttcagtgcaagttgaggtaattcatgggaaacagtcaccaaagaagtgccagtattagaaatccaagagccatttctctagcttcttccagaatcaagactttagaggtaatttctatcaacactggacatttcctgtctgcaattaacaatgaacacatagcattatgtttaattgcaacctgtttaaagcagattggatgctaaggtttaagaacactcttcagtcaaaaaggtcttttaatcaggtttttaatcttgagcacaatctaggacacagcatcatagactaactcattcgagaataggtgttgtcatctaatcctaaccacccccaccaccaacaagctgaatagctctgggctcagtatatacatttgtactgggctcagtacacacacctaagctgggttcagtatatgccactttatagtgagaggcattttgtaatgagagctctgggttcactatatacatttgtactgggctcagtacacacatctaagctgggttcagtatatgccactttatagtgagggccattttgtaatgagagctctaaggctctaaaattctgtgtttctgctagtttcttcctcaagataaaactgtggaactcatagtgaattccctctctttgggcagtttgagccaggccgctatttaatcacaacatcacaagtcagatttttcctacctagtgttggcagtggaacacaccagaactgctaaggccaaggaaatcccattttttgaagaggctttcctttgttagcttctctttctagtagtaaaggtaaaagaaaaatagatgttaaagatataaatatcttagggggtttttattggtataaatatttgtacacaaaaagaatatgtaatgtaaactggatatgtattttttacattttacttaacctgaattttacacaatctttgcttgaatgctcc

SEQ ID NO: 824 - DNA, 399 bp, Homo sapiens
gggagagggagggggccggccgcagggtgacgggtggcagcctggggctgtgcagatgtgggtggctgagaagggcactagggtgggggtggctggaggaattttaagtgctgtgatgaaatgggcacccttctctgccctccatcgccaagccctacacctctgcgaagactgtgacacataaagtcctgtgtcaacgatctgtgcccgcagagagagcctgctccagcctctttgctacagccttgagtcttctgctgaagctgtggagactaccaaatggactcgtctagatttcacatgcaacgtggctctgccttccctgagcactctgggcctttccatggagacagaatgaatagataatgggctgtcaccatcttgcactgccagctgtcc

SEQ ID NO: 825 - DNA, 2914 bp, Homo sapiens
ctccttccaggccggaacccaagtgcttaggcagccgggaaaggccggtcccctttttcagttctctcgcgacctctagccacttccggttgctaacggttcccaaacagcccccgaaaacgctacgtgagctgggccctgggccagaggcagaaaacggacggaagaaaaggtctggccggagatgggtctcactctgtcacccagactggagtgcagtgagtggtgcgatcatagcttactgcagcctgaaactcctgggctcaagtgatcttctcgcctcagcctcctgagtagctggagctacaggtgtgagctacccagcatggctcatttgagatttctgagtagagaagtaacatgattaaacttgggtattgagattattattttggctgctatgttaacagtagacttgaatgtgaaggggttgggcaagggcagaagcagggagacaggttggaaagttggagtgggaagggcctttttaagaataacacaaacccctaaagacataaaactgaaaaggccatggaggaaaagataaatgaaactggccttgtaaaattgaaatatttgaatgaaaaaagtaaaaataaaatataaactaaaagtaaaatatgccacacatctaaaagacacagctgattttcctgatatacaaagaccttttatcttaccaaaaaataaaaatatgaacaagccaatagaaaaatagacaaagtacttaacctgcatgcatttattgtcaggcctctgacaatatgatactaagccatcatagcccctgtgaccgccacgtatacatccagatgacctggagcaactgaagaaccacaaaagatggcattccaccattgagatttgttcctgccccaccccaactaatcaatcgaccttgtgacattccccctgcccccgacagtgagtctcatgatctccccacccagcaccttggcaccttgtgacccccgcccctgcccacaagagataaccacctttaactgtaattttccactacctacccaaatcctataaaactgccccacccctatctccctttgctgactctctttttggactcagcccacttgcacccaagtgaaataaacagccttgttgctcacacaaagcctgttggtggactctcttcacacagactcacttgacatttatagaacacaaaattaagaatagtgaatatgaaaaggttcactaataagaatttaaacaaaacaagaaagatttttaagattgctaaagacaaacgatttataatattcagtgttaggaggtgtgtggatatacaggcatacttagttttacatttttagaaggtaagacttatttagaaggtaagaagttgtccataccccttgattcaacaacttagcttcttggaattatccatatagaaatgcttacataaatgtttgaacgtatgtacaaagaagcactatttatttaaattgggaaacttgaatgcctaacatttggaatttaaatttttatatgtctattcattaaaataccacccagtttttagaaactaagagatgctaaaggtatattgagtaaaataaaaagttacaaaagatatggtatgattgtttttgtgaaaattattatcttaaaaatgttggccgggcaaggtggctcacacctgtaatcctagcactttgggaggccgaggcaggcggatcacgaggtcaagagatcgagaccatcctggccaacacggtgaaagcccatctgtactaaaaatacaaaaattagctgggcatggtggcatgtgcctgttagtcccagctacttaggaggctgaggcaggagaatcacttgaacccaggaggtagaagttgcagtgagccgagatcatgccactgcactccagcctggcgacagagtgagactctgtcttaaaaaaaaaaaaaaaattcactatgagtatcagttgggggtaaacttaaggagaacctgcattttatacattatatatttctggaacatttcaatttcttatgaagatttgctactggtataaatgggaaaagataattgttcttaaaaccctatttattctccacaacctataaaaaaattttcctgtttggagaatttcatcaatatctattttcctcctctgaaattctttgcctgacaagtcaaagataagtaatgcattcacataaatttattagaaagaataaatgtccccagcatctagtttgacaatatttttttgtgaaatgtatatccttccatagatatatataccttttgtagatacatacctttcatcttaaaggaattatgccttgtaaaagggtataattcctttaatatgaaaatcagattcaacttctgtgtgctttttaagggcaaatataagtgagcaaataaatttgtgtggattatttagaaagtgtagatataaataattttcaaatatgctttagaacactctcccactctgggaagaaaattttagaaaaaggataacccctgcatttctttccattagaagtacatgatcaaaagacaaagtccctttttcccttgactgtgacataacatgtccctcataggcaactgaacagataaaaaatccagacgatgcttagtaatttcctgcttcccctttagtgcacagtgtattatcagtatgttttgccctctttatttaatatcttgctgaattaaattatctcatcaggtttttaagcacaagcccagcctgctttctggatgacacctgccacaggtcatccttcctgaatttcctaaataacccagaatattcttcaagcatgcccctggctcatcatccaacttcagagaatcaactggctagcaccttggagcacctgctgtgggctcctctgctaatgcttctgggagacaccttcatacg

SEQ ID NO: 826 - DNA, 2914 bp, Homo sapiens; identical to SEQ ID NO: 825

SEQ ID NO: 827 - DNA, 1491 bp, Homo sapiens
cccagtagcacccctttttctccatgagctgctggtgggttcccccctcccggatagcgcctccttccagaaagaggatgtggtcagcctgctccaccaggctgaggtgctgggtgatgagaagcactgagcgggagtaccgctcagggctttcgtacaggagctgctccacctgaggaaagacatcggaccgtcagagccggggactaccctcagcccagggagacacctgtgtttccagggctgggactgacctcacaggatcactgctggctctgctaacaaccccaaggacaccaacgtttcccattctgagtacttctccgcaaaccctttgtttcattaaggactgttttacatgaagggtgcaaaagtaggataaaaatgagaaccctagggtgaaacacgtgacagaagaataaagactattgaatagtcctcttctctacccatggacttggcatttttatattcgattttaaggaaatataacttagtagtaaagagatgagcattcaagtcaggcagacctgaatttgggtcaaggctgcgccactcaaaagctatatgacctctatatgagcagcttattcaacctcttttaacctccattttgtcatctgtagaatgatgataaatgcctagctcagaaggattcctaatgaataaatgagtgacagtgcatgtaaacagactagcttaattaatattaatatgattaggatgggctgggcccggtggctcatgcctataatcctagcactttgggaggtcaaggagggaggatcacttgggcccaggagttcaaggccagcctgggcaacatagcgggacgctgtctgtacaaaaaataatttttttaaataaacgatattatgaggatggtcttttccttatgtttcgctttagaaattcagtctataggactgggcgcagtggctcacacctataaccccagccctttgggaggctgaggggggcagattacctgagctcaggaattcaaggccagcctgggcaacatggtgaaacccatctctactaaaaatataaaagtcaaccaggcatagtggtgtacacctgtagtcccagctactcgggaggctgaggggagaatcgcttgagcccagcaggttgaagctgcagtgagccaagattgtgccactgcgctccagcctgggcaactgagtgagacactgtcttaaaaaaaaaaaaggaaagaaagaaagaaattcagtctgtagtttgtagatagtctcttttaactgattctaggtgtctttgcctcgtcttctatctctactccttggggaggcatccaatggaactggatttgggaactgagaactgcaaggactggtttgtataattatgatgttagtaaaactaacagaagatgtataaaagaagcaagattgggtgggatatagccattaagaagatgactgcctcacctgtaactggctgtttgcatccagggcactggtggca

SEQ ID NO: 828 - DNA, 1491 bp, Homo sapiens; identical to SEQ ID NO: 827

SEQ ID NO: 829 - DNA, 1491 bp, Homo sapiens; identical to SEQ ID NO: 827

SEQ ID NO: 830 - DNA, 1491 bp, Homo sapiens; identical to SEQ ID NO: 827

SEQ ID NO: 831 - DNA, 1491 bp, Homo sapiens; identical to SEQ ID NO: 827

SEQ ID NO: 832 - DNA, 5371 bp, Homo sapiens
agagaacaataaatgaaaactgttgtcataaatggttatttctaacaatttttcaaacccctagacttcaaatattttggacaggacctgacaaaatgacccttaatctgtaaaacatctgtacttttgaccactcatctttcttaataattcagttctctggtgataatgtttgagcttaaaatctctatcttcagaaggtaacgtgatttgtgaattttctgtcaaatcaggaaagaatcactggcattgccctcttcccacacatgcataggataaaatagctctactggactttttattaatcaaagagcccgagagacagctgaatggctgaaccaagcagagagtggaaacttggggagggtaattccttgctgggccttaaaaggagtccacaagataggaaaaaaacgaaaaagccaaataagatgaacctctattcaggccccaatgagaggctgcttgactctgatctttcgttagctggctcaaaattttgttcttaaagaattatttttactcaaaatcaagaactgttagaaaacaagaaaaattatggagttttgttgttgatttccacctctctacatatatatatgaaatacatatctcctcccgatacacatgcacacacgcaaaaacatatttaactgaaacaacggtttcatgaaactatagttactctcattacctgtgatgcaggcaagtattttcaattgtattttattctatttcattctacttggaaaaaaagtcttttggtctcaacataaatgggttctgacctgcagtttcaagccaatacgttacagtaagagtaaatgtagggtttctcccagttttatctggcagtcccaaagtcaggatcagagtaaccgatggagcatcatttgtacgctccacgtctgaggaggaggtctgggaaaagatccaacgtgtaggactggcgcagaggctcaggcctgtaatcccagcactttaagaggtggaggcgggaggataacttgaggtcaacagttcgagacaagcctggcaaacatggtgaaaccccgtctctactaaaaatacagaaattatccaggcgtggtggtgcgcacctgtagatccagctcctcgggaggctgaggcacgaaaatcgcttgaacgcgggaggcggaggttgcagtgagacaagatcacaccactgcactccagcctgggcgacagagcgagaccctgtctcaaataaaaaaaataataataataatccaatgtgtccctagtctggctttcagggtcttagatgaggttcggaagtggacttaggagccttaggagcgcagccagtgctgtggattcccacatccacgggacctgcggtttcgggttattccattcagggatacatgacgtccctcatttctacctaccagtgggctggtcaagattctcatttatcaagtcagttggagtgggcttaagtaagttctcagccaaggctgtggggtctggaggaccagatatcccgaccaaaagccccccctcccattcctttcacacgcctgccgcagaggtgcacgggtgcgagtggggaactgaggcaagaagcagatggggcggcaccgagagaagagaaactacgctagaggaaaagctcgagctgttacccctcccaacttcttccgccttccgccttcccccttccccctctttcccctcttgcccctctccagcttttctggtccaaccctcttctgcgcctaacactggcacctccttttcttccggctgatgaataattgtccgcaaaccagcctctctggggcactgaggggcgggaaggttagaaggagccagggctagagtcctggaaggtggcagtcaggtcgcagggccacagcagtcactctgcgactctctcttccggtgtttctccagcgccaagcgggagaagacggagcctgggagctgggactggaggagcgggaagcgcagtatcgggaccacggctctgggaccaggaaaaacgcagactctccagagtcaatgtctacttcagccagctcaagggcgcgacaacctggcgccgagcatctcaggccgccgcggggaccccccctaagggactcgggaacacctgcctaccctagaagaggcggagaataaccccgtagggagttaagcggcctctgcctacagcgttcctcccgcctccacggcgccgagccctgattgacgttcagccaggccaatcatagcctgtgtctgaggcgcgcggagctggagcgcccagggcatgtccgccgatcccaaggaggcaatctgtcaggcgccgcccgggcggcagtatgcctgagggggtcctccgtgttcgcgcctcccgccgcctgcactgaaaggtctgtacctgagcctggatacttgaacagaggcagacactgcggctcaaaaccccaaggaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatatctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattattggtctacagtcaaattgcgtatccccattaactagagttatatttttccattttctgatccaaaaactttaggaacaggaaatgtttattttagaaaacaagaacacttcttaagcatttgctgttaacagttattttcacatgtgcttgtacttattttacacttgtcagaacatagtatttacctttgaaccaaggttttataataagcaagcactttttttatttagaagtcacattttccaagtagaaaaatcattaaaaattcagtcctctgaaggctaatttctttaaatcatttaacctaattgtttaaggtatagattggaatttttctcagcactctcttgaaaacaggtgacagtggaaccctgttaggttcacaaatcctagactttgattatatagcccaggctcaaatttttctcgaatgttacgaacattcaaagcattaggagtcttggtttcatttcttaattttttttcttctgggtatatttgagactcatcttggattcaaataaattaataatagtctcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacaccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaacagctggaatgtatatagtatggttctggatgctcttgtatacctcactcttcatttctcacctaacccatgtgctatgatttgaatgtttctcccctgcaaaactcatgttgaaatgtaattgccatgataacagtattaataggtggaatatttaagaggtgattagggtgggattggtgatgttataaaagggtaagttcagccccttcttgctctctctgtcacccttccaccttcctctgtgtgatgatgcaacaaaaaagcccttcccagatgccagcatcttgattttggacttctcagcctacagaactataagccaataaatttctgttatttgttattagtctgtgatattctgttacagtagcacaaaatggactatgacaccatgtgtttacacagaaagaaaaaaatatcatacggtaattgctcctaaatatgcagagaatatgttctgatatccttagtggatgcctgaaactgcagatagtaccaaaccttatatatactatgttttttttcccatacatatgcatgttaaagtttataagttaggcagagtaagatatgaacaataactaataatgaaatagaaacgtaacgatgtgctgtaataaaagttatgtgactgacgcctctttttcttcctctttctttcaaaatatcttaatattttcaagccatggataactgaaactgcagaaagtgaaactgtagataaact

SEQ ID NO: 833 - DNA, 5396 bp, Homo sapiens
ttttggacaggacctgacaaaatgacccttaatctgtaaaacatctgtacttttgaccactcatctttcttaataattcagttctctggtgataatgtttgagcttaaaatctctatcttcagaaggtaacgtgatttgtgaattttctgtcaaatcaggaaagaatcactggcattgccctcttcccacacatgcataggataaaatagctctactggactttttattaatcaaagagcccgagagacagctgaatggctgaaccaagcagagagtggaaacttggggagggtaattccttgctgggccttaaaaggagtccacaagataggaaaaaaacgaaaaagccaaataagatgaacctctattcaggccccaatgagaggctgcttgactctgatctttcgttagctggctcaaaattttgttcttaaagaattatttttactcaaaatcaagaactgttagaaaacaagaaaaattatggagttttgttgttgatttccacctctctacatatatatatgaaatacatatctcctcccgatacacatgcacacacgcaaaaacatatttaactgaaacaacggtttcatgaaactatagttactctcattacctgtgatgcaggcaagtattttcaattgtattttattctatttcattctacttggaaaaaaagtcttttggtctcaacataaatgggttctgacctgcagtttcaagccaatacgttacagtaagagtaaatgtagggtttctcccagttttatctggcagtcccaaagtcaggatcagagtaaccgatggagcatcatttgtacgctccacgtctgaggaggaggtctgggaaaagatccaacgtgtaggactggcgcagaggctcaggcctgtaatcccagcactttaagaggtggaggcgggaggataacttgaggtcaacagttcgagacaagcctggcaaacatggtgaaaccccgtctctactaaaaatacagaaattatccaggcgtggtggtgcgcacctgtagatccagctcctcgggaggctgaggcacgaaaatcgcttgaacgcgggaggcggaggttgcagtgagacaagatcacaccactgcactccagcctgggcgacagagcgagaccctgtctcaaataaaaaaaataataataataatccaatgtgtccctagtctggctttcagggtcttagatgaggttcggaagtggacttaggagccttaggagcgcagccagtgctgtggattcccacatccacgggacctgcggtttcgggttattccattcagggatacatgacgtccctcatttctacctaccagtgggctggtcaagattctcatttatcaagtcagttggagtgggcttaagtaagttctcagccaaggctgtggggtctggaggaccagatatcccgaccaaaagccccccctcccattcctttcacacgcctgccgcagaggtgcacgggtgcgagtggggaactgaggcaagaagcagatggggcggcaccgagagaagagaaactacgctagaggaaaagctcgagctgttacccctcccaacttcttccgccttccgccttcccccttccccctctttcccctcttgcccctctccagcttttctggtccaaccctcttctgcgcctaacactggcacctccttttcttccggctgatgaataattgtccgcaaaccagcctctctggggcactgaggggcgggaaggttagaaggagccagggctagagtcctggaaggtggcagtcaggtcgcagggccacagcagtcactctgcgactctctcttccggtgtttctccagcgccaagcgggagaagacggagcctgggagctgggactggaggagcgggaagcgcagtatcgggaccacggctctgggaccaggaaaaacgcagactctccagagtcaatgtctacttcagccagctcaagggcgcgacaacctggcgccgagcatctcaggccgccgcggggaccccccctaagggactcgggaacacctgcctaccctagaagaggcggagaataaccccgtagggagttaagcggcctctgcctacagcgttcctcccgcctccacggcgccgagccctgattgacgttcagccaggccaatcatagcctgtgtctgaggcgcgcggagctggagcgcccagggcatgtccgccgatcccaaggaggcaatctgtcaggcgccgcccgggcggcagtatgcctgagggggtcctccgtgttcgcgcctcccgccgcctgcactgaaaggtctgtacctgagcctggatacttgaacagaggcagacactgcggctcaaaaccccaagggtaggtacctattgtgcggagtctcggaacgcctgcctggaagaagagttccggcggctccccgaacgcttggagaaagcgcttggatgcagttgcaggaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatatctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattattggtctacagtcaaattgcgtatccccattaactagagttatatttttccattttctgatccaaaaactttaggaacaggaaatgtttattttagaaaacaagaacacttcttaagcatttgctgttaacagttattttcacatgtgcttgtacttattttacacttgtcagaacatagtatttacctttgaaccaaggttttataataagcaagcactttttttatttagaagtcacattttccaagtagaaaaatcattaaaaattcagtcctctgaaggctaatttctttaaatcatttaacctaattgtttaaggtatagattggaatttttctcagcactctcttgaaaacaggtgacagtggaaccctgttaggttcacaaatcctagactttgattatatagcccaggctcaaatttttctcgaatgttacgaacattcaaagcattaggagtcttggtttcatttcttaattttttttcttctgggtatatttgagactcatcttggattcaaataaattaataatagtctcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacaccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaacagctggaatgtatatagtatggttctggatgctcttgtatacctcactcttcatttctcacctaacccatgtgctatgatttgaatgtttctcccctgcaaaactcatgttgaaatgtaattgccatgataacagtattaataggtggaatatttaagaggtgattagggtgggattggtgatgttataaaagggtaagttcagccccttcttgctctctctgtcacccttccaccttcctctgtgtgatgatgcaacaaaaaagcccttcccagatgccagcatcttgattttggacttctcagcctacagaactataagccaataaatttctgttatttgttattagtctgtgatattctgttacagtagcacaaaatggactatgacaccatgtgtttacacagaaagaaaaaaatatcatacggtaattgctcctaaatatgcagagaatatgttctgatatccttagtggatgcctgaaactgcagatagtaccaaaccttatatatactatgttttttttcccatacatatgcatgttaaagtttataagttaggcagagtaagatatgaacaataactaataatgaaatagaaacgtaacgatgtgctgtaataaaagttatgtgactgacgcctctttttcttcctctttctttcaaaatatcttaatattttcaagccatggataactgaaactgcagaaagtgaaactgtagataaact

SEQ ID NO: 834 - DNA, 1663 bp, Homo sapiens
ggataattgttaattttcccaagaatataattataattcttttattgtttaaatagagttaatagtttatctacagtttcactttctgcagtttcagttatccatggcttgaaaatattaagatattttgaaagaaagaggaagaaaaagaggcgtcagtcacataacttttattacagcacatcgttacgtttctatttcattattagttattgttcatatcttactctgcctaacttataaactttaacatgcatatgtatgggaaaaaaaacatagtatatataaggtttggtactatctgcagtttcaggcatccactaaggatatcagaacatattctctgcatatttaggagcaattaccgtatgatatttttttctttctgtgtaaacacatggtgtcatagtccattttgtgctactgtaacagaatatcacagactaataacaaataacagaaatttattggcttatagttctgtaggctgagaagtccaaaatcaagatgctggcatctgggaagggcttttttgttgcatcatcacacagaggaaggtggaagggtgacagagagagcaagaaggggctgaacttacccttttataacatcaccaatcccaccctaatcacctcttaaagagagttcccgtatgtcccctcaagccctcttccctccagtttccactattagtaacatcttgcattagtgtggtacatttgttaaaattggtgagccaatattgatacattattaagtccatagtttacattagggttcactctttgtgcagttttattggttgttatattttattggttttgacaaaggtatgacatgtatccaccattacagtatcattcagaatagtttcactgccttaaaaatcctctgtgctccacctattcatccaacccttcccatggaccactggtaaccactaccttttcactgtctccatggttttgccttttccagattaccatatagttggactcatacaatatgtaatcctttcagattggcttttccttagcaatatgcatttaaggttcctccattatccagagatggttttagttgtcacaacttgggtagagagatcaggggtcaatgctactggcatctagtgggtggtagagactgaggtagctcatgagcatcctacaatgcccaggacagccccctacaaaaaagaattattcagccccaaatgccaaccatgctcgaggttgagtaaccttgtgttaagagtgacatgtggcatgagaaatggggcggttttggctcatgttgtgatattctagattcagatatttccctgagcagagaggctgaaatgctgaaaatttttcatttgatgaccttgatgcttcctttcctgaccatcgtaaagaacaaatggctcctttgctttggcaagaaatactgaaggtggtggcttttttctgtttgttttgaaatgaagtcttgctatgttgctcaagccagtcttgaattcctgaacttctggtctcaagtgatcctcctgactcagcctccagagtagctgggactacaggcacatgttactgcaccagccttcaacgtgattttttttatttcattcaggtgacaaactcatgctgaggttcccaatttttgtctcagagctaggatattc

SEQ ID NO: 835 - DNA, 2719 bp, Homo sapiens
ccatggcttgaaaatattaagatattttgaaagaaagaggaagaaaaagaggcgtcagtcacataacttttattacagcacatcgttacgtttctatttcattattagttattgttcatatcttactctgcctaacttataaactttaacatgcatatgtatgggaaaaaaaacatagtatatataaggtttggtactatctgcagtttcaggcatccactaaggatatcagaacatattctctgcatatttaggagcaattaccgtatgatatttttttctttctgtgtaaacacatggtgtcatagtccattttgtgctactgtaacagaatatcacagactaataacaaataacagaaatttattggcttatagttctgtaggctgagaagtccaaaatcaagatgctggcatctgggaagggcttttttgttgcatcatcacacagaggaaggtgagaaatgaagagtgaggtatacaagagcatccagaaccatactatatacattccagctgttttggtgtagaagcagcacaaatgtagaagctgcattgtttcttgataaaagggtcctggaaagatgaccagctatacagtttccactagaggaaatgcagattggcttgtacgactttagagtatgaaatataaagatctggagtctgttccatgttttttcaggactggtgtgactatattatggataacgaaggaaaggagcctcctttgaaagaagcatctaaattagggatgggctcctcatttggaggatgttagaaactacgaatcaatgtctctcatgttcaatggagctcccatttttatcggtttcatgagactattattaatttatttgaatccaagatgagtctcaaatatacccagaagaaaaaaaattaagaaatgaaaccaagactcctaatgctttgaatgttcgtaacattcgagaaaaatttgagcctgggctatataatcaaagtctaggatttgtgaacctaacagggttccactgtcacctgttttcaagagagtgctgagaaaaattccaatctataccttaaacaattaggttaaatgatttaaagaaattagccttcagaggactgaatttttaatgatttttctacttggaaaatgtgacttctaaataaaaaaagtgcttgcttattataaaaccttggttcaaaggtaaatactatgttctgacaagtgtaaaataagtacaagcacatgtgaaaataactgttaacagcaaatgcttaagaagtgttcttgttttctaaaataaacatttcctgttcctaaagtttttggatcagaaaatggaaaaatataactctagttaatggggatacgcaatttgactgtagaccaataattaattgtcataaagactttaaaaatccttctagattaataatgtgtagaggagtcttagaggattactcagtaaaataaattcaaggtaacaatattaatctaagtttctttaatattcttgatctgggtaaacattttcataaattaattttgtgaattttgagtttaaaatatgtcctgctctaatttcaccatgtgtaaaataaaaaggcaatcatagtattttagtccatataaaaccatgcctccatttataaaaacagactttttttggacagtttaacagttacagaaaaactgaacaggaattacagagagttcccgtatgtcccctcaagccctcttccctccagtttccactattagtaacatcttgcattagtgtggtacatttgttaaaattggtgagccaatattgatacattattaagtccatagtttacattagggttcactctttgtgcagttttattggttgttatattttattggttttgacaaaggtatgacatgtatccaccattacagtatcattcagaatagtttcactgccttaaaaatcctctgtgctccacctattcatccaacccttcccatggaccactggtaaccactaccttttcactgtctccatggttttgccttttccagattaccatatagttggactcatacaatatgtaatcctttcagattggcttttccttagcaatatgcatttaaggttcctccattatccagagatggttttagttgtcacaacttgggtagagagatcaggggtcaatgctactggcatctagtgggtggtagagactgaggtagctcatgagcatcctacaatgcccaggacagccccctacaaaaaagaattattcagccccaaatgccaaccatgctcgaggttgagtaaccttgtgttaagagtgacatgtggcatgagaaatggggcggttttggctcatgttgtgatattctagattcagatatttccctgagcagagaggctgaaatgctgaaaatttttcatttgatgaccttgatgcttcctttcctgaccatcgtaaagaacaaatggctcctttgctttggcaagaaatactgaaggtggtggcttttttctgtttgttttgaaatgaagtcttgctatgttgctcaagccagtcttgaattcctgaacttctggtctcaagtgatcctcctgactcagcctccagagtagctgggactacaggcacatgttactgcaccagccttcaacgtgattttttttatttcattcaggtgacaaactcatgctgaggttcccaatttttgtctcagagctaggatattc

SEQ ID NO: 836 - DNA, 9738 bp, Homo sapiens
gccaccgcacccggccgggagagtgttttataagttgaaaaacactagaaaaataatattagctattataattggtccactcaacttcctcagatggagttcgccccaagcaaaacaaatttccctcaactccaccccataaactgcaagtccccataactgcccctcctcttctcctcctttccaggctcacccaaacttggcttcctctgcctgtcccaggcacaggcctggcaggaagtgaccagcctcccattagctcttgccacaggtctgggagagttcacaggctgctgagctgagataagaggaccggcaggaactgagggtttcctcaccctagaaaagcacctcctcctactactcctttgccctccagactcaaggcaggaagagaaacctggggaaggggcctcagaggagaggcctccatcatgtgttcattctgactgctcaaactgttccttccattttgggaccagggaacagagctcacttaatgctgctctcccactgatgatgcccacccattctcggcctgcaagccctaccactcacagcttcaaaaatggctccgcccttcctgattccaccccacacagaagaaagcaacttcttgtgatgcttccttattctggatgtggctcacctcttaccccttccaactcctttgggtcccctagaaagcctccctggctaaggggtacaggccctctcctcagcagtgggcactgaccgtctaaccagggctctgtctcggcacctggtagcaaggacggcaagatacaacaacatgctgattttaatagcctctggctttctccactgcgtttctcacctgaatgccctgcacaccaaatcttccatggggtcacccttgacctctagggcaattcccaagaatctagcagaggagtgggggaaaccaaaaggctgacatgaaggactcaagggaagcctctggaaagaagagaccagacactaaaagggatgtgtgtgaaatactggtttttattggttggcacaagattacaacctacaatttcaatgcccttccctcccacacagctcaaatggaaggaaactgattaacacatagaaaggaacggcaggctcacaggtttaagcatttgtttttacaaaaaggagtgggatatgggggtggtcaagttttacgggtaataacaacattctctctagatggcagggggtaagtctgcctgtcctccattgctggtaccacataagggatacattagtaaagtagggaaagggttatatgtgtggctggcctgttctttagagaggaaggtgggatggtatctgctgtgtacctgtctcagaccaaacctggggctggaccagtgcccctttcttctcagccctcctccacagcctgactgtactgccagccgcacccatgagaaggaggtgtgaaggaagcctgaggacatccacctcgagaaaaggaaacaggaaaactatttccttccgccttctctggaccaaatttcactcccctcagctccagagagtgctgcaaaaatcttccttagggacgctgtgaagacacggggaagaggccagccctgagcgggcaagaagaaaagcttgaactttccatgcagtaccaagcaaggctattttggaaacaagcaaacaaacaaaaaatggaaaccaacaccatataaccacaggttgggtagctcctaaatcctggacagcatttggattgggggtaagggcaattttactccagctccttgttttataacccgcacaaggtgccaagaggtttaaggaccacaactgacctctctttccctacaagcaccattccttggattcccagttttgttgagctcatttgaggtcatccttgccatcctcttaaaaaatgacacagcctcttggttattccattttctatccctttctacaattatgaacacactctctaaacaggagatctatatatgctctcatcctgcaacccaagagattaggtgacctaatgatgagaaggctaacttatttgctttcctgggtggtcctgatggaaatgaacagcagcagagttctggtgggatagagcagtctagtctgagccactgtgtgattccccaggggactggtccctgggtacatgggtccctggctctctgtctcagttccacagatattactcaacttggccatttacgcctcagctaaaacatatgagcatgagggaaaagggacaagaaatacttttgtcctctagaaaaacttaactcaatacatcttggctactttgcctcaacccacggggttccctggaaacatttgttgaacttggccaagaggagattgtatatggatggcacacctggaaaaggggagaaagcacactagttcatctcttttataagtagaatggtcccagggatgttaacctttctgatgctgatagtagatgagtggagtggaggtaatcgtgagaaaacttaaaaacccttaagctgtttggagactacacaccacagtggagcaaaccaaggtggggcctcactgcctcctcagagcccatccctgaccatgtcattggataggatggaagacaaagtctttgaaatggaggctgggctggcaaaagtaagtatgaagatgctactactggccttccacttcctctctctgatacacctaagaaggtgagagacactagcttcaattccattttacaacagttctcaacaacctgaaatattcttgacttccttaagcacatggaaaactggtaagctatatctttctaactgaaattttacttattctaaccaccaaccttttctttgattatcaaccagtttgacagtcttcagatcacaaaacaatagaacagacctgacatttacaaaactgtactacatacttatttcttttacagtagagctgaccaattacttttctaactactaatgcaacaccatgccactgggccctggactctgatgtttctgatccctgagcaacacatctatgtccattcacagatggaaatgaaagagtgagattctcagaggctaaacaacattctgggagcaaattggatttttgaagggagagtcctcttagaaaattctgagcaaacatgctcccagtcacgagggatggggtgagcgggcaggtttctgtctgtgagctatagctcccttctgaactccctcatgttcttgggaggacacaagcctcttgctcattaagcaaaggccctccaagtctcctttttacttcagcactttggaaactctccaagacttaacttccgatctggggaggttctacgtggagcagacctatcccttcttattcctgttcctgggtgtctccataatcagcctctaccttccctggcataagtcatatctgttatgctgcaggaactgagtaaccaaagctagatatcccttggaccactgattagtgacacattttctccacaacaaagggaggttaaagacaaaggtttaacctgagaaactttttttttggcaagataataaagaggttaaagaggctacgtggatctgtcactgctttagcttaccattttcaattcagcaccaaagtgctcagaaagacaggctcagatcaggacgacttcttaaagggattcacaggcaatattactggcaaaatgattttccaaagctgagccacgcgccccaccctacagggaggggagtagaatcttatggcccagcattggcattgaggcatcttgctttttttcctcagaattccacaaaggcttaagagtgatctaaatgcctggctggaagctcaagtctaggagagctattttactgcactgttgagatgttctctgcaaggtagtcacagataataagcaatttagtagataattattctatacaagaattaatgttctctgaaacagtgattaatagaatcttcacatctggcctggctgggaggcttgggggcaggaaagggagggtggaaggatgggtagcacatcaaaatggtgatgaacctggcaaaacgacaatgctgctgtttttgtatcctttaaagcctatatccagggttttaaatgacgctttttttgtgtgcttcctgataggaagtcaaataagttttagtattaagaactggggatataaaccaaaggaaacctagagtcaactgactgctggaggaacagaagcaatgacttctttccaccttctagatagtaatcttacttttgttggctaaaagcactttcttcagcattctgagttaacacgggttccctataagctcccctccccaggtggacagtcttattttctaagacaagctcaaagctcaaactcaccaaattaccactataaacaaagcttcagggaagagacataaccttacttcaaaagcttcaggtcagagacagccaaaatcatgtgactgctagcctcagctcaagtagtgtgcccaaatcatcacaaaatgggattcccttcccttttcttttttttttttttttttttgagacggagtcttgctctgtcgcctaggctgcagtgcagtggcgggatctcggctcactgcaacatccacctcctgggttcaagcgattctcctgcctcagcctcccgagtagctgggactacaggagcgtgccactacacctggctaatttttgtatttttagtagagatggggtttcaccatattggtcaggctggtcttgaactcctgaccttgtgatccacccgcctcggcctcccaaagtgctgggattacaggcgtgagccaccatgaccagccctccatttattaatttataaggggactagaaggacaaactatttgattaatttgaaggtgagaggtatcattttctcagatgctccaactaggcttctcacatccctcaaaggttatcagctaaagacaagagtttctgaggctaatgcaaaaacatggtcaaatgtgaaaccgcccttttagaggcagggtttgtgaaaggctgctggcctccaaaggagagtatgcctaaactctctgggctcccaggacctgtggtgacctcaagctaacctgatgcacagacaacagtatcttttagggactgcagccaatgttccccaatttactttttttttataccttaaaatatcaaatgtttcatttttaggtgatatcccaagtgacacagaaacacagctcctccggatggtgaagtctccgctgcaaaactcacgaaacagcacagaggatgactctagggtgctctcccacttgctccaagttaggcaggtgccctgatggaggcaaggctgagccattaacatgcacagctccatatcctggaagcctctgtagccttgaggagataggctctatccaacaggactcagaataaatgactgccacctcaactgagcagtatgaactgcccacctcaactgggcagtctgacctcttccacagtctttaagaaacagaagagccatttgcattatttaatcaccattcaataatctcctccctccccatagctgcttgagttaactgtcccacaagtgtcctgtgttttgtaaagatgagggttattttctgaaatgcagatgggactaggatgaagctgtattatcaattacagagacagccaactctcatttctcttaaagcaaaaattcattccactgtgatttctccaggtatttcctgcaattctaaatccgcccttgatattagagaatattaaaatcacacagttgtggcaaaaatcacattgtggctattaaatcctttttgtgaactaaaaaaagtgaatgtggcttaggctaagctgtttttttttttttttttttaaagatgaggatgcggactccaacaaaggcattaagaaagtactagatgaaaatgagaaatatgtgaaggataacatgtgaaatgtacactcaggtctaacaaatacctattatttctctggttaagaaggtttagcaggagcctccaatgagcactgtatgtagagaaaagggaaggagcaggaggaggaacagatctgcacagaatttttttcttaaaaaccacaaagggtgacttttttcttctaagcaagcaagcctgagaggcattacatgggctggctcctaatatcaaaacaaaatatttctttgccacaaaggaacttgactatgtagcaacacatttacaaaactactgcaaaacactcccagagggcagtgacctactctgctccccagaggctccaagaagcaaggcctcaagtgcctcatgttccatggggctgtgcagtgcaatgcagaaggcggaaatcctgctgtgacgccaccctcgagaccttctgcagcctgagagggggtgatactcccacaccctttgatccttccagatggctcagcctagatctagcagtgagagagccctctccatgcagggcagatggagtggtggacacttgtgaaaacaaaacactaactgttccatcctgttatatttgctgtgaggaaaattaagattcctgttgtatgggctgcactgtttctggaagactacagaaaatctaacatggttgacacttcctggtagcccttctgtacatacacacacacacacccagagagaagacagagagaaaatcctggtccaaaagatcacatgaccttactagtgtttccccaatgactgtaatttataaactaaaaatttttacaaatccactgctatcttcttctgtcctgagtttggtagactttaatggatgctccagcaataaccagaatctaggacatgcagactcactgtgagcgagaggctagggatctgccctaaacataggaacctgtttctatcaagcctgaatgaggtcagctctggtagaattaatgacaaatcaatgtcagtgaaatattctgcaaacagggtagcttttgtgctttcttttgattattttctttggggagataaaggtattgcaaccatgggtctaactaatctatcactaaaggactgtgacgacattctcaataaagacagtcatggtgtttactgtgccaaggagggaaaatcccagatcatcagaatcccagtgcaacagaaaacagcaccagtttcaacaattctgatgttggacaaagcctctttttgtcagttaagaaagcgtaagcacaatctctcagtcaattgcattaacaggaatccattcatgtcactgaaaaatacttcttggcacagttcactttcctgacccaaagacaccaacaacaatcaaaactgcactttcagggtagtatattgttacactagcccagtcaaaacatactcagaacatttaaaaatgtataaattactgttagcactgcagttccgttttattttcttatttatttattaagacagagtcttactctgttgcccaggctggagtgcagtggcatgatcttggcttactgcaacctctgcctcccaggtttaagcaattctcatgcttcagcctaccaagtagctgggattacaggagtgcaccatcatgcccagctaatttttgtattttagtagagatggggttttgccatgttggtcaggctggtctcaaactcctggcctcaagtgacccacctgccttggcctcccaaagtgctgggattacaggtgtgagccactacacccagccctgcagtccctttttaaagagtactgactgttttcctgcaaagtactttcaaatccataccataaaggtagaatttatctggaagaatgtgttttttgaattccacctggcacttggttaaatctactttattttgccctttatttatttgaacagaactttagaatgctctaggtcaggaaaagaaacagtgtgttcgtttttaagaaggatgtgtgaatagtaagttggcattcagactcaagtcccatggtattgttcttatccaatgggacctctccttgggaatataattcctttcccagaggtatcatggtatcccaagaatataactgctctttggctctgtgtgtgaagattgggggagaggatgtaaactaagagtatatagcaaaaaaaaaaaaaaaaattttttttttttttttttgagatggagtttcactcttatcacccaggctggacgacagtggtgcaatctcggctcactgcaacctctgcctcccaggttcaagcgattatctcgcctcagcctcccaagtagctgggattacaggcgcccacctaatttctgcatttttagtagagacggggtttcaccatgttggtcaggctggtctcaaactcctgacctcaggtgatccacctgcctcagcctcccaaagtgctgggattacaggtgtgagccaccgtgcccagtgagtagacagcaaaatttaaagttcaccaactgatgttcccaaaagtgctgaacactaaatgacacagggctatgaggtacatacatttcttttagtaggagggaaaagtaaaagcttttcaaagtttgagtgctttattagaatttttaaatgaggcgaactatgattttaatttcacatcttggctaaggagatgccactggagtacagagataatctcctgtcttaagccacggatcagtcagtgtagccctccctacccctcaatctcaagaccctcttacttccgaactaaacaacacaattggcaaatgaagccagcacgaaactgtatcaaaaaacaagagagtctgcagtgagccagtgtattatgtaaccactgtaataagtgattacgtggcctcccatatggacctttcatatcctggtgggagatgggagaccaatttaatagctctgagcatgctccatggtgcaatcacaagtgccatgccaatacaaagacaagcaagcaggtgaatttccctagtgtacttttcaggaacacggttactcagttcagggacaggactacattgatgcacctgcaaagtaaagttggatgcttcagagcacatggatgatacccaggtcagcacggtgtaaggcatatatggacacaaagagaggccattgttggcaataaatagcattacggaaaagattccaaaccagcagaacagaaatggacctgatgctccagttttttagataagtaatcccaagaatccagttccaactctactgtcaacatgtggggcagaattcaatttctatcattgtttttacagatctgggctgaggccatttgctccttgcttggttaaaaaaaaataaaaaaataaaaaaaggtttcttcctgtttctttctgggcagggaaatacagcttaaagaaggaaaggccatgagtcctgggagcactatgaaggtagctaaactcttcccatatctacagtcaatgactgggaaatagagaaaggacagggcaacctgcccagccactagcatcgaaaacaaaaaggtatgttaattgtgaggctctcaattctagaaatgcccaaattaaaagagaaaaaaaccttgaaaaattaaacaaatttctctttctagaagtcatttatttacatattatatgtccgatatataatgtgtagataaatgtatactgcagtgaaagtgaccactctactgaactgtacagcacattataggacaaattattggaagttttcatctcatactggtatcttttaataaaaaaaaaaaattaaaaatcaaagaaaacgtctggccagggccaggataag

SEQ ID NO: 837 - DNA, 9738 bp, Homo sapiens; identical to SEQ ID NO: 836

SEQ ID NO: 838 - DNA, 9738 bp, Homo sapiens; identical to SEQ ID NO: 836

SEQ ID NO: 839 - DNA, 9738 bp, Homo sapiens; identical to SEQ ID NO: 836

SEQ ID NO: 840 - DNA, 9738 bp, Homo sapiens; identical to SEQ ID NO: 836

SEQ ID NO: 841 - DNA, 7843 bp, Homo sapiens
gtttccatcttgctattattccacggggcccagtacataatcgccactcagtgtttatgcagatcacgcttgaacactgccagtaacagggtcctcactatccatgacaactcacttccacatagccctgcttgttaagagttcattcattcattccgcagatgtttttggagtgcctactgagtgccactcactgctccaggggttgggatactaaggtgtgcctaacagaccaaatctctgcctccattaagtttacattctgtggaaaataatagctaccacattctagagtctgtactagtattttatatgcatcattatcttcactccacctatacagctttgccaggcaggcattattagctccactttacagagaaagaaactgaggcactaagagctccaggattgtccacctcacactgttagtctgttagtgatgaggcttggacttctgcgtagatccgtgctcctttccacagtaacaccttatgtgacaaaattagacagatcctaggatggctatgataattttttaaaaggaaaaacaactgttggtaaggaaatggagaaactgagatcctcacacactgttagggatattatccagccttaaaaaggaatgaaattctgatatatttgacaacatagatgaagcctgaaaacatttctaagtaaaagaaaccagacacaaagggacaaatattttatgattctatttatgtaagatacctagaaaaggcaaattcatggagacagaaagcagaatagaggatactaggagctggggtcagggagtatgaggagttattgcttggtaggtacagagtttctgtttggtgtgatgaaaaagttttggaaatagatagtggtgatggttgtacaatattgtgagtatagatctttcaccatgatcagatgggattcatcccagggatgcaaggatggttcaacatgcacaaatcaatatgcatgacacatcatagtaacagaaccaagagcaaaaaccatatatgatcatttcaatagaccctgaaaaagctttctaaaaaaattcaacatcgtgttataaaagccctaaaatattgggtatagaggcaacataccttaaaataataaacgctatctatgacaaactcacagctaacattgtaataaatggagaaaaattgaaagcctttcctctaagatctggaacaagacaaggatgcccacttttaccacttttattccatgtagtattgggagttctggccagagcaattaggcaagagaaggaaatgaagggcatccaaactggaaatgaagaagtcagattagccttgtttgcagatggcatggtcttctacttagaaaaatctaaagactccatggggcgtggtggcttacacttgtaatcctaacactttgggaagctgaggtggttggattgcttgaggccaggagttcgacaccagcctgggcaatacagtgagatcctgtctctctcttaaaaaaaaaaaaaaggccgggcacagtggcttatacctgtaatcccagcactttgggaggccgaggtgggcagatcatctgaggtcaggagtttgagaccagcctggccaacacggtgaaatgctgtctctactaaaaatacaaaaaaaaaaaaaattagccaggtgtggtggcaggtgcctgtaatcccagctaacttgggaggctgaggcaggagaatcacttgaactcgggaggcggaggttgcagtgagctgagatcgtgccattgcactccagcctgggcgataaaagcaagactcctcctcctcctcaaaaaaaaaaaaaaaaaaaaaagggactccaacaaaaaaccgttagagttgatgaatgaattcagtaaagttgcaggataattcaacatacaaaacccagtagcatttgtatacgctaacagcaaacaatctgaaaaagaagttgagtgcaatcccatttccaacagctacaaagaatgtaaaatacctaagaatcgatgtaaccaaagtgaaagatctatacaagaaaaactataaaactgatgaaataaattgaagaggatgcaaaaaaatggagagatatcccatgctatgtattggaaaaattaatattgttaaaataacaatattacccaaagcaatttatagatttggtgcaatctctgtcaaaatagcaaaggcattcttcatagatatagaaaaaaaatcctaaaatttatacggaactacaaaagacctcaaatagccaaagtaagcctgagtaaaaagaacgaagctggaggcatcacatttcctgacttcaaaatacactacgaactggccacggtggtacacacctatagccccagctattcaggaggctgaagcaggaggatcccatgagcccaaggagactgaggctgcagtgacctatgatcataccactgcactccagcctggacaccagagaaaaatcctgtctctaaaataaaacaaaaaaacaaaatgtagtacaaagctatagtaaccaaatcagcatagtactggcataaaaagagacacaaagaccaatggaacagaatagataacctagatataaatccatgcatttacagagaactcatttttgacaaaggctccaggaacacacaatggggaaagaacagtcctttcaataaatggttctgggaaaactaaataaccacatgcagatgaatgaaactagacccctatctctcaccatataaaaaaatcaaataaaaatggattaaacatttaaatgtaagacctgaaactatgaaactactagaagaaaacattggagaaatattccaggacattggtctgggcaaagagattttttgtggaagacctcaaaagcataggcaaccaaaccaaaaatagaaaaatgggattatgtcaagctaaaaagcttcaggacagccatggaaacaatcaacaaagtgaagagacaacccacagaataggagaaaatatttgcaaagtatcaatctgacgagggattaataaccagaatatataaggagctcaaacaactctgtaacaaaaaaccaaataatccagtttaaaaatgggcaaaagatctgaatagatatttctcaaaagaagacatacaaatggtcaacagagatatgaaaaaatgctcaatgtcactaatcatcagagaaaagcaaatcaaaattaaatgagatatcatttcatcccagttaaaatggctttttacaaaaaaaatagagaacatcttttttttttttttttttttgagatagagtttcactcctgtcacccaggctgaagtgcaatggtgcaatcttgactcactgcaacctccatctccaggttcaagcgattctcctgcctcagcctcctgagtagctgggattacaggcgcccaccaccatgcccggctgatttttgtatttttagtagagatggggtctcaccatgttggccaggctggtctcaaactcccaacctcaggtgatccaccagcctcggcctcccaaagtgctgggattacaggcatgagccactgcgcctggccaagaatatcttttctgtaaaaagatgctggagaagacgtggagaaaggggaaccctgataaactgttagtgggaatataaattagtacagctactatggaaaactgtatgaaggttcctcaaaaaactaaaaatagaactatcatatgatctagaagttccactgctgggtatatatctaaaagaaagtaaaccaatatattgaagagatatctgccttcccatgtttactgcagagatattcataatggccaaaatatgaaatcaacctaagtgcccagaagtggataaatagattaagaaaatgtgatatatataatattattcagccataaaaagaatgaaatcttgtcatttgcaacaacatagatggcaccataggtcattttgttaagtgaataagccaaacacagaaaaacaactatcgcatgttctcacttacatgtgggagctaaaaaagtggatcacatgaagatagagagtatattagtggtaccagaggccaggaagtgtggggggaggacaaagagaggttgatgaatgggtataaacatacagtttgacaggaaaaataagacctaggattcaatagatcagtagggtggctacagtttacaataatctattgtatatttcaaaatagaagagaataatttgaatgtttctagcataaagaaatatttgaggtaaaggatacctaatgacatgatttgatttttataaaatatatgaatgtattaaattatcacatgtaccctgaaaatatgtacatctgttatatatcaaaagaattttttaatttcatgaatgtatttaatgccactgaattgtacgcttaaaatagttaaaatgggaagtttcatgttacacacacatatatacatattatttaaaatagtaaagacgcttgtgttttaagcctctaaaatagtgatgaacacaagggaggaaacagaaggggaagacagaggagaggggtatggaaggagaatagggaagtacagagttgctaaagggaatggaatatgggtgaagaagaaaaacctttaaaagggatttttagaaagatttgctgtgtagtatagatataagccacttcctctgaaatcttgagcaaattccatattattcaccaattactttggtgcttgagttgcagttttagttttaagtgctgacgtggatgagaatggccttgaggcatccggatatatttgggtcacactaatctaagcaggaatttgtgtcactgtggcttttctccatttgcccctctcctgacccccttgtcttctcatgcccctgaggacactctgggccctgagatgtcctccacccccatcctgcccctcacctccacgcagcagtgtgcatccagcgggataatgccccttttctctttgcactcttcactcccaaagtagcagaggcagctgggctgcagctggaaccagcgttcggcccagttccttctcaggtgccctcgcttccacaggtagccctgccagccggagttacgtcagaggcttcccaggccccccttcgccctgcaccttgtgtgcttcccctagttcccagcttgcctgacctgcttcaggacatcttggatgagctcctggtagacctcgtggatggccatgctgagggtgtcccggcccacgccccgcagaagctcctccagctcacccaagctcacctccaagctcatgctgctgagtacctttttcagcaggtattccacctggagcaggagaaggaaggcctggtagctgcagcaggtggtgttgccagcaccaacaccagggagtgctctatctggctcccagagcctgggcagagggaaacaggggacagagcgttgagggggccagaggaccgaatgttatggagccagggaaaagacctgggagaggatcctggagccccaaccccaactcaggttttctctccccgtccacaacctccagtcccactccttcctgtcttaagggcaaggtgaaggggacctgagatctggggtccagaaagaggcaataaatcacagaaagtgtcaagggagtgcaaaggccctctcatccaatcactcattttgcagatgaccaaaaaaaagcccaaagggggaagtgactggctctaagtcacacagcaaactgggggcagccagaacccgattctgatctcctgaatcccattcaggtccttattccaagccccaatccccaaccctggggatctttcccttgtgggagaggaaggggatttggggtaggggtaggcgttggggagtggggagtagaggtaagctgggcagggacaggaaacctgttacagaggaaccggaagtggtggctggggtacatcctgctgcagttgttaactctgtatgttgatcgcagaagcaaacaacctcctggcctccgaggccaccttgccctgactggcaggggtctaacaagggcagccagccaagtgtatgtgcagatggacacatgtccctcacctgccccagcagctttttgggacactctgtttaggactttctgggggatcctgggtcttgtttgggtgtttagtagagggcactggttcagggctcgggtggttcccttcatcacccttcccacaaacagaagccaggacaaatgtgagtggagcttgacatgctagggcttcttgtaagtacagaagccccctctcctgtaaaccccactctaaagacctaaagtcaccctggcatctccacagccaccaagaggactaaagggtcacaaggccaaatgggcaggggagggaagtgaggataagagggagggtacaggtggatgggaaaatgccttccctggcttcacccaggagtaaggagatagggaccagattcccagccttttctcccaggatgccctatccctgggtctcttagctgagtttgtcctggctttccagaagaaaggcagaaagggaaaatctggaaccagagtaacctcctgtctcagaaaggtctccccttgccttgtaaagcatccttcctgtcctggaagaagtggcaaaaggtaaaggaaaaaaaagcacccttcctagattgccagtaatgctcagtaatgtatctggcatttagacctctgtgtaaacagaatttgcagatcattttcctacagtgaggaccagcagaaccctcatgaaagtgtaatttcagttttcctggaagaaggcaaaattactctgacacaggcagttctaggcatctggagacagctgggtgaggacagataccagcatgggaagatggtaaagaaagaaaggggatatgggaaggcaccaaaggtggtttggtctcattcatggttttgcttaggtctggtcccaagtgattcagtccctggggctgccatcaccctcacctcatcaggaaccatgatcagagggtacttgtcctcagacaggaagttgaagaggcaccagaggcggaaggcatcctgattggagagcatactgttcccgttgctatctgcccgatagttcttcttggccgtcagcgtccagcacagctcatcaaagtgctctttaacaaaagccccctcctccacctgccaccagggctgcaaatcagctgactgcatatctcagctctaccacgacactaggctccagctgggtttcttgggttcatctatgcccctgctccccacctggccaagtccagggccctaactcaagggatccctgagctgattaccaggtaactagctggttccaaccactccaccctccacaacacacccacacccacccaggccccctgacaacagattaactctagtctttcagcccagaggacaaagaaggagaaacccagcaggaagctaagagccaagaacctggaaacacagtgacagattggaggagttggagggggagttcagggggacagtctgggaagggtggagaaccctggaagctggaggagggccgggcagggattcggtggaaggttatgggtagggtggggcccacctcattagagatgagggacattgaaggtgaattgagggggacaggaagggggcaggtggctgggatgtgagggacgtgatgggacagcagtcacggacagagcaggcagaagtaggagtttatggcaggggcgaagagttggagtggcaaggtattaggctgctggccaggctggaaaagtggggagaggttacagatgctccctacaagctgggccccaccttgtccaggatgtacttgttgaggtagggcatgtatccctggctggacacagggccgtca

SEQ ID NO: 842 - DNA, 561 bp, Homo sapiens
aggagggagcgcgcggagagcgagggaggagggagcgagagagcaagcggcggagggaggggagaccaacttctagtgctaccataattcgcctaaagcaggtgcagcaactttcaccccgcctggcagcccgctgagagcgagagaaaaccacgtgcaccaaactttaggggaggaaaaatgggaacgtggggagaagacgtgaggcggcagatctgaaaaagatggtcattccggactcctgacgccgccagtcccgcggtgagacgtgagcgccattggcgtccgtggcctctgtttccgtggcaacctagtaaccattaattttcaattaaaggagacaaaaagctcgatgacagctccaggtctgctgaagatgtcaagaatctgtattaatatacagcaagagagcataattgtgtgtccatcttccagagcagcgaaaaatggagggataattaccagctcgaaagccactctgtaatttagttcttactgtcaccacagccctacacattagcataaattaaaagcagagtttattgttatcaaagtgcattg

SEQ ID NO: 843 - DNA, 650 bp, Homo sapiens
aggagggagcgcgcggagagcgagggaggagggagcgagagagcaagcggcggagggaggggagaccaacttctagtgctaccataattcgcctaaagcaggtgcagcaactttcaccccgcctggcagcccgctgagagcgagagaaaaccacgtgcaccaaactttaggggaggaaaaatgggaacgtggggagaagacgtgaggcggcagatctgaaaaagatggtaggtggagggaccccagggattcaccctggcctcggactaatcctatggggcgcttgcaaaccccggccatcccctggagtctgaaggtcattccggactcctgacgccgccagtcccgcggtgagacgtgagcgccattggcgtccgtggcctctgtttccgtggcaacctagtaaccattaattttcaattaaaggagacaaaaagctcgatgacagctccaggtctgctgaagatgtcaagaatctgtattaatatacagcaagagagcataattgtgtgtccatcttccagagcagcgaaaaatggagggataattaccagctcgaaagccactctgtaatttagttcttactgtcaccacagccctacacattagcataaattaaaagcagagtttattgttatcaaagtgcattg

SEQ ID NO: 844 - DNA, 5239 bp, Homo sapiens
gtggttggtagctgaaaaaacactcaaagaattgtagacagtttcaacatggctttactctctctctgggcacaagcgagccatatgtgcagcatcagcaaggtataccttttacagacaatagtggctctgagccaaacacgagctcatgtgagttgttacctaatgtgcctcatgtggtgtggttacataacgagcaaggttgtgtgcttgcactccaaacccactgagtcatgctgcaccagaaggctgcctcagcctactcctgactaaagcacagccatttcccttacactacaccccctaggctgagggcgtcctccaggcagggacacatgcctatatggcggagccctgagtccataacccacaacaacaatacagagagcaacagctcactactaggatctcagctatgatacttatgactattagggcccaatgtacgccagaacctagggatgctcaccatctctgcagggggttgacagtgaggctctcagtcaccttaatctcctggaagacccctttgcagggctgctgttatgttctgctgattgtcagggataaggtacaacattgtgttcctaaaagggcacaggtggctccttgggcagcagttatgtctaaggccacttggttttgcaacaccactttttgatctgatcaacctcattcattaacaggaggagggacactcaggtgtaattcagagcctgagcggtgtgctccgcaagagcagtaaattgtgcttctacagttttgacacctgctccagggatagtcattgccaaagggtagaaacaccagggggctcatcacattcgcaaaaactgagagcacagtgcctcccagttatacaggcatctgggcaatgtggggagaacagtagcaggtacataaggccacccccagatacaacatccactccagtttgctgataggaaaggctactgtgtcctcatagacccataagctcccaagaggcaaaaagtccattggggtccgaccttggtgaggccacttgttccaccataccttcagtgtggtgacacatgttatgtttgcacaggccgtgacaggtacccatcctgttaccccaatgttgctctgtgcactgcaatgcctgggcttgggctactacatgttcccctactagccagccccactcatcacgaatgctacggtccagccatgggtcttgctgtgtcctttgtccaaagcttgccacattgtgttccaggcatcagccatgggatctcaagtctccaggcatgtccagttctctgcagacacgggatgtatgtgtcagggaaagctgtctgcagctgctgctggaaaggcagtgcaggtccaacagttggaaacattggtcacctcagcataggtgtggggtcagtccacaatgcaattggagcatgttaacctacggttgaaatgacagagcaggcacaggtactaacagaggtaaatcacatccctcaggcaaaatataggctaactttccatccctggataacaatgcagccaccaagggcttttgccctgggtgatggtaccacaccttctcaaatctccatggttcctttgaatcctgtatccatgccaaagtcacagcgtagctcataataggcccatggaatccccactttatgtccatttgctgtgcccatcattgtacctgttgtccagtgaaatgtgttcccctatcactctcaatggccagaggacaaccatacagggaacataagtgttgcagggcctggatggtgttctgttggttggccaccctgcaagggtaggtgaacaacaggcctgtggccatgtctacagccgttagtgcatgcgtataccctcgcgactttggcagcggcccgatgtagtctacttcccacctggtcaagggcactcaccctattgttacttgttgtataacaccgggcagctgcctctttttaggatatgtctgaacacatgccaggcatttctgacaagcctcacaaatgtcttgcttgggaagggacagaccccaacacttattgaattgttgcatcagtttaccccctgcatgtcccagtttccggtgtagccacaaggtcacatcttgtgttggtgctgactctgaccatctgaccttagccaaggcatctgcctcatcattactaggggtggccaaaggcatatggcctgacacatgataaatagttacctctttttgatgacctatttcccaaaggtcttgccatatggcttggcctcaaatgggtctgtggctcactagccaattctgtattttccaagtagttaaccacaaggttaagcctcagtagactgcccagctatcagtacagattaccacaggtgtcacctccttggtgatcaccatccacactgctctgagttcagcccattggctactttgtccgcacccagtttcaaaccatatggtgtcagtactaggttggactgcaacagtggtccaggcagcagtagcacctcatctactgtgtaccatgccccctcaggaatcctgggatgcccttccttaaatggtgaagactcaggatctaggggtgcctcaggccgcatggccttatcttgcattaggactacacgtcccaagacctcttgcaactctgctgctatgggacttgtactcagcttactccactgctgcaaggagttgccccattttgccaaagtggacatctgtgctatcccactccaggtggtcattacacatagacgcatccatcctgttattgggtaagttgtccatatgatgactgcagcctgtcctgtcatgctctcatgagcccgaaggccagcatatacagctgctagctgtttctctatcaatgaataccggagttcagctcctttccatagttgggaccaaaagcctactggcattcttaggcgctctgtgcattgccacaagcctcaaccaaaaccgtctgtggccacatgcacctccagctcaaacaggtgcccctggttaattacttgtagggcttgtggctgctgaatagcgcacctggctgccagtaaggcagtctcagccacaccatcccagtcccaggcaagagaggcattactgcttctaaatctgcaagagaatcagaggttaacataatatcatcaatgagattatgacatatggtgcagctgtgcatatagccctgtggcaacactgtgaaaatccattgtcgctgtcccataaaggtaaagtattcctggctctctggaaaagaatgcattagccaagtctaccacatagtggtattgttccaattccatcatcgagcagtctatcaaatccatgatagatgagacagctgccaaaccttgtgaaacactcacccccagaatgtattcaggagagacatacacagcgcataagcagggagccaaacggtgatgccaaggtatagagatacaggtttcactttcactgaccagctgccataactgtcaatgtaagcaggtttgccaagaaacttatccgggttcccataaacaaggctgcaatctgtgccagtatccaccagcacccgctgtacatcggtgggggactggtggatcactaattccacatgtggcctccagtcatttagtgtccccgcaagctgggcaccttggccagttccctaatcaagcaaaaaaggctctacatttccacttggctgcagcaagtcatctttgaactgaagcgcctgggtgggaccaggttacacagcaatgtccttctcccccttgggcattttctggaattgctcctccagagacaactgtctccacaaagttaaaagcacttcattgggttgcttatcaattttctctcagtcaacccggccaaaataaaatctatacatgtctgtgagtgtgtcactcgttggcgccccctttttaccatggggggaccccctgtgggtggggcatcttccccttctttacagcatggacccctcggtcctgccgatggccttctgcttccctgagagtcaccatagcagtggtcacttcatgtatgtggtaccctatgtacaggttgaggacagtagctagggagtcaaaggcactcaggggtgcagaacccaacacaagattctcccatgtggtagctgaagcattcatctcctggtccctgggtattcaggtcaaacatagcctgccgcatacccgtctcccgaatgacttgcaccaaatcacatagactggtatttactcacggtttgggtatttcaccagcgttgttccacacagtctgtatggctgtccatagccactcaatcaggatgtgatcactttgcccttgtgccaactgcttgttcacctgcaaccactgacagagggaggggtgagtcgtgatagaggccagcttttccatctcagaggcagaacaggagatactatctgctctcttgtctcacaaatgaagcatccaggcaggtagacattcccctggatgctggcggcactgcttgcctaattcccacaactcagttggggtataggcagtatatgaagtatgttgcattacggtgggtgggggggggtccctgagccttctcttggggccccaacagctgttcatgatctaccttctggtggaccactgggtgagcccacaacaagagttcttctttctctgtatcagaccaagtggggatctctggctgagacaatggacccatgcctacattcacagcagcctctaattccttttccaagctctgtagctgggtttccaggtgccccacctctgcctgaagggcgcttacctgcactgcatccctcagggactgggtgtgtgcttctcatagcacagtcaaaatgcccatccaactctaccagcaaaagctcactccttctcagtgctctgtgcttccagcagcttcagagccttctccatgcttgcaggggacccatctatcgccacccaggtttccaccaaagcccatccaaacagcacagctgctaccaggtaccacaacccacgctgcagcctcatggccgacccggaatcaggggggaccaaagggtcactcacctcaggatcctgttcatgagcccaattgtcatgttctaactgagatctgaggggagtgggtgggcaagtggcaggtagctggaaaaacactcaaggaatcgtagatagtttcgacatggctttattctctctctgggcacaagtgagccatatgtacagcatcagcaaggtagttgtaccttttac

SEQ ID NO: 845 - DNA, 5239 bp, Homo sapiens; identical to SEQ ID NO: 844

SEQ ID NO: 846 - DNA, 5239 bp, Homo sapiens; identical to SEQ ID NO: 844

SEQ ID NO: 847 - DNA, 3351 bp, Homo sapiens
tccccctccccttacttccactgatcacttttccttttccatacccaggggtattataaacctcactgctgacaccccacatgagggtaagcaaactttttctgtaaacaccagagagcaaatatggagttttcggggcaatatactgtgtgtgacaactattaaactctgccatcgtcacctgcaatgaacaatacttaaaaaaaaaaaaaaaagaatgagcacagctgtgttccaataaaattttatttatggacactgaaatttgaatttcacataattctcacgtgtcacaaaataattcttttgattcttttccaaccatttaaaaaatgtaaagaacattcttagctctcaggctacacaaaaatatggctatactttgtcaaccatccctagaccctgaacagcatttctgaattagtaacacttaggtgtcctaaaaaacaggtttgggatagctgtgtgttaaggagtccctaaaaaattcataatgccaattagcataataaaggctctaagccttgcggttaagaaagcaagcttaacttccgtcagctcagctagtccttcctttttcctagtattaagttgcaacagtttgaaaaatatttaaataagaatagtcaagtcaaacttcctgggatgactaaaatgatagctaaggtttaaaacagacatccaagttcctgaaactaataaagccacaacatgacttcagctatgccatcagaaactgaaagtatctagaggagaacaatgataaaataaagtgtatacatgctctgaaaaaaagtcactttagtactctagttctacattaatttgtattatatttgaactcacagatgtgaaaggaaaacaaagagttcccacaagtttgccaatctcaatttggtaagccactgtctacttccaaacctaactactcattttagttaatgacagatgggtatttactcccataaagtttaagaataatcggtgttaaaataggaagctaaaaatcaggtgcatgagaaaattatttccaagtttactaacatgaaaactgggaagctctttgatacctgcacaacactgcagctcccattatgacattacaaaaaacatacaggaccataccccaaattggccatataaacacaaagtcaaactaaattacatttagaatgtcattcaaaactaccgtttaaaaaatgtaattttagcaagtcaaaatttcaatttcaacttgttttctcaagtaaactttttgcgataatattcaaattagtttggaaataacttttagcagactcagaatcaataaggatgtgattttaggtttcaggatataatcaaacttccaaagtagatgtcaaaaaaaaaacaccttgaagaaaatagcagtattttggaaagtgaatgtgaatctcaatcagctggcttaaacaattccaataattccagtcgttttactacaacagtccaattaatttaaacttgagataatgtggagccaactgtattaaccaacgctacagatatgccaatgaaaagtcgtttacaaaggatcacaattctgaataagtgtgctttaaaggggaggaacatggtatagtccccaattgttcacatacatgcccaagattattttgacattgagatatagtactttaattcccaaacctagcactgtattaattcactccctcgactgaaatgtattgctggttagctccttaatgaccttattttgaaatggctttattagttaagtacagaatccatttcaatttccaatgataccatttcactaaaagacaaattccaaaaatgtcaaccaccagtagctcattcttgacattggctgtttccttttttttttcccaaagtaaagcctaacaattaatcaacaaatgccttttcaatctaattaaaacacagtttagtaaggtcattaaataaatttatctaagaatttccgtaaaaactcactacaactctaaaacagtatgtccttaaattagaccaaatatttaatagcaaaaatggtagcttgcatattcgagggtcactccatggatttagaaaatatttttaaatgtgacaaaaaaaaaaaaacactaaagtcagtttcaaatggaagtcaccaaatacagaggtatatacttcggttttttaagctactgataacgagacatttaaatcaagctatggaaaggctttgtctaaagggtgatattattactaaaggctcacacagaaatctttgcatgctacacacaaaggaaacatttacacttctagtccacaaaagcctatcctaggattgtgccaggggcacacaaggatttcaaagtacagaaaaaactgggcatacacatgccctacaaagcagccaaaagacattccccagtctctctcaggaaatgtttcaagatgaaaagcaaaagtctgaagtcccttggaatcttgggttgatttcttcattattctcaaggctaggttgttttcccccagcatactttgttgggcaaaaataaaacatttccaaataaaagcaactcctcagccccaattttcaatgcaatatgcttattaaaagttcaacatttctcaaggtctagacttatagtgtgatcatattacagtactcgggaagagcattttctttgttgttgaccctgctagggaaacaggtcttgactcagccaaagtggcgttcttgtgggtgattaatgacaggcctagatctcgccctagtgacatccatcccccaccccccacccccactatactaaaatcagccgtgtctgaactgaaggaggggctgtagcctcgcctcaaaccacccagtcccagagttaatagctgcaaccaatcgattacggcaagcacacatccagattggggtgaaatgtgaccctttcgcctaaatttacgaataatatcgtcctctctgatcatttccgctggggctccagcgactacggaaacaattccaatcattcggcccaaagaaaaagatgtccctgttctacccaatacgggcaaggcaaagcccctacccacctccaaacactatccccttgacatcagcccatttctattgtgtcttattaggtcctcgggctacgaggacctagtgaaaaacgtggctgccctactactttgctaagaacaagaaccacacagtccggcacccccaccccaggggccgcatcccacaccccaggacccctgttcccagttctctccactaccccggcggccgcggggccgggtcccacctgtggtgaggcgggaggagacgtcgccgaagggggatggctccattcggagatacttctgcggcgaggcggccgc

SEQ ID NO: 848 - DNA, 3351 bp, Homo sapiens; identical to SEQ ID NO: 847

SEQ ID NO: 849 - DNA, 9492 bp, Homo sapiens
cacattccctggaatctcaagagagactaagtctgaaatatattttatgtgagtttatcacccctaagctccttattagcatgaggtctcacagagtttctagatgagaaggtcattttaaaaattattcagcgttattgtatagttcttttaaaaaataaattgaaaagatatgatggaaaggaaatctggaggacatttgctctgaatcccagcagtcttgacttaagtgatgggcatacaggcttcaaacactgccagttggagcaggaggcagttaggaagacactgatttttgtcctggctctgcctgtaagatatgatctatgcatggcaaagaacttggataatttgtcagacgaagtttcactctcgtcacacaggctggagtgcaatggcatgatctccactcactgcaacctctgactcctgggttcaagtgattctcctacctcagcctaccaagtagttgggattacagatcttctgccctccactgctccctggtagacccacaggacaacgatctctatgaactgcatcaagtgtttcccttgccctgcagtttctagtggagtttggctaatggatatccctggcaggagatcagaggcttctagaaaagaagtctaggctatccacttggagaaagtggccatgtgaataaaaggaccccagcagcagcccagcaccatggttcctgacatacaatgaaacattcccataagaaacataaagcaggctggggacagtggctcacgcttgtaatcccagcacttgggaggccgaggcggcggatcacgagatcaagagatcaagaccatcctggccaacgtggtgaaaccacgtctctaataaaactacaaaaattagctgggcgtggtggcatgtgcctgtagtcccagctacttgggaggctgaggcaggagaatcgctcgaacctgggagacgtaggaggttaaagtgagccaagatcatgccactgcacaccagcctggccacagagcaagactctgtctcaaaaggaaagaaagaaaagaaaagaaaagaaaagaagaaaagaaaagaaaagaaaagaaaagaaaagaaaagaaaagaaaagaaaagggccaggcacggtggctcatgcctgtaatcccagcactttgagaggccgaggcaggtggatcacgaggtcacgagatcgagaccagcctgaccaacatggtgaaaccccatctctactaaaaatagaaaaattagctgggcatggtggcacgtgcctgtaatcccagctactcgggaggctgaggcaggagaattgcttgaccctgggaagtggaggtcacagtgaaccgagatcgcaccactgcaccactccagcctggtgacagagcaagagtccatctcaaaaaaaaaaaaaaacaaacaaacaaaataaaaaaaaggaaagaaaagaaaaacatgaagcaaggcttaaagatgaagagctaccaaggaagtggtaaagaagtatttacattgggtggtcagagaaggcttcctgaagagataacattcaagcagaaaaggaagttagataactaaatgggtaacagagatgagtcacaaacatcagaaaaaaatatacatatatatatctacaaatgttttcgtgatatgttataagcaatatattcaaatcaaattcaccatccttcctatattggcatccacatagaatgcccatcctgtcatctccttttctctgcattactatttatctttacaaatcaatttagctgtcatcttctccaggaagacctacctgacttttctaatctgggtagtgctctcttctatgtcatcatagctccctgtattttcttatatgacagtttgtaatatacattaaccttagagctcttttagagtaaagaaattctaactttgatataccctgcaatatgtacattgcaggtaaaatggcaatgtttttctgcctctacttacactgaattcactattctttcttttgttttattttatttcctaatggttcctagtgtaagcacgtcaccaaaatttagattaaatcaagaaaaaagtttttgaccaatggctgcttaatctgtcactgaaaagtagcaacaaaaccaagcttttatcaaccagaaaacatattgtgcttcctttgggaaagtaaacaagacagtagacatagaagcctcacacaaagggggaaaataaactgaaggattttaagagtaacacctgtcaaatggagcagtaatgtgtatggtttgacaaaataggctggtgactgtcaaagtaaataataaatcttccagctctgactaatgactgaactatgctggaagacttgagggaagcatccaataaaatgcaaaattgaaagaaaaattggaacggtcggcacagcctcctagcagctaaatttcaagtaattttggaaaaacacaaaccattcaccaggttccatggcagagggaaaagttccaaaaactgttctgattgagcattctgctttagttaggaaatcacatctcttctgatggagtgccaagaagttggtttctgctttttcaatacagaaaaaatcctgccgtgactgtgacattctctgtgcagacattcagctgactgccaataatatcattagggaagaacagctagagctggacccctttgtacgtagagtgaagcaaactgcagaaaaggcatagatccagggaaagcccatctctgatacctttctattttcatttcttcccaattcaggtacctaatttcctttagtcacagcttcttagaagactatcttattttttcttaccagcaagcaaagattttctaacattattataaagaaaactggccaagtgtctgctgattatgttatgatccttccaggggcagtttcatttatataaattgtttcttgaggacccaaaaagccttgataaatttctgttctagaatttaataatatatcacaagtggaagaatgcatcactagtgaaagaattttaagcacctcaaaaacacagttctataaaagtcatcttttttcagaaactttccacttatctctcaagttcaaagtagcagaggcactgtcttgaagaattatactggtctaaaaactgcattttattaatatattattttcatagccatacttatgaaagcaaaacatcaagacattttctgattacagaatgaatatttgaattcaagatcatgccagatttatggctagcaaatcgctgtcaatgtgtatcccaagtgcagtgagaggttggctccctcaaatacccatgactcagaaatgacaggaatcaggatgcctttgcttctttcccagtgatttcaacattctaggatgatttgattcaacaaccctttggttgatccattctactctgataggtggttatccaacccagtcaccaccatgtccaaggaatcctgtacttcttgcagcaattattctgcttggcaggactctcttctctgaagctttctctgctcatttttcttgctgcctctgcagggtcagtaatgtgtctgccagtaaagtgttgtctctttccatttcctattcccataaccacaaggaatagaagcagttccttcgttgaggaaagagtatttgtccattaataaccacgctagtctagcattcaaatccctcgttgacacttaggtcatttttaccttggactactacaaccacatactgtgctgtctccaaggctttattcttctctccagtttaaaatgatatgcactctacagttcaaatcattttctagatgcatttaagttatgcccatgggaagaaagagcctgagcttggcaatattgcatacaggaagtgtggtgtggaatgcaaagaattgtctaaaagaagcatttaaatacactatatgatgacagagactcagcttaatagttttttgcactccaggaatcaagaaattccaataaactattacaattttaatggctacctttgacaaattatgagaatttgatctgcctggatcccaccttattacaaagttattaaaaatattttgtgtaatttgcaaagtaaaaagtcactgaatagtactgtcatgttgttatttactaacttctactctgatgcagtcaaatcagcaaagaaattgtaggaagctccttgaacaataggtacatggtttgccaaatatgctcataagaagaaaaagcaaaacttagaggaatgtgagactgaaatagaaaaaacaaacaaacaattgtctgctatcctgggaaactctgtttaatttcctggcatctgagccatttttgtaacctatgttttggaattactatagccctgtatgaaagagttaattcattaccaaaaggtgagccatttcctgtctactcaattgtagaatcagactaagtactattttatcaaaggagcattggctgtcacccagcgttaatcattttcagaacaattatgatttactttagacataaggctgatggatttttatttccagattccattttggcaactttaagccttacctcatatgtaagactattactaaaaacagtgcctctccaaattttcatccttcattatttctgtttctccctaaaaaaaaaaaaaaaattaaaattaaaattaaaaaaatacaattaattacattcgttagttagccaatgtgattgccaatgctagcttaaacattgtttgtatataattttacatagatgtggagccaatagagatctgaatgattgtgtgcttttacacatcttttagctaaattaaaaatccaaaagctaaatcttgtgttctgggacagcatgtgaatttgatatttcctggcggctattggaaccataaaccattgaatagactatattcattcatttaagtggtttgtgactgtgaaagactaaatatttacaatgtcttttatccttggatacaatgtaatgatttcatcattttaatagccttttactcaaatgtggttgcatcctggttagattttagacatgcatttcaaatagtttgggtctctgtaatcatttcaatgactcccaagattgaaaaacaatatatagcaagagttcaagtctttgaacttattactttagttttgatttatgtcttccctccagaattttgccctgtttaccaaactttgctctaaatgttcagataagagatatttgtgctgagttggtcagtggaaggtcactaacagatcccaggcatatatttataagtgcaagtgcatgtacacaaatagggatttggcaacttaatgtgaatgaaccaagacaaaaccatagcagtcactatagaaacaattaaaacaatatgcccccactgaaagctatggaaatagctttgtggtacatatgaaaacacagtattatcccattaaagcaaatatctaggttttttttcccttttagacagtcctaacaaatgccagaatctctttgtctcatttcagaacgaaaaattgatttgtgtcttctttcctacctcacgtagggtgaaaattaaatctggtttattttcaacataaaaatgtagaaacaacattggttcattttacatttggttctaataatcacaaatatttatttctatgaatattcagtcttctgaatagcaggaaaataaaaatactgactaacatatacattgtcaaaatataatttgtgattacttcccctaaggtgcagaatggatatgatcacttagaacttttgtaccaagaatttttaaatgctcagctcagagtagttgataccaatgattattttatgaaccattatcctaaaatacctatctaaaacgtacaataacttggttggatcttctgtcaaaccataatttatgtcacaatgaggttagatgccaaatgaaataaataaaggctaaggaattttttggcttgtaatatactgatacttaatgaatgttcaaagaaaatcatgttcaaaggggtgtctttttttctaccctacaaggagaaaaatatatatactttggttctttacctgttgatggttctttacctgatagggtgacttaacccttcattcctgaaaggtctgggccatttgcagttctgccagaattggattgtcatagttttccattgactttaattatagggtatgttaatactaggagacacactaaggaatcttctggatttcagacatactcttccttacctttattgaggaggattagttcaatttccccttcgtcatcaggattaataatcccagccaacaccacatctttcttcttgcctgttgactcaaaggcatgaggaacccaaaatggccaggtggcagtcttaacatccaacacaatgaaatcattgttgtgtctcctggtagaagcatttgtttctgtggaactaagacctctaggctgacagaaattaaagctgcagaaacaggaaccaaaaattttgctagtgggtcaccaaaggtaattgtaagtgatgccactcccatttccactctttgactcctagacctatatatcctggctatcagagaaagagtaccacataatgacactgattcagagccttctggagaatcttgctccagccctgaaaggtattattacctagctggtgctgtaattcagtcttcaaaagaacattccatcattctatcaagccagctgcttcagattggtggggaacatggtgaaatcagtgaaatccatgagcatgagcccattcttgcacttcttttgttttgaagtgagtttcttgctcagaagcaatactgtatgaaatacaataacgggaaatcaaaaaaaaatggctaggaggttattgtaattatccagaccaaaatgattcacaacttatgttaatttgattgtcctgaaaaagatgaagagggaatgagtttgagatagagatgtggtaagattaataagatcttcccatgtagagatggggagtataggtaaagtaaatagtatgttggtgtgatgagtatatgtaatatataaaatgtgtataattctctaagcatgtgcttaaatctctatgagtatgagaagtatccactactctcgtgtgcttctctgtgatgtttgtcaataactactttattccctatttaacatttttccccacagcagataaaggatttttaaaatgtgtaaagcagatgcaagctggaaatccctttctgttagtaatttctgagattggatatggatgattaaaaaaaaaaaccactgtgcctaccccttcttatcatgctttcatttggacagcactctgtcaagtcataggattttggccgcgatctttcttaccatgtttggtgggtggcaattaatcacatggtgtgcatcacccttttcacccagtacactaatatactgtgctcaaggatgcaaatgttcatggtaaaaacttatctgtttgcatccccatgttgaacgcatcccgcatgttgaatgaatggccttaaaattcctgcatcgttgttgtctatcttctgttgtaatagagatacaggcaggaatttagcctaattaattcccatttataacactcagcactgccccctaaaaatatagacatttaataaatgttttggtgataaaggaataacttatctttccttggatgcatccctttcaactgaaccaagaaaagcatacattgtactggtttagggaggataaatgtaattccatgacaattaaaaatgataggaggagtagaaacccatccatctatctaatgactaaacttcgctggtgaagatttgataattctagtgaatgttttagtggaggagacttttattttaatatattaaaaaattgaggaaagtctaactttgttaactcagtagcttcaagccatttgaagcaaccacagtgaactgaagaaaagggtctgatctatattttcacttcagaacaaaagaaaacgatgtttatcctatttaaattagttcaaattttgttcctattatttccaatataatatataaattataaaatctaagtcatatatacatacccataccacacgtgatttaatatatgatatatatccatagctccacatgaaaaattgttattttttatgatttattactttaaaatattatatttaacttttggaatctaaaagctgtttatcaagtgaaatggatatatagataattaaaataagtttgttaatgcaaaattaagaattaggttatttttattgatatgctagtttgtgtatgagcttgtgttttattttattttaatattttataccactttattgagatatatgattgacacacaaaaagatgtatatatttaatatacacaacttgataaatctggcaacaaatataaatctgtgaaactatcacaacaatctatatcataaatgtattcatcacctcaaaagtttctctctcatctctttattattgttattattattttgtgataagattccttaacatgagatctacacttttagcaaaatttcaagtataaagcaaagtatcattaaacatgggcactatgcagtagagcaaagctcttgggcttattcatattgcacaactgaagccttgtaccctttgactaatacctctcagttttcccagaggagggaacatggtacaatgactgtggaaaacagcatagaggttcctcaaaaaaaattaaagtagatctaccatatactccagtaattcctcttttcaaacatgaaatcaaaatcgggatcttgaagagatatttgtacacccctgatcataataggattattcacaatagccaataaagggaaaccacctaaatgtccatcaatggattaatgaatacatatgatgaaatattattcaaccatttaaaaaattctgccatttgcaacaatgtgatgaaactggagaacattatggtaagtgaaatagttcagacacagaaaggcaaatactacatgataccacttccatgtgctttattttagtaccaacacaaaccaaaccatgcggtatctagaaactgcttgttggaaacttggcttctgggttaagacttctgctgagagcacacaatctgtacaatgagctctgaataaagaaataaatctcaaagtgaagcaaaaggtgaagaagatggggcaaatcttgagttggttgtgaaagcttctgcacgtaactcccttttctccaactttcatgggctgagaaggccatacccagatacaaagaagatagcaagtgcaatcctaccatgtatcaagaagaaaattttttgaattttttgcacaatcctaatgatttgggggacttcaatccttaaatcagcttctctaataaacaccaggactttctgccatctctgtcaagttctatgccctcaccttgctttattttcttcagactacttataaatatatgaaatcatattgtttgcttggagatatagaattggac

SEQ ID NO: 850 - DNA, 9162 bp, Homo sapiens
atcagatcttctgccctccactgctccctggtagacccacaggacaacgatctctatgaactgcatcaagtgtttcccttgccctgcagtttctagtggagtttggctaatggatatccctggcaggagatcagaggcagagccctgcatgtagtgcacagcagagaagaggaactctgtaaaggaaactgagaaggggcaggcagacaggaggagaggatgacatcctgcaagccaagagatgggtgaggtttccaacaagggtttggcagtgcctaaaaggcttctagaaaagaagtctaggctatccacttggagaaagtggccatgtgaataaaaggaccccagcagcagcccagcaccatggttcctgacatacaatgaaacattcccataagaaacataaagcaggctggggacagtggctcacgcttgtaatcccagcacttgggaggccgaggcggcggatcacgagatcaagagatcaagaccatcctggccaacgtggtgaaaccacgtctctaataaaactacaaaaattagctgggcgtggtggcatgtgcctgtagtcccagctacttgggaggctgaggcaggagaatcgctcgaacctgggagacgtaggaggttaaagtgagccaagatcatgccactgcacaccagcctggccacagagcaagactctgtctcaaaaggaaagaaagaaaagaaaagaaaagaaaagaagaaaagaaaagaaaagaaaagaaaagaaaagaaaagaaaagaaaagaaaagggccaggcacggtggctcatgcctgtaatcccagcactttgagaggccgaggcaggtggatcacgaggtcacgagatcgagaccagcctgaccaacatggtgaaaccccatctctactaaaaatagaaaaattagctgggcatggtggcacgtgcctgtaatcccagctactcgggaggctgaggcaggagaattgcttgaccctgggaagtggaggtcacagtgaaccgagatcgcaccactgcaccactccagcctggtgacagagcaagagtccatctcaaaaaaaaaaaaaaacaaacaaacaaaataaaaaaaaggaaagaaaagaaaaacatgaagcaaggcttaaagatgaagagctaccaaggaagtggtaaagaagtatttacattgggtggtcagagaaggcttcctgaagagataacattcaagcagaaaaggaagttagataactaaatgggtaacagagatgagtcacaaacatcagaaaaaaatatacatatatatatctacaaatgttttcgtgatatgttataagcaatatattcaaatcaaattcaccatccttcctatattggcatccacatagaatgcccatcctgtcatctccttttctctgcattactatttatctttacaaatcaatttagctgtcatcttctccaggaagacctacctgacttttctaatctgggtagtgctctcttctatgtcatcatagctccctgtattttcttatatgacagtttgtaatatacattaaccttagagctcttttagagtaaagaaattctaactttgatataccctgcaatatgtacattgcaggtaaaatggcaatgtttttctgcctctacttacactgaattcactattctttcttttgttttattttatttcctaatggttcctagtgtaagcacgtcaccaaaatttagattaaatcaagaaaaaagtttttgaccaatggctgcttaatctgtcactgaaaagtagcaacaaaaccaagcttttatcaaccagaaaacatattgtgcttcctttgggaaagtaaacaagacagtagacatagaagcctcacacaaagggggaaaataaactgaaggattttaagagtaacacctgtcaaatggagcagtaatgtgtatggtttgacaaaataggctggtgactgtcaaagtaaataataaatcttccagctctgactaatgactgaactatgctggaagacttgagggaagcatccaataaaatgcaaaattgaaagaaaaattggaacggtcggcacagcctcctagcagctaaatttcaagtaattttggaaaaacacaaaccattcaccaggttccatggcagagggaaaagttccaaaaactgttctgattgagcattctgctttagttaggaaatcacatctcttctgatggagtgccaagaagttggtttctgctttttcaatacagaaaaaatcctgccgtgactgtgacattctctgtgcagacattcagctgactgccaataatatcattagggaagaacagctagagctggacccctttgtacgtagagtgaagcaaactgcagaaaaggcatagatccagggaaagcccatctctgatacctttctattttcatttcttcccaattcaggtacctaatttcctttagtcacagcttcttagaagactatcttattttttcttaccagcaagcaaagattttctaacattattataaagaaaactggccaagtgtctgctgattatgttatgatccttccaggggcagtttcatttatataaattgtttcttgaggacccaaaaagccttgataaatttctgttctagaatttaataatatatcacaagtggaagaatgcatcactagtgaaagaattttaagcacctcaaaaacacagttctataaaagtcatcttttttcagaaactttccacttatctctcaagttcaaagtagcagaggcactgtcttgaagaattatactggtctaaaaactgcattttattaatatattattttcatagccatacttatgaaagcaaaacatcaagacattttctgattacagaatgaatatttgaattcaagatcatgccagatttatggctagcaaatcgctgtcaatgtgtatcccaagtgcagtgagaggttggctccctcaaatacccatgactcagaaatgacaggaatcaggatgcctttgcttctttcccagtgatttcaacattctaggatgatttgattcaacaaccctttggttgatccattctactctgataggtggttatccaacccagtcaccaccatgtccaaggaatcctgtacttcttgcagcaattattctgcttggcaggactctcttctctgaagctttctctgctcatttttcttgctgcctctgcagggtcagtaatgtgtctgccagtaaagtgttgtctctttccatttcctattcccataaccacaaggaatagaagcagttccttcgttgaggaaagagtatttgtccattaataaccacgctagtctagcattcaaatccctcgttgacacttaggtcatttttaccttggactactacaaccacatactgtgctgtctccaaggctttattcttctctccagtttaaaatgatatgcactctacagttcaaatcattttctagatgcatttaagttatgcccatgggaagaaagagcctgagcttggcaatattgcatacaggaagtgtggtgtggaatgcaaagaattgtctaaaagaagcatttaaatacactatatgatgacagagactcagcttaatagttttttgcactccaggaatcaagaaattccaataaactattacaattttaatggctacctttgacaaattatgagaatttgatctgcctggatcccaccttattacaaagttattaaaaatattttgtgtaatttgcaaagtaaaaagtcactgaatagtactgtcatgttgttatttactaacttctactctgatgcagtcaaatcagcaaagaaattgtaggaagctccttgaacaataggtacatggtttgccaaatatgctcataagaagaaaaagcaaaacttagaggaatgtgagactgaaatagaaaaaacaaacaaacaattgtctgctatcctgggaaactctgtttaatttcctggcatctgagccatttttgtaacctatgttttggaattactatagccctgtatgaaagagttaattcattaccaaaaggtgagccatttcctgtctactcaattgtagaatcagactaagtactattttatcaaaggagcattggctgtcacccagcgttaatcattttcagaacaattatgatttactttagacataaggctgatggatttttatttccagattccattttggcaactttaagccttacctcatatgtaagactattactaaaaacagtgcctctccaaattttcatccttcattatttctgtttctccctaaaaaaaaaaaaaaaattaaaattaaaattaaaaaaatacaattaattacattcgttagttagccaatgtgattgccaatgctagcttaaacattgtttgtatataattttacatagatgtggagccaatagagatctgaatgattgtgtgcttttacacatcttttagctaaattaaaaatccaaaagctaaatcttgtgttctgggacagcatgtgaatttgatatttcctggcggctattggaaccataaaccattgaatagactatattcattcatttaagtggtttgtgactgtgaaagactaaatatttacaatgtcttttatccttggatacaatgtaatgatttcatcattttaatagccttttactcaaatgtggttgcatcctggttagattttagacatgcatttcaaatagtttgggtctctgtaatcatttcaatgactcccaagattgaaaaacaatatatagcaagagttcaagtctttgaacttattactttagttttgatttatgtcttccctccagaattttgccctgtttaccaaactttgctctaaatgttcagataagagatatttgtgctgagttggtcagtggaaggtcactaacagatcccaggcatatatttataagtgcaagtgcatgtacacaaatagggatttggcaacttaatgtgaatgaaccaagacaaaaccatagcagtcactatagaaacaattaaaacaatatgcccccactgaaagctatggaaatagctttgtggtacatatgaaaacacagtattatcccattaaagcaaatatctaggttttttttcccttttagacagtcctaacaaatgccagaatctctttgtctcatttcagaacgaaaaattgatttgtgtcttctttcctacctcacgtagggtgaaaattaaatctggtttattttcaacataaaaatgtagaaacaacattggttcattttacatttggttctaataatcacaaatatttatttctatgaatattcagtcttctgaatagcaggaaaataaaaatactgactaacatatacattgtcaaaatataatttgtgattacttcccctaaggtgcagaatggatatgatcacttagaacttttgtaccaagaatttttaaatgctcagctcagagtagttgataccaatgattattttatgaaccattatcctaaaatacctatctaaaacgtacaataacttggttggatcttctgtcaaaccataatttatgtcacaatgaggttagatgccaaatgaaataaataaaggctaaggaattttttggcttgtaatatactgatacttaatgaatgttcaaagaaaatcatgttcaaaggggtgtctttttttctaccctacaaggagaaaaatatatatactttggttctttacctgttgatggttctttacctgatagggtgacttaacccttcattcctgaaaggtctgggccatttgcagttctgccagaattggattgtcatagttttccattgactttaattatagggtatgttaatactaggagacacactaaggaatcttctggatttcagacatactcttccttacctttattgaggaggattagttcaatttccccttcgtcatcaggattaataatcccagccaacaccacatctttcttcttgcctgttgactcaaaggcatgaggaacccaaaatggccaggtggcagtcttaacatccaacacaatgaaatcattgttgtgtctcctggtagaagcatttgtttctgtggaactaagacctctaggctgacagaaattaaagctgcagaaacaggaaccaaaaattttgctagtgggtcaccaaaggtaattgtaagtgatgccactcccatttccactctttgactcctagacctatatatcctggctatcagagaaagagtaccacataatgacactgattcagagccttctggagaatcttgctccagccctgaaaggtattattacctagctggtgctgtaattcagtcttcaaaagaacattccatcattctatcaagccagctgcttcagattggtggggaacatggtgaaatcagtgaaatccatgagcatgagcccattcttgcacttcttttgttttgaagtgagtttcttgctcagaagcaatactgtatgaaatacaataacgggaaatcaaaaaaaaatggctaggaggttattgtaattatccagaccaaaatgattcacaacttatgttaatttgattgtcctgaaaaagatgaagagggaatgagtttgagatagagatgtggtaagattaataagatcttcccatgtagagatggggagtataggtaaagtaaatagtatgttggtgtgatgagtatatgtaatatataaaatgtgtataattctctaagcatgtgcttaaatctctatgagtatgagaagtatccactactctcgtgtgcttctctgtgatgtttgtcaataactactttattccctatttaacatttttccccacagcagataaaggatttttaaaatgtgtaaagcagatgcaagctggaaatccctttctgttagtaatttctgagattggatatggatgattaaaaaaaaaaaccactgtgcctaccccttcttatcatgctttcatttggacagcactctgtcaagtcataggattttggccgcgatctttcttaccatgtttggtgggtggcaattaatcacatggtgtgcatcacccttttcacccagtacactaatatactgtgctcaaggatgcaaatgttcatggtaaaaacttatctgtttgcatccccatgttgaacgcatcccgcatgttgaatgaatggccttaaaattcctgcatcgttgttgtctatcttctgttgtaatagagatacaggcaggaatttagcctaattaattcccatttataacactcagcactgccccctaaaaatatagacatttaataaatgttttggtgataaaggaataacttatctttccttggatgcatccctttcaactgaaccaagaaaagcatacattgtactggtttagggaggataaatgtaattccatgacaattaaaaatgataggaggagtagaaacccatccatctatctaatgactaaacttcgctggtgaagatttgataattctagtgaatgttttagtggaggagacttttattttaatatattaaaaaattgaggaaagtctaactttgttaactcagtagcttcaagccatttgaagcaaccacagtgaactgaagaaaagggtctgatctatattttcacttcagaacaaaagaaaacgatgtttatcctatttaaattagttcaaattttgttcctattatttccaatataatatataaattataaaatctaagtcatatatacatacccataccacacgtgatttaatatatgatatatatccatagctccacatgaaaaattgttattttttatgatttattactttaaaatattatatttaacttttggaatctaaaagctgtttatcaagtgaaatggatatatagataattaaaataagtttgttaatgcaaaattaagaattaggttatttttattgatatgctagtttgtgtatgagcttgtgttttattttattttaatattttataccactttattgagatatatgattgacacacaaaaagatgtatatatttaatatacacaacttgataaatctggcaacaaatataaatctgtgaaactatcacaacaatctatatcataaatgtattcatcacctcaaaagtttctctctcatctctttattattgttattattattttgtgataagattccttaacatgagatctacacttttagcaaaatttcaagtataaagcaaagtatcattaaacatgggcactatgcagtagagcaaagctcttgggcttattcatattgcacaactgaagccttgtaccctttgactaatacctctcagttttcccagaggagggaacatggtacaatgactgtggaaaacagcatagaggttcctcaaaaaaaattaaagtagatctaccatatactccagtaattcctcttttcaaacatgaaatcaaaatcgggatcttgaagagatatttgtacacccctgatcataataggattattcacaatagccaataaagggaaaccacctaaatgtccatcaatggattaatgaatacatatgatgaaatattattcaaccatttaaaaaattctgccatttgcaacaatgtgatgaaactggagaacattatggtaagtgaaatagttcagacacagaaaggcaaatactacatgataccacttccatgtgctttattttagtaccaacacaaaccaaaccatgcggtatctagaaactgcttgttggaaacttggcttctgggttaagacttctgctgagagcacacaatctgtacaatgagctctgaataaagaaataaatctcaaagtgaagcaaaaggtgaagaagatggggcaaatcttgagttggttgtgaaagcttctgcacgtaactcccttttctccaactttcatgggctgagaaggccatacccagatacaaagaagatagcaagtgcaatcctaccatgtatcaagaagaaaattttttgaattttttgcacaatcctaatgatttgggggacttcaatccttaaatcagcttctctaataaacaccaggactttctgccatctctgtcaagttctatgccctcaccttgctttattttcttcagactacttataaatatatgaaatcatattgtttgcttggagatatagaattggac

SEQ ID NO: 851 - DNA, 5951 bp, Homo sapiens
gactgacactgcccgatcgcctcggaagccccctagaccatcacggacgccgagcttcgggtaactctcacagtggaaggtaagcccgtccccttcttaatcaatacggaggctatccactccacattaccttcttttcaagggcctgtttcccttgcctccataactgttgtgggtattgacggccaggcttctaaacctcttaaaactccccaactctggtgccaacttagacaatactcttttaagcactcctttttaattatccccaccggcccagttcccttattaggctgagacactttaactaaattatctgcttccctgactattcctggactacagctatatcttattgccgcccttcttcccaatccaaagccgcctttgcgtcctcctcttgtatccccccaccttaacccacaagtataagatacctctactccctccttggcgaccgatcatgcaccccttaccatctcattaaaacctaatcacccttaccccactcaatgccaatatcccatcctgcagcacgctttaaaaagattaaagcctgttatcactcgcctgctacagcatggccttttaaagcctataaactctccttacaattcccccattttacctgtcctaaaaccagacaagccttacaagttagttcaggatctgcgccttatcaaccaaatcgttttgcctatccaccccgtggtgccaaacacatatactctcctatcctcaatacctgcctctacaacccattattctgttctagatctcaaacatgctttctttactattcctttgcacccttattcccagcctctcttcgctttcacttggactgaccctgacacccatcaagctcagcaaattacctaggctgtactgccgcaaagcttcacaggcagcccccattacttcaatcaagcccaaatttcttcctcatctgttacctatctcagcataattctcataaaaacacacgtgctctccctgccaatcgtgtccagctgatctctcaaacccaagcaccttctacaaaacaacaactcctttccttcctaggcatggttagcacggtcagaattcttacgcaagagccaggacaacaccctgtagcctttctgtccaaacaacttgaccttactgttttagcctagccctcatgtctgcgtgcagcagctgccgctgctttaatacttttagaggccctcaaaatcacaaactgtgctcaactcactctctacagttctcataacttccaaaatctattttcttcctcatacctgacgcatatactttctgcttcccggctccttcagctatactcactctttgttgagtctcccacaattaccattgttcctggcccagacttcaatccggcctcccacattattcctgataccacacctgacccccatgactgtatctctctgatccacctgacattcaccctatttccccaaatttccttctttcctgttcctcaaccctgatcacacttgatttattgatggcggttccaccaggcctaatcgccacacaccagcaaaggcaggttatgctatagtacaagccactagcccacttcttagaacctctcatttcctttccatcgtggaaatctatcctcaaggaaataacttctcagtgttccatctgctattctactactcctcagggattattcaggctccctcccttccctacacatcaagctcgaggatttgccccacccaggactggcaaattagctttactcaacatgccctgagtcagataactaaaatgcctcttagtctaggtagacactttcactggatagatacaggcctttcttacagggtctgagaaggccaccgcagtcatttcttcccttctgtcagacataattcctcagtttagccttcccacctcaatacagtctgataacagatgagcctttattagtcaaatcagccaagcagtttttcaggctcttagtattcagtgaaacctttatatcccttaaggtcctccgtcttcaagaaaagtcaaatggactaaaggtcttttaaaaacacacctcaccaagctcagccaccaacttaaaaaggaatggacaatacttttaccactttcccttctcagaattcaggcctgtccttagaatgctacagggtacagcccatttaagctcctgtatagacactcctttttattaggccccagtctcattccagacaccagaccaacttagactgtgccccaaaaaacttgtcatccctactatctcctgtctagtcatactcctgttcaccgttctcaactactcatacatgccctgctcttgtttacactgccagtttacactgtttttccaagccatcacagctgatatctcctggtgctatccccaaactgccactcttaactcttgaagtaaataaataatctttgctggcaggactatgctgaatctccttaggcactctctaatcagatatccagagtcatcccaattcttagccaaaaccgtatccaggccatcaccagtcattctatacgacaaatgtttcttctaacatccccacaatatcaccccttaccacaagaccttccttcagcttaatctctcccactctaggttcccacgccgcccctaatcccgcttgaagcagccctgagaaacatcgcccattctctctccataccaccccacaaaaatttttgccgccccaacacttcaacactattttgttttatttttcttattaatataagaaggcaggaatgtcaggcctctgagcccaagccaagccatcgcatcccctgtgacttgcacgtatatgcccagatggcctgaagtaactgaagaatcacaaaagaagtgaatatgcccttccccaccttaactgataacattccaccacaaaagaagtgtaaatggtcggtccttgccttaagtgatgacattaccttgtgaaagtccttttcctggctcatcctggctcaaaaagcacccccactgagcaccttgcgactcccactcctgcccgccagagaacaaaccccctttgactgtaattttcctttacctacccaaatcctgtaaaacggccccaccccatctcccttcactgactctcttttcggactcagcccacctgcacccaggtgaaataaacagccatgttgctgtgtaatttatattaaaaaaagaggattaattgactcaaagttcagcatggcttgggaggcctcaggaaacttacaatcatggcataaggggaagcaaatatgtccttcttcacatggtggcagcaaggagaattgtagacagaagatggggaaagccctttataaaatcttcagatcttgtgagaactcactcactatcatgagaacagcatggaggtaactggccccatgattcaattacctcccactgggtccttcccaggaaatgtagggattatgagaattacaattcaagataagatctgggtggggatacagcaaaaccatatcacctactaactaaaaaggcccagatctagacagattcacagttgaattttaccagatgtacaaagaagagctggtaccttcccttctcaatgtatttcaaaaaattgaagagactcctccctaactcattgtataaggcaagtatcctgataccaaaacctggcagacacacacacacacacacacacacacaaaagaaaacttcaggccaatatccttgatgaacatcagtgaaaaattcctcaacaaattgcatctagtggcacatctcaaagcttatccaccacaaacaagtagacttcacctctgggatccaaggaaatgaagaatattccatggggaagacagtgaagaaatcagccaggatggatataaagacatcaaaatgactttgagatctataaaaaatagatgccaaaatttgtatattctaccgatatccaggtaacacagtccatttgtttgcacaatgtttattttttctttactccttgctaattcttcatttcatctaaagctacatgaacactttgacttttcctactctttaccaactaattcatatggcttcactttaaaacaaaaataagagaatttcatggattagatatttatggcattgctcttaattttgagtttcagtttttaaattacagaagaatgtcagagctagtgatttttggaaagaggtattgatacaattatacaggaattattctgctaacataagtagaataatctggtatgttcttttctctaaagatactctgattgatatgagaatgccatagagtattgacaaagagaaaaaaagtttctgccaaattttcaagctatttaaacatgagttctgtttcataattttgcctacaatctcttccaataaaaatgttattgtctcagaataaatgtttaatacctaaagtgttctttggtctcaaagtgtcaaaatgttaacaatgtgatttggtattactgacttttttctatcagcatagctgagaaccactgatataaaatttccatatattaaaaatatattttctctcataactttaaaaagtcttcatttttctgattaagcactgaaactttgacttttaattcttcttttttgaattctgattattcaagataggttattcacactttgggcaactcactacatttctgtggcatatcagaaaagtcctttttcttggtcagcttattttaggaatcctataaatatgtccaaactgcaatacaatgtgctcatgagtttgatatgtttatacatttggataaccttttggataaccattactacaatcatcatatagaagattaccatcatcccatctccaaagtgtttccttaatacctgcccaatccattccacctacactcatcataatgctaaacttcatttatcataatgatgctattcatctttaatagattttcaaataaatggattcatacattttgaactctcttgtgtatggagtccttcactcaagataatgttgttgaggtgcatccatgttattgcatgtcatcaatagttcatttctttttatttctgagcactatttcacttatgatcatactgttaatttgtttatccattcaacagttatatatatgttgtttccagtttggagttctttcaagtaaagctgctgtgaacattcatgttcaaatgtttgtatggacaaatgtttttattttttaaaatgtctaaattggagtggcagggtctcatggtaagtatatgtttagctttataagaaagtgcaaaactgctttccaaaatgtttgtatatttttacaatcccaccagcaatgtacaagagttccagttgctccacaatcttgacagaatctgggttttgccagtcatttattttagtaattctgtgtatacagactttcctctttaaaaaattatttgtataaatttaatggagtataatcataattttgttacatagatatattgagagtggtgaagtcagggcttttagtgtatccatcactggaataatgtacattgtacccagtaattaatttctcttcatccaccccctcctacccccacccttctgagtccctattttctgtcattccacactctacctctgtgtgtacacattatttatttccacttataagtgagaacatgtggtatttgtcattctgtgtctgagttgtttcacttaagatagtggcctccagagacttttctatcttatattaaattgcatcttctctgatgactggcattgaacatcttttgtgatgaatttgatctttctaatatctcattttgtaaactgtctgttaaaaatttttggtttttttttcctgagtttattgttttgttatgctttattttattatattttattgtgtgtttattgttttattatgttttattattgttttattat

SEQ ID NO: 852 - DNA, 1448 bp, Homo sapiens
cacattccctggaatctcaagagagactaagtctgaaatatattttatgtgagtttatcacccctaagctccttattagcatgaggtctcacagagtttctagatgagaaggtcattttaaaaattattcagcgttattgtatagttcttttaaaaaataaattgaaaagatatgatggaaaggaaatctggaggacatttgctctgaatcccagcagtcttgacttaagtgatgggcatacaggcttcaaacactgccagttggagcaggaggcagttaggaagacactgatttttgtcctggctctgcctgtaagatatgatctatgcatggcaaagaacttggataatttgtcagcagtgctcaggagttttgaaaggagctgactcatgagccatgttctgggacactgctgattctcagtgggcaagctgtactgtgtgtattttggagctccataacacagactcatgccttgaatggggggatgccgggagggctgggatgcttggagagaaaaagaaaagaaacagaatatggcaagacactctacatgctaaagcttacagatgctttgattacaggaaacttacgtaaatgataacagtgcgcagaactagacgtggaagaagggaaaaaatatgggatcccgacataggcctttgtactcataaaatcacgggtgagactgctgaaaacaactgttgggagttttatgatttaatcccattgactggatcactgaacagggcatttttcacttccagttttcgtgctttagctgacctacgaaatctcatggttttgtttggtgacacgtgcttttaggaaaacttgttatttctgctgttctgcactgccctgtctccactgaactgcctgatctcctgtggaatttacagtttcagcgcagccagcaaatgcagggaaagaatgtgtgcttcatagctggagtgctcctgataacagtccattctggtatcggtggctggaagagagagggactgccacccagtgtttttacagtgcctgtttcaggcagcttctaaattgacagcgaagggtggagtgggtagggggagaaacaagaaaaaaaaattccctgtctttggggtgggggagataattctaaaatctctgagaaacttaaatatggtaattccctattccaaacatacacaagtcacaagcaaccttattctttggtttctaggcacatttttgagtttagcacaatagggagaagaaaattggaggttagcgaatccagtagggcaagaggtgaagaggactaaatttcagtcaagacaacaaggaaagtacaaagaatacagtttctctttcatgtgctttgatcgtctttcctgttttacccttaatgaatactttctcaaaactaaaaataaaacactgcattctattaaattgtgctcttcctctaagggaa

SEQ ID NO: 853 - DNA, 8137 bp, Homo sapiens
ctcatttattcaaaaagatttcttcctgaaaacgttccattattaaaaaatctcaattatgcttataattaacccgttttttgaagctgtattccattcactccatcagatcttctgccctccactgctccctggtagacccacaggacaacgatctctatgaactgcatcaagtgtttcccttgccctgcagtttctagtggagtttggctaatggatatccctggcaggagatcagaggcttctagaaaagaagtctaggctatccacttggagaaagtggccatgtgaataaaaggaccccagcagcagcccagcaccatggttcctgacatacaatgaaacattcccataagaaacataaagcaggctggggacagtggctcacgcttgtaatcccagcacttgggaggccgaggcggcggatcacgagatcaagagatcaagaccatcctggccaacgtggtgaaaccacgtctctaataaaactacaaaaattagctgggcgtggtggcatgtgcctgtagtcccagctacttgggaggctgaggcaggagaatcgctcgaacctgggagacgtaggaggttaaagtgagccaagatcatgccactgcacaccagcctggccacagagcaagactctgtctcaaaaggaaagaaagaaaagaaaagaaaagaaaagaagaaaagaaaagaaaagaaaagaaaagaaaagaaaagaaaagaaaagaaaagggccaggcacggtggctcatgcctgtaatcccagcactttgagaggccgaggcaggtggatcacgaggtcacgagatcgagaccagcctgaccaacatggtgaaaccccatctctactaaaaatagaaaaattagctgggcatggtggcacgtgcctgtaatcccagctactcgggaggctgaggcaggagaattgcttgaccctgggaagtggaggtcacagtgaaccgagatcgcaccactgcaccactccagcctggtgacagagcaagagtccatctcaaaaaaaaaaaaaaacaaacaaacaaaataaaaaaaaggaaagaaaagaaaaacatgaagcaaggcttaaagatgaagagctaccaaggaagtggtaaagaagtatttacattgggtggtcagagaaggcttcctgaagagataacattcaagcagaaaaggaagttagataactaaatgggtaacagagatgagtcacaaacatcagaaaaaaatatacatatatatatctacaaatgttttcgtgatatgttataagcaatatattcaaatcaaattcaccatccttcctatattggcatccacatagaatgcccatcctgtcatctccttttctctgcattactatttatctttacaaatcaatttagctgtcatcttctccaggaagacctacctgacttttctaatctgggtagtgctctcttctatgtcatcatagctccctgtattttcttatatgacagtttgtaatatacattaaccttagagctcttttagagtaaagaaattctaactttgatataccctgcaatatgtacattgcaggtaaaatggcaatgtttttctgcctctacttacactgaattcactattctttcttttgttttattttatttcctaatggttcctagtgtaagcacgtcaccaaaatttagattaaatcaagaaaaaagtttttgaccaatggctgcttaatctgtcactgaaaagtagcaacaaaaccaagcttttatcaaccagaaaacatattgtgcttcctttgggaaagtaaacaagacagtagacatagaagcctcacacaaagggggaaaataaactgaaggattttaagagtaacacctgtcaaatggagcagtaatgtgtatggtttgacaaaataggctggtgactgtcaaagtaaataataaatcttccagctctgactaatgactgaactatgctggaagacttgagggaagcatccaataaaatgcaaaattgaaagaaaaattggaacggtcggcacagcctcctagcagctaaatttcaagtaattttggaaaaacacaaaccattcaccaggttccatggcagagggaaaagttccaaaaactgttctgattgagcattctgctttagttaggaaatcacatctcttctgatggagtgccaagaagttggtttctgctttttcaatacagaaaaaatcctgccgtgactgtgacattctctgtgcagacattcagctgactgccaataatatcattagggaagaacagctagagctggacccctttgtacgtagagtgaagcaaactgcagaaaaggcatagatccagggaaagcccatctctgatacctttctattttcatttcttcccaattcaggtacctaatttcctttagtcacagcttcttagaagactatcttattttttcttaccagcaagcaaagattttctaacattattataaagaaaactggccaagtgtctgctgattatgttatgatccttccaggggcagtttcatttatataaattgtttcttgaggacccaaaaagccttgataaatttctgttctagaatttaataatatatcacaagtggaagaatgcatcactagtgaaagaattttaagcacctcaaaaacacagttctataaaagtcatcttttttcagaaactttccacttatctctcaagttcaaagtagcagaggtgagtactggttttccctctgtctgactcctttaattttgtctttgtttccagagtaaactatgctctagattccctatatcataatgaaagagagaggaggaaaaacaaagtatccttttttaaggggggaccatctctaggtattatttagcctgcaatagcatggcttgctttcttatttaattatttttatttatgttcttccactatttatttctccttcatgtcttttatgcattagattgtattgaacctagttccaaatatgtttttttcataaaatttggttactgttataagtaagcaaagttgagatgagaaataaactaaatattaaatctaaaaacatacgtttaatatttgtttttttctaacttaaatatatttgctaaaatctgtaatttaaaaacctcctaaccattttatttattttaggcactgtcttgaagaattatactggtctaaaaactgcattttattaatatattattttcatagccatacttatgaaagcaaaacatcaagacattttctgattacagaatgaatatttgaattcaagatcatgccagatttatggctagcaaatcgctgtcaatgtgtatcccaagtgcagtgagaggttggctccctcaaatacccatgactcagaaatgacaggaatcaggatgcctttgcttctttcccagtgatttcaacattctaggatgatttgattcaacaaccctttggttgatccattctactctgataggtggttatccaacccagtcaccaccatgtccaaggaatcctgtacttcttgcagcaattattctgcttggcaggactctcttctctgaagctttctctgctcatttttcttgctgcctctgcagggtcagtaatgtgtctgccagtaaagtgttgtctctttccatttcctattcccataaccacaaggaatagaagcagttccttcgttgaggaaagagtatttgtccattaataaccacgctagtctagcattcaaatccctcgttgacacttaggtcatttttaccttggactactacaaccacatactgtgctgtctccaaggctttattcttctctccagtttaaaatgatatgcactctacagttcaaatcattttctagatgcatttaagttatgcccatgggaagaaagagcctgagcttggcaatattgcatacaggaagtgtggtgtggaatgcaaagaattgtctaaaagaagcatttaaatacactatatgatgacagagactcagcttaatagttttttgcactccaggaatcaagaaattccaataaactattacaattttaatggctacctttgacaaattatgagaatttgatctgcctggatcccaccttattacaaagttattaaaaatattttgtgtaatttgcaaagtaaaaagtcactgaatagtactgtcatgttgttatttactaacttctactctgatgcagtcaaatcagcaaagaaattgtaggaagctccttgaacaataggtacatggtttgccaaatatgctcataagaagaaaaagcaaaacttagaggaatgtgagactgaaatagaaaaaacaaacaaacaattgtctgctatcctgggaaactctgtttaatttcctggcatctgagccatttttgtaacctatgttttggaattactatagccctgtatgaaagagttaattcattaccaaaaggtgagccatttcctgtctactcaattgtagaatcagactaagtactattttatcaaaggagcattggctgtcacccagcgttaatcattttcagaacaattatgatttactttagacataaggctgatggatttttatttccagattccattttggcaactttaagccttacctcatatgtaagactattactaaaaacagtgcctctccaaattttcatccttcattatttctgtttctccctaaaaaaaaaaaaaaaattaaaattaaaattaaaaaaatacaattaattacattcgttagttagccaatgtgattgccaatgctagcttaaacattgtttgtatataattttacatagatgtggagccaatagagatctgaatgattgtgtgcttttacacatcttttagctaaattaaaaatccaaaagctaaatcttgtgttctgggacagcatgtgaatttgatatttcctggcggctattggaaccataaaccattgaatagactatattcattcatttaagtggtttgtgactgtgaaagactaaatatttacaatgtcttttatccttggatacaatgtaatgatttcatcattttaatagccttttactcaaatgtggttgcatcctggttagattttagacatgcatttcaaatagtttgggtctctgtaatcatttcaatgactcccaagattgaaaaacaatatatagcaagagttcaagtctttgaacttattactttagttttgatttatgtcttccctccagaattttgccctgtttaccaaactttgctctaaatgttcagataagagatatttgtgctgagttggtcagtggaaggtcactaacagatcccaggcatatatttataagtgcaagtgcatgtacacaaatagggatttggcaacttaatgtgaatgaaccaagacaaaaccatagcagtcactatagaaacaattaaaacaatatgcccccactgaaagctatggaaatagctttgtggtacatatgaaaacacagtattatcccattaaagcaaatatctaggttttttttcccttttagacagtcctaacaaatgccagaatctctttgtctcatttcagaacgaaaaattgatttgtgtcttctttcctacctcacgtagggtgaaaattaaatctggtttattttcaacataaaaatgtagaaacaacattggttcattttacatttggttctaataatcacaaatatttatttctatgaatattcagtcttctgaatagcaggaaaataaaaatactgactaacatatacattgtcaaaatataatttgtgattacttcccctaaggtgcagaatggatatgatcacttagaacttttgtaccaagaatttttaaatgctcagctcagagtagttgataccaatgattattttatgaaccattatcctaaaatacctatctaaaacgtacaataacttggttggatcttctgtcaaaccataatttatgtcacaatgaggttagatgccaaatgaaataaataaaggctaaggaattttttggcttgtaatatactgatacttaatgaatgttcaaagaaaatcatgttcaaaggggtgtctttttttctaccctacaaggagaaaaatatatatactttggttctttacctgttgatggttctttacctgatagggtgacttaacccttcattcctgaaaggtctgggccatttgcagttctgccagaattggattgtcatagttttccattgactttaattatagggtatgttaatactaggagacacactaaggaatcttctggatttcagacatactcttccttacctttattgaggaggattagttcaatttccccttcgtcatcaggattaataatcccagccaacaccacatctttcttcttgcctgttgactcaaaggcatgaggaacccaaaatggccaggtggcagtcttaacatccaacacaatgaaatcattgttgtgtctcctggtagaagcatttgtttctgtggaactaagacctctaggctgacagaaattaaagctgcagaaacaggaaccaaaaattttgctagtgggtcaccaaaggtaattgtaagtgatgccactcccatttccactctttgactcctagacctatatatcctggctatcagagaaagagtaccacataatgacactgattcagagccttctggagaatcttgctccagccctgaaaggtattattacctagctggtgctgtaattcagtcttcaaaagaacattccatcattctatcaagccagctgcttcagattggtggggaacatggtgaaatcagtgaaatccatgagcatgagcccattcttgcacttcttttgttttgaagtgagtttcttgctcagaagcaatactgtatgaaatacaataacgggaaatcaaaaaaaaatggctaggaggttattgtaattatccagaccaaaatgattcacaacttatgttaatttgattgtcctgaaaaagatgaagagggaatgagtttgagatagagatgtggtaagattaataagatcttcccatgtagagatggggagtataggtaaagtaaatagtatgttggtgtgatgagtatatgtaatatataaaatgtgtataattctctaagcatgtgcttaaatctctatgagtatgagaagtatccactactctcgtgtgcttctctgtgatgtttgtcaataactactttattccctatttaacatttttccccacagcagataaaggatttttaaaatgtgtaaagcagatgcaagctggaaatccctttctgttagtaatttctgagattggatatggatgattaaaaaaaaaaaccactgtgcctaccccttcttatcatgctttcatttggacagcactctgtcaagtcataggattttggccgcgatctttcttaccatgtttggtgggtggcaattaatcacatggtgtgcatcacccttttcacccagtacactaatatactgtgctcaaggatgcaaatgttcatggtaaaaacttatctgtttgcatccccatgttgaacgcatcccgcatgttgaatgaatggccttaaaattcctgcatcgttgttgtctatcttctgttgtaatagagatacaggcaggaatttagcctaattaattcccatttataacactcagcactgccccctaaaaatatagacatttaataaatgttttggtgataaaggaataacttatctttccttggatgcatccctttcaactgaaccaagaaaagcatacattgtactggtttagggaggataaatgtaattccatgacaattaaaaatgataggaggagtagaaacccatccatctatctaatgactaaacttcgctggtgaagatttgataattctagtgaatgttttagtggaggagacttttattttaatatattaaaaaattgaggaaagtctaactttgttaactcagtagcttcaagccatttgaagcaaccacagtgaactgaagaaaagggtctgatctatattttcacttcagaacaaaagaaaacgatgtttatcctatttaaattagttcaaattttgttcctattatttccaatataatatataaattataaaatctaagtcatatatacatacccata

SEQ ID NO: 854 - DNA, 6761 bp, Homo sapiens
gttaggaaaaaaattctgcaaatttgcaatttggttctcattacccagcctcagaacaaggtaaaaactatttctttttaataagtaggcaaaatattttattttcgattttgaaaaaagtattgcattgacaatattttcaaaataaaagcaccacttagggaatatacctctgttgacctactgtttcttttactgaaaaaaaaagattcattaggaaaggttaaaaaaaaataataataatcataagttataaaagttgctattagtggtaagaaaatctagaaaatgccaaaaaaaatactgaattagtcccatcagagtaacaggttacttcttgccatttttctaggcatgtatataacaagagctaaaattgtattacaattgcttaatacagttcatcttccacttcatatgaacattttccactgtatctgacatattttggctattctattatttgtactgaaggagggccattataattaacctcattatacacccttctatataaattagattctctttgcattgtttaactaccccttcacttctcacttgctctcttcggcagacggtacacatgcccggaaaagaaaccgcctaaaggtttgttcttcaactagtgtcagtcaactgatgcattttctgcagataagcccttgctgctttccccctttacagcaccaaagagagctatagcacaaaagactcatggcaattcacaggaggacccagggtggagaaagctgcagagaactacatcaagagtgaacccagttctcaagaaatgaacaacagttctgaataaattgttcccccactccctgcaccccattttcttttcataaccaaccttctgaaaattacttttctccaaacacctctggtttcagcaaccttcaacatcctacttagtcaatgtcttctaatgagtgttaaatatttacgaccacatcaccatataatcatcagctcaaaataagttttgtatcatttgcagacttccatggcatgactatttccatggtaaccagtttcaagttaccaacatggtatcactgaacatgggctgggaagagctactacacaataactggctagcaaaagctggtccaagccagctccacacaccactgcgtaagtgtttcaagatgagttgtccttgttacagcatttgactacttcttcctttgaaaaactacgcccacaaccacatactgttagtttcttgcacatacttctctgggcttttttactaccctacccccatccctatttcctcccgtcttcttcctagcccttagacattactgtttcctagagtctggtcttcaagccccatcccttctttctatatgctcctccagtgcctctactactgcctatgcctatttatatttttagccaagagctcttgcctgacttgcagtttcctgaatactgaacagatcccacttaaatggattctaggtatcttaaactaaaatcccaaatgacaggcccaaccatcaatagactgctcttcctctttcttgcttactttggtgaaaattcctccccttctccctatcactctacctctcctcctctcagtcatgaagtcctaccccttctacttcctaaacttatttgcaaacatctgcagcccacctctatctgttctctagaattattgtaacaggctatctaatctcctgagttccttctggcatcgttccaatctactctccacaatgccagaataagttgttttattaaaatgcaagtctgatcatatgacctataaactttaaaatctttcaggataacatctaagtctaccagcaaggcatacaaaggtgtttcccaattctgctcacctggtgagcaactggtgatggaccagcttaactccttctcaccttgtacaggatgggacactctttgaactcaccgtactacttcacatctcctccgcatgtgctgacccgctgctccacttcagaggctctctccaagttttccagtgcagtttcactaccaagctatcaccacatctgcatcccacccaatacacattccttcttacaaatttcccaatacgctgtgctcactgagatctttcattgttcctacagtagacaaaatgctggcttaaccctaccatttaccctagtacttgtcttggaatagacgcatttaatattggtaaaatgttaagtatttaatatttactcttcctctcaagttagtaaattttaaggagttcttatccatgctgttgagggcacggtaaaaactttccaggttgatgggaatgaaaataataaatctttctggagagccttaaaataatcataccctctgacctagaaattctgtttgactcaaacctatcagagataaatacaaatgcaattccatgtaagatgttcactgcatggagaatgagagacggcctaattctctaatcaagagcaggatgggtaaagtgtataccataatgcttacattaagagagaaaatacaggctgggctcggtggctcacacctgtaatcccggctctttgggagtctgaggtaggcggatcactttaagtcaggatttcaagaccagcctggccaatgtggtgaaaccgtgactctactaaaaaaacaaaaattagttgggcatgatggcaggtgcctgtaatcccagcgactcaggaggctgaggcaggagaatcgcttgaacttgggaggggaaggttgcagtgaaccgagatcgtaccactgcactccagcctgagcggcagagcaagacttcgcttccaaaaaaaaaaaaagaaaagaaaaaaagaaatacaaaggtgcatgaacgttatcgtacaatttcataaaaagtgtatttatttagatacacataaaaaagactagaagaaattaatcactgaaaacattttggttgctctggatgatgagaattataatttgctttaggcttctatatttcccaagatttccactaaatctataaaaagtactttatagactcaatgtacacagcctcagcaaatctgctcacattcaccgactataaaacactggagctatgtgtcactgtcacaaaaggtagagattaacgttaattgctgtggtccaagacttttaagtttttactcatctttaaaattatactaacaacttttacataattatttaaaactaatccatcaagaaagcttaaaaatactgaaggaaaaggaagaaaacagtcatcttgaattacctgtagaattggctgttggcactggagtggccgtggaaactattaaaaaaagaaaaaagaaaaaccatatacatcaaagctatttaaaatatcacaatctataacgctagttcctgacctgcaatcatttgagtacttttcacaatttttacaacacttaaatactacctgtggaagagactgacagttgcccccaaataccagtctcttctttagaaatagaatcaccaatttttatcaacacctcccttcctcctgaaaagacatttcctagtctccagtgcttccaggccatcacgcataacctctaggaagcatccttaaagtaagatacaagcctctttcattcccttcttcatcctgctggcaggaaaataatcaatgtgatggctggaacataaggacccaccttggacagtagggtcaaagccatttttgagaggtgaaagagtaaaaacctaaagaagcctcagtccctaatggttgcagagctgaactctagtccagacttcctttacatgagagaaaagtaaatcagtccactgcttaagccattgtaatttgggggtttatgtccttcatagctgaaactaattctaactggtacatcatcaaatatgcagcagtacaaatacagttttcctttaaatcagttttcaaaaacgttctaatactaatgaaatcttcattaatcttgtctctaagcaatattacaaaaccacaggtctgacagttattagtttatctaacacatattaaagtaattacttaaaatgtttcagccaggtccagtagctcaagcatgtaattccagcactctgggaagccaaagtgggaagactgcttaagcccaggagttcaagaccagcctgggcaacatagtgagacaccatctctacaaaaaaatttttaaattagccagctatggtggcatgcacctgtaatcccagcttctggggaggctgaggcagaaggattgcttaagcccaggaatatgaggtggcaatgagttatgattgtgccactgcactccagcctgggcaacaaagagactgtctcaaaaaaagtttgttcgtgtaccacctaactatattatgcaccctgtgtgaagtaaaactgatctaatactaatgaaatgttcagttacaaaattcacattgggatggggcaacccctaccaaaattaaagagtcaaaggtagtctttcaaggttagacacactgcacaaaaatctttttcctattcaattattatctatgcatcaaattaggaatatgcctttcccactgatttacaatctcattggaaaaatcagcagcttcaagtagaattttaacgttttgctggacgaatagtaaaggttaaaaattaatcaagttactcagattaaaatacagaaaatggatgggtatagaaaagctcatttaaccacagcaccaactatgctgcagaataaatttatcaatcaacaatccccagtatcgcaacaccaaaagtgccagaatgaggtttcccagacctgcaagatgcaaacatagcggctaaactgtgatgaattcctagaaaagtttaaaaaaaaaaaaaaaagtgtgggggcagacaacgcatccacacttacagcatccacactatagctaaatcactaaaccaagcttcaaatatcatcctttaatcaatcaatatgaatatactattcatattccaattctaacaagatgagaattatggcaatgcttcaaacaaagcactgaaacaaggctttctgaggcaatgatcttcctcacctctctgcggtcagcttccaagcagccaatatgaatacttaccggaacagaagtctgtcgtgttccccacttgacaatcactaactgttgagttatgtgaacaatagctctcatctgttggggggcaggggaaaagagacaaacagcatcaaccacccatttgtattatctttgactctgctactaagctctatgaaatcaaacccaaacactttagaagtgggcagggggaaccactttaggtgttttgacctaaagttaaacccacagaccaaaccctgtcattctccttttcccactgacttagagattacgcaggatccttctaacttttatccattaaaaatccacattaatatactgaaaaaataaatctgcaacacttagatctcagaattgtgggaagactactgtacaatcaagaaaggcagccatcatctaaaaagtgggcaggtggctcacgcctataatctcagcactttgggaggccagggtgggaagatcacctgaggtcaggagttcgagatcagcctgaccaatatggtgagaccctgcctctaccaaaaatacagaactctgtctcagggaaaaaaaaaaaggcggagacagtaagttgaagtggtcagggtctgtattaagaggttagtaaacagatgaggcaccccataacactgtagaaactctattccaaatctcactgctttagtcttctatactttctaaaacaactttcctggataggtagacttggaacaagagtaaggggagaacctttcccaacaaatcttaaagtagagcattccatctccaaaattcaccaactcttacatactcccatataaaggggaaagagtacgcccttaaatcccattttatgacctaaaaaaaagagacacttctataacaaaaaagttaatttggcccaatttagttaataccttaaagagctttttgaaatttatgtagtgatataatttctagaactattaaaatttttaccaaataaaaaaacttatggtttgtttttacttaaaaaaaaaaccgccaaaacaactagattgttttactgataagtgcaaccactttacattaaaaaacaattaaaataatgtatgcagtaatatggttctaataagaatcttattgaatttcaatgtacgtccctttagcgctctacctcttgtattaacaaaagcacaggaagtcaactctccctacctctttcttctctacacctaagcatccaacagtttcataaggtctctttatatttcatgttgcaggacacagttttcaacacaaccttcactcacagctaattccagtgtattaaagtactctcaatccttagaacaggctttaaaaaaagccaggtgaggaagcacgcatctgtagtcttggctactagggaggccaaggttggaggattgcttgagcctaggatttcaagaccaacctgggtaacacaggagactccatctcataaaaaacaaacgactgagctttaattatcaagtcttaaggaatctaaagggaggatgggagacaaaaagagattttcagggggagtgcgaggcaactggcactttaaaggagtactggatttgcaaaataaatagtgcacaatatcctaaatgtcctacataactttcaagtgttcaagaattactgtattttaaaatgctataacaaaacagttttgcatccccaaagtttcttacctt

SEQ ID NO: 855 - DNA, 8975 bp, Homo sapiens
gtgaaatcttcagtgttgtgggcccttaaaagggatagaaattgtgcactcgaggagctcggattttaaggcagtagcttgccgatgctcccagctgaataaagcccttccttctacaacctggtgtctgagaggttttgtctgcagctcatcctgctacattttttggttccctgactgggaaacgaggtgactgatggatggctgaggcagccccttaggcggcttaagcctgccctgtggagcatccctgcgggggactccggccagcctgagtgccgcgatccaaagagggctcccgggtaggaaatttccacagtggaacgcctcaccagagcagcccgtagcaggcccccatggaggattaacacagtggctgaacaccaggaaggaactggcatttggagtctggatatctgaaacttgatgcaattggagccccgcaaggaataccagatcaatttaaaacttgaaatcaaatagttacaggatttaagtcaatattttggtagatgacagtcaataaaaatgtagattagataaactacatctattacacccaacagcaatgaacttttcatgagttaaaaaaaaaaaaactcatgtcggccccagccctgaggctacctgacctgacaaaactctttgcactctatgtgtcaaagagaaaaaatggcagttggagttttaacccagactgtagggccctggccaaggcctatctctcaaaacaactagatgaggtttccaaaggctggcccccatgtccaagggccctggtagcaatggccctgttagcacaaaaagcagataagctaactcttagacaaaacctaaacataaagtccccccatgctgtggtgattttaataaataccaaaggacaccattagctaatgaatgctagactaactagatagcaaagcttgctctgtgaaaatccccgcataaccattgaagtttgcaacaccctaaaccccgccaccttactcctggtatcagagagcccagttaaacataactgtgtagaagtattggactcagtttattctagcaggcccaaccaccgagaccacccctaaacatcagtagactgggagttgcacgtagataggagcagctttgccaacccctgcaaagtgactctgaagaagacgacaagccccgccccagtcacacctggaagctgactggtccacgcacggccgaaacatgaggaaattcatcgcgggacccaatttccttaaaatttggacttgaacagtaaggacttccactgaccttcctcagactgataactgtttccagtatatacatcaagtcactgaggtaggacaaaagattgctacagtcctattattttatggttattataagtgtaccgggactctaaaagaaacttgtttgtataatgctattctatccaaggtatgcagcccagggaataaccaacctgatgcgtattatgacccattttaagcctcccatgttcacagtttttaaaataaaattaaggactggtccttttctaggtgacacaagtaaggtaatagctagaacagaagaaagaaaggtccccaaaaatgtaaccttaaaatttgacgcctgtgccgctattaatagtaaacagcatgggataggatgcggttctctagattgaaaaaaaagttacacagcagaaaataagtacatctgtcaaaaatcatatttatgtgagatgtgtcaatactagtcttgtgtcatttaggctacttagaaagaagataaaaaatatcctgtttggctccaaaaaaaagaaaagtcagcccctcctgcacgagtaggagctgcaaccctttagaattgataatcacaaacccctcagacccaaagtaaaataaaaaaaagatatgtaacattaggcattgatggaaaaggactagatcctagtataagcatcctaataaaaggagaggttcaaagacgctctccagaaccagtatttcagactttctatgataaactaaatgtgccagtacctgagattccaggaaaaactaaaaatttgtttttgcaattagccgaacacgtagcccagtctctacaagtcacctcatgttatgtttgcggaggaaccgtaacaggagatcaatggccataggaagcccgagaattagttcccacagacccagttcctgatgaattcccagcccaaaagaaccaccctgacaatttttaggttctaaaagtctcaattattagacagtattgcacagctattgaaggaaaacaattcactcattctatagggcggcttagttgtcttgggcaaaagctgtataatggtaccacaaaaacagttacatggtggagttccaattacacagaaagaaatccattcagtaaatttccaaagttgcagactgtttaggcccacccagaattccaccaggactggacagcccccaccaggttatactggatatgtggacacagagcttattctaagctgtctgatcagtggacagggagctgtgtaattggcaccattaagccatctttcttcttactgcccataaaaacaggtgaacttctaggcttcccagtctatgcttcccatgaaaaacgaagcatagccataggtgattagaaaaataatgaatggccccctgaaagaatcatacaatactaccgacccaccacttaggcacaagatggctcatgaggatttcgaacccccatctacatgctcaaccgaatcatatggttgcaagctgttttagaaattattactaataaaaccggtcaagccttgactgttcttgcccagcaagaaactctgatgagaaatgctatctatcaaaatagactagctcttgactacttagtagcagctgaaagaaaagtctgtagaaaatttaaccttactaattgttgtctacacatagatgatcaggggcaagtagttgaggacatagttaaagatataacaaaactggcacatgtacccgtgcaagtgtagcacggattcaaccctgaagctatgtttaaaaggtagttcccagcactaggaaaatttaaaactcttataaataggagttataataatactaaaaccctgcttactgctcccttgtttgctacctgtacttcttcaaatgataagaagcttcatcgctaccttagttcaccaaaatgcttcagcacaagtgtactatatgaatcactatcaatctattgcacaaaaagacataagtaacaaaaataagagtgagaactcccactaataaaaagtgagagtctcaaaaggggggaatgaggaaagagagaggccctctcatattgttttatattgttttatactcagttcctgtttttaaagaaaaaaaaggaaataaaatcaaagacaggcagcccagcgccaggcccaaaaccggacctgggcctgcctggcctaaacctagtagttaaaaatcaactcatgacttagaaaccgacgttattcatagattccagacattgtatagaagaacattgtgaaactccctgccctgttctgtttctctctgaccaccggtgcatgcagcccctgtcacataccccttgcttgctcaaatcaatcacgaccctttcatgtgaaatcttcagtgccatgagcccttaaaagggacagaaattgtgcactcgaggagctcggattttaaggcagtagcttgccgatgctcccagctgaataaagcccttccttctacaacttggtgtctcagaggttttgtctgcagcttgtcctgctacagaagaaatttctaagcagcaatgcattcaagagatgacttgggtgctgttaaaagcattcagttttaaatgggaaacacagcacaaaagtttggaaaatttgcagactgatggtgcaagagaaaagaaaaaaaacattttctgaggagaaattcaagctggctgcagacatttgcataagtaacgaggagccaaatgttaatccccaacacaatggggaaaatgtctccagggcatgtcagacctttgcgacaacccctctcaacacaggcctggaagtctaggaagaaaaaatggtttcatgggccaggcccagggccctcctgctgtgtgcagtctagggacttggtgccctgcttctcagccactctagccatggctaaaaggggtcaaggtacagctccagccatggcttcagagggtgaaaaccccaagccttgacaacttccacatggtattgagtctgcgggtaaacagaagtcagaattgagctttaggaacctctgcctagatttcagagggtatgtggaaatgcctggatgcccaggtggaagtttgctgcgggggcggggccctcatgaagaacctctgctagggcagtgtggaagggaaatgtggggtgggagcccccacacagagtccctactggggcactgcctagtggagctgtgagaagagggccaccatcctccagccccagaacggtagatccaccgacagcttgcaccacgcacctggaaaagccacactcaacgccagcctgtgaaagcagccacgagggaggctataccttgcaaagtcacagaggtggagctgccccaggtcatgggagcccacctcttgcagcagagtgacctggatgtgagacatggagtcaaaggagatcactttggagctttaagatttgactgccctgctggatttcagacttgcatggggtcttttgcccctttgttttggccaatttctcccaattggaatggctgtatttacccaatgcctgaacccccatggtatctaggaagtaactaacttgctttttattttacaggttcataggcagaagagacttgccttgtctcagatgagactttggactgtggacttctgagttaatgctgaaatgagttaagactttggggggctgttgggaagccatgattggtttcaaaatgtgaggacatgagatttgggagggttcaggggtggaatgacatggtttggctgtgtccccacccaaatttcatcttgaattgtagctcccacaattcccacatcatgggagggacccagtgggaggtaattgaaattatggggttggatctttctcgtgatgttctcatggtagtaaataaggggtttcccctttcacttggctctcatacaccaagactcagaaagtataaaggtgggtagggaggttttatgggaacatggggaaacaactgaatcatgctccaagttagaactgtttaaccagattatcactacagttgttttaaacaagataaaaataaggctgtggccactaagtgcaggctttcagctgctgggacctgcagggaagggaagtcaggagaaggatctcaatttctgcctgacatgcaattttccactctaaaacagaaacatctataatcatctcaattaggaaattattattcaagtaaaacatttactaagacatgcagtgagtaacagctctttggtagactggattttaccaaagatgttagatatcactagagaacttatatatcattttcaaaatgtctatgtgaagtacaaatactattcctattttaggaacccaatacaaccatcacataaattttggagcactcatattctaaactctggacagattcttgactaatttctgaagtagagatgccaaactcatttttaaacatgactgaaactggcataaaaacagatacatagaccaatggaacaggatagagaacctagaaataaatctagacatttacagccaactcattttcaacaaaggtgccaggaatattcaatggtgaaaggacaatctccgaaaaaaacagtgctgggaaaactggggatctatatgcagaatagtgaaactagacccccacctctcactctatacaaaaatcaaggcaaaatggatgtaatactaaaatataagacctaaaactatgaaactactagaagaaaacatgggtaaacacttcaagacattggtctgggcaaagactttttgagggtaagtcctcaaaaacacaggtgacaaaagcaaaaattgataaatggaattacatcaagctaaaaagcttctgcacagcaaaggaagcaatcaacaaagaaacaacccacagaatgggagaaaatacttgcaaactacccatctggccaggcacgatggctcacgcctgtaatcccaacactttgggaggccgaggtgggcagatcacttgaggtcaggagtttgagaccaggctggccaacatggtaaaaccccgtctctactaaaaatacaaaaattagccgggcgtggtggcacatgtctatagtcccagccactagggaagctgaggcaggagaatcgcttgaacctgggaggcagaggttgcagtgagctgaaatcgtgccactgcacaccaacctgggtgacactgagaccccgtctcaaaagcaaacaaaagcaaacaaaaaaaacatacccatctcacaagggattaacaatcagaatacatttggaattcaacaattcaatagcaaaaacacacaacaacaaaccaagtaatctgatttttacgtaagcaaaagatctgaatagatcttttttttttttgagatggagtttcactcttgttacccaggctggagtgcaatggcgtgatctaggctcactgcaacctctgcctcccgggttcaagcacttctcctgcctcagcctccctagtagctgggattacaggcgaccaccaccacacccagctgattttttttatttttagtagagatggggtttcactacgttggccaggctggtctcaaatctctgaccttaggcgatacacccgcctcagcctcccaaaatgcctggattacaggcgcgagccaccacggccggctgaataaacatttgtcaaaagaagacatactagtggccaacatgtaaatgaaaaatgttctggataaacagaaactgattataaaacaaaaaacaaaaaaaaaaaaagaaaaaagaaaatgcctgacatcactcatcatcggtaaaatgcaatcaaaaccacgagatatcacctcacccccattagaatggctataatcaaaagaacagaaaataaagagatgctggccaggatgtggagaaagtggaatgctcctacactgttggagaaatgtaaattagtacagccaccacataaaacagtatggagattcctcaaaaaactaaaaatagaactaccatatgatacagcaattccactgctgggtgtatatccaaaggaaaggagattggtgtatcagagagacagctgcactcccatgtttattgcagcaattcacaatgaccacatatggaatcaacctaagtgttcttcaacggatgaatggataaagaaagtgtggtatatacactatgaaatattattcagccataataaaatgaaatcctatcatctgcagcaacacggatgaaactgaaggacactatgttaagggagttatttcacttaacagaaagacaaatattccatgttctcacttagatgtgggagctaaaaaattaatctcatggaggtagtgagtagaataataattaccagaggctgggaagggtaggggacagagcagagggcagcaggttggttagcaaatacaaaaatacagttagacagaaggaataagttctagtgtttgatagcacagtagagtgactacagttaacactagtttattgtatatttcaaaatagctacaggagaagatgtgaaatgttcccaacacaaagaaatgataaacatttgaggtgatggatatcccaactaccctgatttgctcattacacactgtatgcatgtatcgaattatcacagggaacccataattatgcatagctattatgtatcaattcaaaaatcagtgaaacaactgaaacatgaatcttaaaccaacatcactattgttatcaatattttattcaaacaagtttttatatggtacaaagctatgtaaacagtgagtagtctattttttttgtttgagatggagtctcactcatgcagtggtgtgatcatggctcactgcagtgttgaactcctcggctcaaggtatcctcccgccttggcctcccaaagcactgagattacaggtgtgagccaccacgcccagcctaggtgagtagtcttaaattcagatgtaataaacctgcaagatcattcctactctgttaagccccccaaatcaaaattgactggtgaaaacctgcctagaagggcaacctccaaaagatctgagcttttgttttaggaaggacttcaaataacagcaatatttcctgcactggaccaagcagcagtggagtgaatagaaaacatgagatctcttcctctccagttttcctttaagaaagtgcacagaatttcaaggatctacaaaagtggcataacttaatcaatctgtaagtaagcctaagaaaaaaccacggtcattagtagaggatccagttttgtgcactgatcaaagcagtggttctcaatcttggctgcacattacaattacgggggattggggaggaggagttacttttttaaatatccatactcaggctccactccagaccaaattggtatttaagttaaaatgctgggcatcagtcatttttaaacactgccaggtgattctaacagcagccaggtttgaaaaccactggagcaaaggttaatcacttgggcagaggacaagaacacattttgcaatcacgtttttcccttgggtcctctttccttctggagcttatgaattctggagggtgtagaagcaaaatgtcactttcccttgcttcagtaagactaagaacttcctatatcattctattagtctgttttcatgctgttgataaagacagacctgagattaggtaatttacaaaagaggtttattggacttacagttccacatggctggggaggcttcacaatcatggcggaaggcaa

SEQ ID NO: 856 - DNA, 21097 bp, Homo sapiens
ttgctttcattttttatcaatgcttattatattacctgctatttctagtttattatttctatatttttattttttgggacctgctattccctgttttaaaatctctttctattgttttattgtttcttctttgagcttctttttatttattggatttgtattccttcctatcaacctgttatataacatgaaacattttttcagtgtttattctcaattttatcacctgtattttcttctaagtggagcaggtggaatgagcctttcctttctaccttcctctctccctctatttctttcttccctccttccttcttttattccatccttccttgtttcctctcttcctttctttgttttattgttttaaacctatagcatatttactgagtttaatgccatttctttttatgttattcaagatcgacattctattttactctgagatggataggtgaccatcttccaaattgtgtctgagttatttgtttcttcctttacagtgtcagggaggaacattttgtagcttatcaacttttctgaagccaaaaggaaggttagtgtcaggcctctgagcccaagccaagccattgcatccgctgtgacttgcacgtatacacccagatggcctgaagtaactgaagaatcacaaaagaagtgaatatgccctgccccaccttaagtgatgacattccaccacaaaagaagtgtaaatggccggtccttgcctgaagtgatgacattaccttgtgaaagtccttttcctggctcatcctggctcaaaaagctcccccactgagcaacttgtgaccccccactcctgcccgccagagaacaaaccccctttgactgtaattttcctttacttacccaaatcctataaaacggccccacccttatctcccttcgctgactctcttttcggactcagcccacctgcacccaggtgaaataaacagctttactgctctcacacaaagcctgtttggtggtctcttcacacggacgcgcatgaaatttggtgccatgactcggatcgggggacctcccttgggagatcaatcccctgtcttcctgttctttgctccgtgagaaagatccacctacaacctcaggtcctcagaccgaccagcccaaggaacatctcaccaattttaaatcaggagcttactacacgtgccggcaatctggccactgggccaaggaatgcccgcagcccgggattcctcctaagccgcgtcccatctgtgtgggaccccactggaaatcggactgttcaactcacctggcagccactcccagagcccctggaactctggcccaaggctctctgactgactccttcccagatcttcttggcttagcggctgaagactgacactgcccgattgccttggaagccccctaaaccatcacggatgccgagcttcgggtaactctcacagtggaaggtaagcctgtccccttaatcaatatggaggctacccactccacattaccttcttttcaagggcctgtttcccttgcctccataactgttgtgggtattgacagccaggcttctaaacctcttaaaactccccaactctggtgccaacttagacaatactcttttaagcactcctttttagttatccccacctgcccagttcccttattaggctgagacactttaattaaattatctgcttccctgactattcctggactacagctatatctcattgccgctcttcttctcattccaaagcctcctttgcgtcctcctcttgtatccccccaccttaacccacaagtataagatacctctactccctccttggcgaccaatcatgcaccccttaccatctcattaaaacctaatcacccttaccccactcaacgccaatatcccatcccgaagcacgctttaaaaagattaaagcctgttatcactcgcctgctacagcatggccttttaaagcctataaactctccttacaattcccccattttacctgtcctaaaaccagacaagccttacaagttagttcaggatctgcgccttatcaaccaaattgttttgcctatccaccctatggtgccaaacccatatactctcctattctcaatacctgcctctacaacccattattccgttctagatctcaaacatgctttctttactattcctttgcatccttaatcccagcctctcttcgctttcacttggactgaccctgacacccatcaagcccagcaaattacctaggctgtactgccacaaagcttcacagacagcccccattacttcaatcaagcccaaatttcttcctcatctgttacctatctcggcataattctcataaaaacacatgtgctctccctgccaatcgtgtccgactgatctctcaaaccccagcaccttctataaaacaacaactcctttccttcctaggcatggttagtgcagtcagaattcttacacaagagccaggaccgcaccctgtagcctttctgtccaaacaacttgaccttactgttttagcctagccctcatgtctgcgttcagcggctgctgctgctttaataattttagaggccctcaaaatcataaactatgctcaactcactctctacagttctcataacttccaaaatctattttcttcctcatacctgacgcatatactttctgctccccggctccttcagctgtactcactctttgttaagtcccacaattatcattgttcctggcccagacttcaatccggcctcccacattattcctgataccacacctgacccccatgactgtatctctctgatccacctgacattcacatttccccaaatttccttctttcctgttcctcaccctgatcacgcttgatttattgatggcggttccaccaggcctaatcgccacacaccagcaaaagcaggttatgctatagtacaagccactagcccgcctcttagaacctctcatttcctttccatcgaggaaatctatcctcaaggaaataacttctcagtgttccatctgctattctactactcctcagggattattcaggccccctcccttccctacacatcaagctcgaggatttgctcccacccaggactggcaaattagctttactcaacatgccccgagtcagataactaaaatacctcttagtctaggtagacactttcactggataggtacaggcctttcttgtagggtctgagaaggccaccgcagtcatttcttcccttctgtcagacataattcctcagtttagccttcccacctcaatacagtctgataacagaccagcctttattagtcaaatcagccaagcagcttttcaggctcttagtattcagtgaaacctttatatcccttacggtcctccgtcttcaagaaaagtagaatggactaaacggtctgttaaaaacacacctcaccaagctcagccaccaacttaaaaaggactggacaatacttttaccactttcccttctcagaattcaggcctgtcctcagaatgctacagggtacagcccatttgagctcctgtatagatgctcctttttattaggcccagtctcattccagacaccagaccaacttagactgtgccccaaaaaaacttgtcatccctgctatcttctgtctagtcatactcctattcactgttctcaactactcatacatgccctgctcttgtttacactattcttccaagccatcacagctgatatctcctggtgctatccccaaactgccactcttaactcttgaagtaaataaataatctttgctggcaggactatgctgaatctccttaggcactctctaatcagatatcctgagtcatcccaattcttagaccttttatacctgtttttctccttctgttattccatttagtttttcaattcatccaaaaccgtatctaggccatcaccaatcattctacacgacaaatgtttcttctaacaaccccacaataacaccccttaccacaagacctcccttcagcttaatctctcccactctaggttcccacgccgcccctaatcccgcttgaagcagccctcagaaacatcgcccattctctctccataccaccccccaaaaattttcaccgccccaacacttcaacactattttgttttgtttttcttattaatataagaaggcaggaatgtcaggcctctgagcccaagccaagccatcgcatcccctgtgatttgcacatatacacccagatggcctgaagtaactgaagaatcacaaaagaagtgaatatgccctgccccaccttaactgatgacattccaccacaaaagaagtgtaaatggccggtccttgcctgaagtgatgacattaccttgtgaaagtccttttcctggctcatcctggctcaaaaagcacccccactgagcaccttgcgacccccactcctgcccgccagagaacaacccccctttgactgtaattttcctttacctacccaaatcctataaaacggccccacccttatctcccttcgctgactctcttttcggactcagcctgcctgcacccaggtgattaaaagctttattgctcacacaaagcctgtttggtggtctcttcacagggacgtgcatgaaagttaggggtagaagaaaagatggattgaggttgtcctcagactttccatggtatctgagctgttttcctcttccggaattgtgtctcatatgaagttcctcttcatttgaggtataaataattcctgtgttgagtgctcttatactttggcccatttatttatcacctaccgaggagataacacatctctgtcaactctgttttctattacttttttcctgtgctcaagtaatcctcctgcttcagcctcccaagtagctgggactacaggtgcatgccactgtacctgtccttgttttccctttccttgtttcaccagttttcccatcatgttaccattttctgtagcgattgttttatctttccattctgcatgctccttttcaaagtgactttgctgctcccccatcaacaggcagagcctgtttccacatcctctgaatgtaggctagccttgggactagctttggcaaatagaatgtggcagaagtgacattttgcattttataaggcatccttaggaggtttgcagcttctgctttaggttccgaaaatggagctcctaccactatgaaaaaaagctcaggttaaactacttgaatgatgagagactatccagtagagaggtccaggctcacagccagcaccaagttctcatatgagagagtaaggccattttatgctctccagtcccaatagagctaccagatgactgctgcggcacaagtgaccccagaaaagcccataagaaaaacaacctatatgagcccagacaagccacagaatcgtgaaaaataggaaattgtgaaaagccaataaatcgacatatgatttgttatgcagcattagctaaataagacaactgatttccatcccaaagtagtcaggaaaaggaataggtaaacctatatagtcaatttgcttttcctcatatttgagggaattagtgagaaaaatcagggttctgaaaagctggggggcagagttcagagacaattctggctctgcttgtcacattcagaatctcctgtttatttcaggaggtttagatgtttctctaattaagagggagtataagccactcttctgctatgctcattcttataatacaatgtgtcattttaaacccactttggcctctctccctttgattggatgaacctaattatggtttgcttggggaaacttggcttgaggctgtggttctctaccattactgtctataaaactcagtaaaccctactgacaggtagaatcctgcccatcactctcacgacagtctgtagctcttccttataaatacacattaggtaattctgaggctagtggtctacactttgtgaaatacaattgacataaatctaacatttcagagaataataggtccagttttacctctttccatcagttgtttgtgaagttaataattgagacacagcctaagcccgaaagcaagactccatgtctacaaaagatacaaaagcaaattagccatacatagtggtgtgcacctgtagtcccagttactcaggaggctgaggtgggaggatcccttgagcccagcagtttgaggctgcagtgagccatgatcataccactgtactccagtttgggcaacagagtgagaccctgtctcaaaaaaataaagaattggaggctgggcatggtggctcttgcctgtaatcccagcactttgggaggccgaggtgggtggatcatctgaggttgggagttcgagaccagcctgaccaacatggagaaaccccatctgtactaaaaatacaaaattagccgggtgtggtggcacatgcctgtaatcccaactacttgggaggcttaggcaggagaatcgcttgaacttgggaggaggaggttgcagtgagacaagatcacaccactgcactccagcctgggcaaaaagagtgaaactgtctcaaaaaaaaaaaaaaaaagaattggggcaaaagtcgtttgggtgtgcatattgattccatacttcaaaggacgtagtagatgcatacccatgttcacagcattgttcacagtagccagggggtggagacaacccaagtggccattgacagataaatgaatacataaaatgtgggatatttatggaatattattcagccttaaaaaagaaggaagatctcacatatgctacaacatagatgaaccttgaggacattatgctaagtaaaatcagccattcacaagaaagacaatgtatgattccacttatataaggcatccaaagatctcaaatttctagaatggaaagtggaatggtgcttacgaggagctgggagaatggagagttgtttaatgggtgtagattttcacttttacaagagatctgttttctagggatctgttgcacaacaatgtgttaacaccactaaaccacataattacaagtgtttaacatggtaaattttatgttatgtgggttttttaaaaattgtggttaaccacaattttttttttttaatgaggaggaagaagaggacgtgttgacagcataaatggtaaatcctgattgtagatggagaatttacaagtttgttatgactatgtttcacagcaatactaaaaacaacaacaataaatacagttgtcactttagaaacattgttaactctatacatcagataaaattgaacataggaaactcctacagctgcagagtagcatatagttagaggccatctctaaagagttgctctccccctgctggcaagtcttggaattgttcagtttggggaaggaaccaggacagctagagagagaacgttctcagtaagatgctcttgtcattaaaatgtaggtgctttcattcatcaaaatatttcctagaaagacaccaaactcccatagctattatctgaagttattcacttttacattcttccatttatttcttttaaatattttaattgacaaatgacagattgtatatatttatggtgtacaatgtaaagtttcgatatgtgtatacattgtggaatgattaaatccaattcttccacttcttaaaatgaatgtacaacttatttgactatagctcattcattcaccaacctgtatttaactcttaatatgcattgttgtgccaaacactgggatttcaaagatgacattggtgtggacccaggtttgatatctgatagagggatatagacatgtaaatcattaaatcaaatttagtaaagagttgtaagtgtaatagaaaccatctgtgtactacagtataagaattacggcataaagaaagcagtaaagagattcagcaggagtataattaatatattggattcctgtcttttttttaaattaattatttcttttttttttttttttttgagactgagtctcgctctgttgcccaggctggagtgcagtggcacgtcgggtcactgcaaacctcccgctcctgggttcaagcgattctcctgcctcagtctcctgagtagctgggattacaggcatgaaccaccacgcccggacttcctgccctttgaatttaccaagaagagggatcttccagggctaccgctttacaatactactaacctcctccctctagcatcgttaaaccctggcaactgttcatctattaaaggatgacattggcactggagatgacatctaataaagagacacagagaagtaaatcatgcaaatctaatgcagagaataaactaagcttgtaacctgtaatagcttgtagcttcaatgttatataaatgaaatcattcagtatgtgaccctttgagattggctttattccccccaattagtgcactttcctgtaatcaagccaagttgctgtgtatcaatagtttattgcttttttactgccgagttatatttctagtttggaggtacacagtttgctgaatcactcacctattgtaggacattttcagttatttccagttcttatctgttacatataacactgctatgaacaactatatgcaggttcttttatggacttaaagttgcatttctctgagttaaatgtccaggaggatgattgctaggttgattagtaagtgaatgtttatttctttttgagaaactgccaaacagtttttcagagtggccataacacttaacatcaccacccgcgatgtgtgaaacatctagtgtttccatattcttacaggcattatttttcattattgtcattatttttcattgatttgatttaataggcatgcagtgatagctcatagtgatcctaatttgcatttcacaattggattaggtgttgcatatgttttcatgtgcttatttgacatttatgtatgctttctggtgaaatacttcatcacgtcttttgccattttctaagtgaatagtttaactttttactgttgcagattgagagtgtttatgaattctagacatgactcctttatcagatatgtggtttgcaaatatttcctcttagtctgcggcttgtattttcacatctttactgggtcttctgcaggacaaacacttttaatttggatgaagtttaatttatcattttttttttcttttatgaagcatgcttttggtgtcatgtctaagaactcttcgtcaaaccccaggtcctgaaaatgtttgtctatgatttcttctaaagttttatagtttacattttactttaaaatctatgattcaaaaatttgagttaatttttatataatgtgtgagatttaggtcaaggttcacatttttacttatgaatatacaatagctgcaggaccgtatattgaaaaggctatctttcctccattgcaatgctttttgacctttgttaagactcagttcagtgtattttcttaggtgtacttctgggttctttatcctgttctattgatttatgtcactgtccctccatcagtaccatgtaacctgtttactgtgtcggcaaagtaagtcttgaaattgggtagagtgagtcttcccacttgattcatctttttcaaaattgtttttagctattctagttcctttgcctttccatatacattttatcttattttatttttgaaacaagttctcactctatcacccaggctggactgcggtggcatgatcactgttcagtgcagcctcagcctcccaggatcaggagattctcctgtctcagtctcctgagtgactgggaccacaggtgtggaccaccacacccggctaattttttttttttttttttaattcttagaaacagggtcttactccgggcgcagttccctgtaatcctagcaatttgggaggccaaggcgggcggattttctgaactcaggaattcaagaccagcctgggcaacatggtgaaaccccgtttctactaaaatacaaaaaattagtagagcatggcggcatgcacctgtagtcccagctactcgggaggctgaggcaggagaattgcttgaactcgggaggtgggaggttgcagcaagccgagatggcgccactgcactccagcctgggagacattgagactccgtctctaaacaaacaaacaaacaaacaaacaaacaaacaaacaaacaaacagggtcttcctactttgccaaggctagtcttgaactcctgggctcaagcaccctcccagcttggtctcccaaagtgttgggattacaagtaagagccactgtgcccagcaccatataaattttagaataatcttgtctttgtccttatcaacaaaatttcttgctgggattgtgctggtaattgcaataaacttatgtatcaatttggggagaactgacatcttaacagtgttgagttgtctgatccatgaccacagtatgtctctccattcatttagatttttgatttctttcattgctatttcgtagtttttggcttgtttttattagattcacactcaagaatatttttagcaattgtaaatgctactgtatctaaaattttaccttccacatttccattgctagtatgtagaaatacaattagtttttgttctaggagggtgttttggtggattccttgggacttttgtagatagacaatcatgctctctacaaaaagggacagttttatttttctctttccaatatgcataccttttatttcctttccttgctttattgcactggctagaacttctaataccatgctgaaaagcggtggtaagtggacattttcgccttgttcctgattctagcaagaacgtattgtctttcgtcgtgaagaatgatgttagctgtagggtatttttttgggaagggggggttgatattagtatgctctgtttttagaaacaaatgtaacatctgaatttgtccaccactctaaggctcaagaaactccactttatttaatttttctcaatcaagttaaatcagaatgttagttgttatgtttacgaagtttccatttttgtattaaatagtagttattttattttaatttttaataaaaaacagaaatttttattggctcacatttctggaggctgaaaagtccaatatcatggtgccagtgctaatgagggcttttgtgctatgtcatcccatagaggaaggtgaagggcaagagagggcaagtgagagaggaatgaactaaccttgtccttttataacaaaccaactccctagataatggccttgatccactcttgaaggtggagccctcctggcctaactacctctttaatggtctcacctcttaacactgttgcattagggattaagtttccaatacatgccttttgggatacacatttaaaccatagcacatgtgacgttgagcaggtgactcacaaaagagtcatgctaagtagtagttattaaaacacacacacacctagaaaaaataataaataatacaaagaaaaattttcactcctggtaaaaatttttaatacccatattagcatattcataaataactgtaaatttcaccttgttgttatcatatgaaaagtggtgatcacattaataattagcccatcaataactttaaaatatcttttgtgccttcttttgagtgttttttctttcttctcataatgaagtcctctttccttgtgaagtaagaaaagtaagtcagcaactatatttagctcttgtaattatgtttttgtataatagacaatgcaaagtcttttaaatattagagctcagtgaagtatcatccttggatatttttagtttaggaaatgttagggatatttgatgtaagtaaggagtgcccatgaactagatatgcagatgccatgggaattttgggggaatcaagatgttggcttgggtgttggagtatccattgggatctttgaacactgagaggagcatcatatggggagaaatgccttcccttgtacctcaggggtcactgaagtctgggccaatcaatgggaccttcaccagtcacgtgaaagctctcagaatgactggcgatggctgcagctgccactggggacatttctctgaactgcctagactgtcattttttaacagcttctgtcttaacaactgtagtgacaccggaggaccaagaactggatgttacagctgcttagggttaaatttgttcttgagatacaatttgtccttgagtgctacatctctttgcccagcaggtggcagtaagcgattacgagacatatggtaacaagcatcagcgtaagagactttggagtatactcagggctacttggaaggattaactcttcaacattctgcgaatctgaatttagctttcaatttagatatcaactgtaatactgttttattgggtgcctctaaaatggtgaagcggtgcatactgtttgagcgtaaacagattttacagcagagctgcttcagttgaataggggcataagacctggaggctacctactcagtgccatcttccccaaatacagcagaccattgagtctttgaagaccctgctttggctcagcttctcagtggatcaacagacctgtaattcttactagtcacctcgaattcagcatattcaaaccaagcagtggtgtgcaggggccagccttcacctacttagaagagtccattgataaattgtcagaggttttgcaagctggttaacttcacattggtagtttgaaagtatccacaatggaagcatttacaatagaagtcgtgtaattctactaacaaagatctcccctcacctccagctgtttattcaatatttattaatattacactgatctaagcacacttgctttctccctgaacaacatctcttttcctgcctatatatcccatctgatacggtttggatttgtgtccctgcccaaatctcatgtcgatttggaggaggggcctgttgggaggtacttggagcatggggtggatttcccccttgctgttctcatcatactgagtgagttctcatgagatctgatgatttaaaagtgtgtggcacttcccccttagctctctctctcatgccaccatgtgaagaggtgcttgcttccccttcaccttccgccatgactgtaagtgattaggtttgactgtgtcctcacccaaatctcatcttgaattgtagctcccataattcccacaagttgtgggagggacccagtgggagatagctgaatcatggggcggtttcctccttactgttcttgaggtagtgaataagcctcatgagatctgatgattttataaggggtttccacttttgattggctctcattctctcttgtctaccaccatgtaagatgtgttttttgccttctgccatgattgtgaggcctccccagccacatggaactctaagccaattaaacctcctttctttataaattgcccaatcttgggtatgtctttattagcagtgtgaaaacagactaatacagtaagtttcctgaggcctctcagtcatgtttcctgttaagtctgtggaactgtgagtcaattaaacctcttttcttcataaattacccagtctcaggtagttatttatagcaatgtgaaaagagactaatacaccatcaatccccaaacctctcattatctcacttcacaaagctcagtccaaactgttcttcctctgcagtgacactgaacttggccactctcccaccatcacctcttcttcccttgcctctggtttcctaaagcactttgtttctgtcacagggtaaaatactcttattttataacatgtgtttcacaagaacctggtggctagacattagcctctgtgttcctagaggggactttgaggcccgtgtctgagacttcatggtaacctcagtggctatggtagattttggcacatggtagatagatgctcattaaatggttgtggtttctgtttttaccacagaataactttccaattcttttttgttccatgatctgaccccaaccagcctattaacattaccttttaattattcatcttcatggtatttgctagatttttctcaagctgtcgcccttggtttgccccatatccacctcacatcttctctctccatctttgtgtgtactcttccctcctcatgggcggcctttcacgtttcctttagggtcttgctcaaatgccattttctctgtgaagctgttttctccttttccttctgattctgccactctaagtaatcagatctctacagtcttgcatctgtccaccaacttctaaaattctgtgaaaaggggaaactaaactcatctactgtggttaaccagaccacaaagaggaatgctggcgttcatgaagaatattctgagagccttgtcaaagtcactctgttgtccaggccaaacagaggagtgtggatgatagagatttcggatgtggcttgtgaaagggaggagggcaaggctggcagaggtggagttctgtctatttaaagtagttgtctgtttagcagtgcaccctggaggagacagggctgtctgtgctctgggccatatcaaaggtgccctcaacaccccacagttcaggtctgttagctttcctcataaaaccatgtttggagagatggcttttcagaaggaattttggcttgaaactggaagaaagcatgcctgaaaatttaattgggaagtaagggtatatcaaggggggaaaggcagcagctttgaagtggaaaatatcttgcaaagagtaaaaatagtggcttttaagtggcatatgaggaggttcggtggccagccctttcattagctgacttcctgtgccccactgggactgtcctctgagggctgattgctgcctttgatgcctctaaccagctggtgtcactactcaggccgaggatttcaggaagacaggtagcttagcaaagaggaagagaaggtttgtttcatgaaagctgatctaccaaacaccatctggcaagggattaataaccagaatatataaggagctcaaacaactctataggaaaaaatctaataatttgattaaaatacagggcaaaggatctaaatagacatttctcaaaagaagacatacagatatgggggcaagtgggggaatgcaatatagctggctagacatagcccaatagacacagccaggtggaacagctcccacagagggacccagataactggcatgcttctaacagatcctcagaggcaaggcactgagagtggatggagggaagacacagaagctgggctggaggggaagaaacctgggaacactgcctggggatactgctcactgggactgatttttggaccacaacagctccaggagaatgggtgacttgaactggcaaggagcaacctgctctctccacgggcctctggaaccccggcaagagaagatcccttgatcaccatggacactcaagttggcaagaagagctccttagagaagtcgtgggagggcaagcaagctgatgtggagccaggacgatttgatgtgggagcacctgcagtggagcacagccagggagagccatctccccaggcctgacttgctcccataggagactttagccctaggggaactgtccatcctgatctctgcagggtggtcttgtccatcagacagggctgattcgacctgagcaccccttggtctgctggcctttctggggtcccagcctggccagacctgcttgcagggcagtcttgggtgccctggaggccacgccatagcttctgtgctggcagatagtatctgactggtggagagctccagcaaggctgcccctaggccacacaccagcccatccaccccctccccacactgcagcttccctaggcccaggaaactcctcacgtgtctttgctggcacaagtctgcacaggtaggttttgccttccttgccctgccagtgcatgggagtgtagtctgcccccctgccccgtctggctgtcattgaagacagagccttggtgggcacagagcaagccagctcccccgcaacgcccacctcaacacctggcccttgtgctaacactgtgcagagaacagtggaccctgctcgcaccctgagtgatcactcctgcttgtggggcacagagaaggtgtccagacctgctcacgccagtgccctgcccccaagccaacaccacatccaacaggagcctgcacccagtcttcagcatagaggtgaaagatctctacgaggagaactatgaaacactgctcaaaataatcaaatatgatacaagcaaatggaagagcatgcaatgctcatggataggaagaatcaatatcataaaaatggccatactgcccaaagcaatttatagattcaatgctattcctattaaactaccattgatattcttcacaaaactagagaaaactattttaaagttcatatggaaccaaaaaagagcctgaatagccaaggaaatcctaagcaaaaagaacaaagctggaagcatcatgctacccaacttcaaactatactacaggactacagtaaccaaaacagcgtggtactggtacaaaaacagacacatagaccaatgaaacagaatagagaacccagaaatggttctctatttcacacacctacaactatctgatcttcgacaaacctgataaaaacaagcaatagggaaatgattctgtattcattaaatgatgctggaataactggctagccatatgctgaagattaaaactggaccccttccttatactgtacacaaaaatcaactcaaaatggatgaaagacttaaatgtaaaacccaaaactataacaacaatagaagacaacctaggcaataccatcttggatataggaacaggcaaaaatttcatgacaaagacaccaaaagcaattgaaacaaaagcaaaaattgaaaagtgggttctaaataaaactaaagagctcctgcacagcaaagaaaatacaaacagagtgaacagacaacctacagaatgacagtatctgcaaactatacatccaacaaagatctaatattcagcatctataagaaacttaaacaaatttccaaaaacaaccccattaaaaagtgggcaaagcatatgaacagacacttttcaaaagaagacatacatgcagccaacaaacatgaaaaaggctcaacaccaccaatcattagagaaatgcaaatcaaaaccacaatgagataccatctcacactagtcagaatggctgatggctgttattaaaaagtcaaaaaataacagatgctggcaaggttgtggagaaaaggcaatgcttatgcactgttggtgggagtataaattagttcaatcattgtggttgacagtgtggtgattcctcaaagatctgaaaacagaaatataattctacctagcaatgctactactgggtatatacccaaagaaaaataaattgttcaattataaagacacctgcacttgtatgttcattgcagcactatttataatagcaaagacatatcaatctaaatacccatcaatgatagactggataaagaaaatgtggtgcatatacaccatggaatactatggtatttcacagccataaaaaaaaatgagatcatttttttccatccacatccttttcaggtacgtggatggaactggaggccaatacccttagcaaacaaaggcaggaacagaaaaccaaatactgcatgttcttacttataagtgatgggaacacatggacacatgtgaaggaacaacatttactggggcctgtcgaagtgtaggggataggaggagggagagcatcaggaataatagctaatgggtactaggtttaatacttgagtgactaaacaatctatacaataaatccccataacacaagtttaccaatgtaacaaacctacacatgtaccccggacttaaaataaaagttataaaaagacatataaatggcaaacatgcatatgaaaatgtgctcaacattgatcatcagataaatacaagtcaaaactataatcagatatcatgtcaccccagttaaaatggcctatatctaaaagacaggcaataaaaaatgctggtggtgacgtagagaaaagggaacccttgtatactgttgatgggaatgtaaattagtgcaaacagtgtggagaacagattgcagtttcctcaaaaatctagaaattgagttaccatatgatccagcaatcccacttttgctggatatatatatgcaaaagaaaggaaatcagtatattgagatatttgcatgcctatgtttgttgcagcactgtttacaatagctaagatttgagagcaacctaagtgtccatcaacagatgaatggataaagaaaatatggtacagatacatgagggaatactatttagccataaaaaagaatgagatccagttgtttgaaacaacatgaatgaaactggagatcattatattatatgaaataagtcaggcacagaaagacaaacattgcatgttttcatttatttgtgggatctaaaaatcaaaacaattgaactaatgaacatagagagtagaagaatggctagcagaggctgggaatggtagtggggggctggcggggaggtggagatggttaatgggtacaaaaaatagaaagaatgaataagacctactatatgatagcataatagggtaactatagtcaataataacttaattgtatgttttaaaatagcttaaagagtgtaattggatgatttgtaactcaatagataaatgcttaaggggatggataacccattctccattctgcacttagttaccattgaatgcctgtaccaaaacatctcatgtacctcatcaatatatacacctactatgtacccataaaaattaaaaatcaggtgagcgccttctatgtgtcaagaacagtcacaggtgctggtgagggcagggagggaagacaaatagataaatatgtgtgtcgattttttttttctttttagtgctttgggtaaagtaaattgttttcatttgtctgagaagattgacaaagaaagagagaaaaataaacacacttttctaataggaagagaacactaaatatgacaatgaagctttcccatggagcctggacatggcctcagaacattctcaacacagagctcaggagagccactagcagtcatttccacttgcatggagtggagacctattccttatcccatccccatccctaactgatgttctgctcctcctttctgttaacttgtgggttgtggtctattattcttgcttttgtatcccaacattctctcatggatgatcattttaaattatgttttgtaattttgaattgcgaactcatcttagacttcatctgtagaaatcctctacaacctgacttggaactatgcccctctgaagaggtttccagtttgcttcagtcagatacccgagatatttgtatattgggactaactattaatctcctggcttgggggttctcagaccatataggtagtactgtttcaaacctcaaggagttttatgggaagactcacagatataaatggtgaggaaaattgttttcctatccaaacagatcaaactgtttctccttgtgctagtgagtggattttttctaacccaccccttcaatgaagttttggttcagtaagtgttctggctttattgggggatggtcatggggtgatggttgtagtttcagcttcatcagctgggttcagcgttttacattctgtgctcatatgggtgctaaaactgcagacttttggttactgggactggaaactctcctcccttccaaggtggcctccgtgttatttggcactcatagttttaaatttattattatttgaaggccctgtagaattcctcttttttcttgagagctcaacaatgcatttaaaataatgttggctatattttacccacaatttctaggtttgtagtgggagaatgttcagtttatctacagctcagaaacataaatccatctagcaaattcttaacacctgaggttattcattcaagtagtccttagcacccatagatatatttaacaacagagtaggaccagtgacagctgctccttctctcattattggagccctttacagatctagatacagaagactgagtcctgcttgactctcccacagcagaaacaaatattatattacacacatgacccatattactgatttttaatatacaaatctggtcacaatttttctgtgtaatttaaaaaaatccagatgcctggattttattctttatgcaagaatccagtgtctctcttttgaggtcttactttctcccccaaattattgaagaattcctcaggattattcaatataaagggagttggtcctcttccaagccccagacagagagcattggagtcagctgtccctcagtgcagctatctaagtcattgccacaaggtgtcgctgttggacatgggtcttgctaggttcagaggccagtttgcaactgcaatttcatccgtgctggtactctcatttgtaaaataaggttacagtcttcagttcactccaggtttttagcaattgtattctgaagctatgggagagtagctggtcctgagggcctttttagccttagctaatggtgtgccaaaccacttctttctcacttaggttttcctgctctcttgcattgcattagtgtttagactgcatataaagaatattatgcttccacattattttgatttctcacttaatactgataaagtattaactctcatggatacagtgccctgctatctcataattttttgatcctcaaaactcactctgtgcaggcagcaccgaaccccagagagaggcaatgaccttcccaggggatttctacaaattaatagaaaaactggaactccactgcccactgcagcaccaccatgtctttcggacagtacctcttgccacatggggaaggagagcattcctcgtggccctgcttgaggccagatgtttaccccagggattgggaaaagacagaagagccaggaagggtgcaaggtacagagagcaatgcgatagaaaaactgcttaca

SEQ ID NO: 857 - DNA, 602 bp, Homo sapiens
cttgtttggcagcaaccctgagacactttacagccctagaccctaaaaggtcaaaaggccgtcttattctcaaaatacattttattacccgacattaataaaacattaaataaaactccaaaaattaaattccggccctcaaacctcacaacaggatttaattaacctcgccttcaaggtgtacgataatagaaaaaagttgcaattccttgcctccacggtgagacaaaccccagccacatctccagcacacaagaacttccaaatgcctgaaccgcagaggccaggcattcctccagaacctcctcccacaggagcttactacacgtgccggcaatctggccactgggccaaggaatgcccgcagcccgggattcctcctaagccgcgtcccatctgtgtgggaccccactggaaatcggactgttcaactcacctggcagccactcccagagcccctggaactctggcccaaggctctctgactgactccttcccagatcttcttggcttagcggctgaagactgacactgcccgattgccttggaagccccctaaaccatcacggatgccgagcttcgggtaactctcacagtggaag

SEQ ID NO: 858 - DNA, 602 bp, Homo sapiens; identical to SEQ ID NO: 857

SEQ ID NO: 859 - DNA, 6909 bp, Homo sapiens
ttgctttcattttttatcaatgcttattatattacctgctatttctagtttattatttctatatttttattttttgggacctgctattccctgttttaaaatctctttctattgttttattgtttcttctttgagcttctttttatttattggatttgtattccttcctatcaacctgttatataacatgaaacattttttcagtgtttattctcaattttatcacctgtattttcttctaagtggagcaggtggaatgagcctttcctttctaccttcctctctccctctatttctttcttccctccttccttcttttattccatccttccttgtttcctctcttcctttctttgttttattgttttaaacctatagcatatttactgagtttaatgccatttctttttatgttattcaagatcgacattctattttactctgagatggataggtgaccatcttccaaattgtgtctgagttatttgtttcttcctttacagtgtcagggaggaacattttgtagcttatcaacttttctgaagccaaaaggaaggttagtgtcaggcctctgagcccaagccaagccattgcatccgctgtgacttgcacgtatacacccagatggcctgaagtaactgaagaatcacaaaagaagtgaatatgccctgccccaccttaagtgatgacattccaccacaaaagaagtgtaaatggccggtccttgcctgaagtgatgacattaccttgtgaaagtccttttcctggctcatcctggctcaaaaagctcccccactgagcaacttgtgaccccccactcctgcccgccagagaacaaaccccctttgactgtaattttcctttacttacccaaatcctataaaacggccccacccttatctcccttcgctgactctcttttcggactcagcccacctgcacccaggtgaaataaacagctttactgctctcacacaaagcctgtttggtggtctcttcacacggacgcgcatgaaatttggtgccatgactcggatcgggggacctcccttgggagatcaatcccctgtcttcctgttctttgctccgtgagaaagatccacctacaacctcaggtcctcagaccgaccagcccaaggaacatctcaccaattttaaatcagctccaggagaatgggtgacttgaactggcaaggagcaacctgctctctccacgggcctctggaaccccggcaagagaagatcccttgatcaccatggacactcaagttggcaagaagagctccttagagaagtcgtgggagggcaagcaagctgatgtggagccaggacgatttgatgtgggagcacctgcagtggagcacagccagggagagccatctccccaggcctgacttgctcccataggagactttagccctaggggaactgtccatcctgatctctgcagggtggtcttgtccatcagacagggctgattcgacctgagcaccccttggtctgctggcctttctggggtcccagcctggccagacctgcttgcagggcagtcttgggtgccctggaggccacgccatagcttctgtgctggcagatagtatctgactggtggagagctccagcaaggctgcccctaggccacacaccagcccatccaccccctccccacactgcagcttccctaggcccaggaaactcctcacgtgtctttgctggcacaagtctgcacaggtaggttttgccttccttgccctgccagtgcatgggagtgtagtctgcccccctgccccgtctggctgtcattgaagacagagccttggtgggcacagagcaagccagctcccccgcaacgcccacctcaacacctggcccttgtgctaacactgtgcagagaacagtggaccctgctcgcaccctgagtgatcactcctgcttgtggggcacagagaaggtgtccagacctgctcacgccagtgccctgcccccaagccaacaccacatccaacaggagcctgcacccagtcttcagcatagaggtgaaagatctctacgaggagaactatgaaacactgctcaaaataatcaaatatgatacaagcaaatggaagagcatgcaatgctcatggataggaagaatcaatatcataaaaatggccatactgcccaaagcaatttatagattcaatgctattcctattaaactaccattgatattcttcacaaaactagagaaaactattttaaagttcatatggaaccaaaaaagagcctgaatagccaaggaaatcctaagcaaaaagaacaaagctggaagcatcatgctacccaacttcaaactatactacaggactacagtaaccaaaacagcgtggtactggtacaaaaacagacacatagaccaatgaaacagaatagagaacccagaaatggttctctatttcacacacctacaactatctgatcttcgacaaacctgataaaaacaagcaatagggaaatgattctgtattcattaaatgatgctggaataactggctagccatatgctgaagattaaaactggaccccttccttatactgtacacaaaaatcaactcaaaatggatgaaagacttaaatgtaaaacccaaaactataacaacaatagaagacaacctaggcaataccatcttggatataggaacaggcaaaaatttcatgacaaagacaccaaaagcaattgaaacaaaagcaaaaattgaaaagtgggttctaaataaaactaaagagctcctgcacagcaaagaaaatacaaacagagtgaacagacaacctacagaatgacagtatctgcaaactatacatccaacaaagatctaatattcagcatctataagaaacttaaacaaatttccaaaaacaaccccattaaaaagtgggcaaagcatatgaacagacacttttcaaaagaagacatacatgcagccaacaaacatgaaaaaggctcaacaccaccaatcattagagaaatgcaaatcaaaaccacaatgagataccatctcacactagtcagaatggctgatggctgttattaaaaagtcaaaaaataacagatgctggcaaggttgtggagaaaaggcaatgcttatgcactgttggtgggagtataaattagttcaatcattgtggttgacagtgtggtgattcctcaaagatctgaaaacagaaatataattctacctagcaatgctactactgggtatatacccaaagaaaaataaattgttcaattataaagacacctgcacttgtatgttcattgcagcactatttataatagcaaagacatatcaatctaaatacccatcaatgatagactggataaagaaaatgtggtgcatatacaccatggaatactatggtatttcacagccataaaaaaaaatgagatcatttttttccatccacatccttttcaggtacgtggatggaactggaggccaatacccttagcaaacaaaggcaggaacagaaaaccaaatactgcatgttcttacttataagtgatgggaacacatggacacatgtgaaggaacaacatttactggggcctgtcgaagtgtaggggataggaggagggagagcatcaggaataatagctaatgggtactaggtttaatacttgagtgactaaacaatctatacaataaatccccataacacaagtttaccaatgtaacaaacctacacatgtaccccggacttaaaataaaagttataaaaagacatataaatggcaaacatgcatatgaaaatgtgctcaacattgatcatcagataaatacaagtcaaaactataatcagatatcatgtcaccccagttaaaatggcctatatctaaaagacaggcaataaaaaatgctggtggtgacgtagagaaaagggaacccttgtatactgttgatgggaatgtaaattagtgcaaacagtgtggagaacagattgcagtttcctcaaaaatctagaaattgagttaccatatgatccagcaatcccacttttgctggatatatatatgcaaaagaaaggaaatcagtatattgagatatttgcatgcctatgtttgttgcagcactgtttacaatagctaagatttgagagcaacctaagtgtccatcaacagatgaatggataaagaaaatatggtacagatacatgagggaatactatttagccataaaaaagaatgagatccagttgtttgaaacaacatgaatgaaactggagatcattatattatatgaaataagtcaggcacagaaagacaaacattgcatgttttcatttatttgtgggatctaaaaatcaaaacaattgaactaatgaacatagagagtagaagaatggctagcagaggctgggaatggtagtggggggctggcggggaggtggagatggttaatgggtacaaaaaatagaaagaatgaataagacctactatatgatagcataatagggtaactatagtcaataataacttaattgtatgttttaaaatagcttaaagagtgtaattggatgatttgtaactcaatagataaatgcttaaggggatggataacccattctccattctgcacttagttaccattgaatgcctgtaccaaaacatctcatgtacctcatcaatatatacacctactatgtacccataaaaattaaaaatcaggtgagcgccttctatgtgtcaagaacagtcacaggtgctggtgagggcagggagggaagacaaatagataaatatgtgtgtcgattttttttttctttttagtgctttgggtaaagtaaattgttttcatttgtctgagaagattgacaaagaaagagagaaaaataaacacacttttctaataggaagagaacactaaatatgacaatgaagctttcccatggagcctggacatggcctcagaacattctcaacacagagctcaggagagccactagcagtcatttccacttgcatggagtggagacctattccttatcccatccccatccctaactgatgttctgctcctcctttctgttaacttgtgggttgtggtctattattcttgcttttgtatcccaacattctctcatggatgatcattttaaattatgttttgtaattttgaattgcgaactcatcttagacttcatctgtagaaatcctctacaacctgacttggaactatgcccctctgaagaggtttccagtttgcttcagtcagatacccgagatatttgtatattgggactaactattaatctcctggcttgggggttctcagaccatataggtagtactgtttcaaacctcaaggagttttatgggaagactcacagatataaatggtgaggaaaattgttttcctatccaaacagatcaaactgtttctccttgtgctagtgagtggattttttctaacccaccccttcaatgaagttttggttcagtaagtgttctggctttattgggggatggtcatggggtgatggttgtagtttcagcttcatcagctgggttcagcgttttacattctgtgctcatatgggtgctaaaactgcagacttttggttactgggactggaaactctcctcccttccaaggtggcctccgtgttatttggcactcatagttttaaatttattattatttgaaggccctgtagaattcctcttttttcttgagagctcaacaatgcatttaaaataatgttggctatattttacccacaatttctaggtttgtagtgggagaatgttcagtttatctacagctcagaaacataaatccatctagcaaattcttaacacctgaggttattcattcaagtagtccttagcacccatagatatatttaacaacagagtaggaccagtgacagctgctccttctctcattattggagccctttacagatctagatacagaagactgagtcctgcttgactctcccacagcagaaacaaatattatattacacacatgacccatattactgatttttaatatacaaatctggtcacaatttttctgtgtaatttaaaaaaatccagatgcctggattttattctttatgcaagaatccagtgtctctcttttgaggtcttactttctcccccaaattattgaagaattcctcaggattattcaatataaagggagttggtcctcttccaagccccagacagagagcattggagtcagctgtccctcagtgcagctatctaagtcattgccacaaggtgtcgctgttggacatgggtcttgctaggttcagaggccagtttgcaactgcaatttcatccgtgctggtactctcatttgtaaaataaggttacagtcttcagttcactccaggtttttagcaattgtattctgaagctatgggagagtagctggtcctgagggcctttttagccttagctaatggtgtgccaaaccacttctttctcacttaggttttcctgctctcttgcattgcattagtgtttagactgcatataaagaatattatgcttccacattattttgatttctcacttaatactgataaagtattaactctcatggatacagtgccctgctatctcataattttttgatcctcaaaactcactctgtgcaggcagcaccgaaccccagagagaggcaatgaccttcccaggggatttctacaaattaatagaaaaactggaactccactgcccactgcagcaccaccatgtctttcggacagtacctcttgccacatggggaaggagagcattcctcgtggccctgcttgaggccagatgtttaccccagggattgggaaaagacagaagagccaggaagggtgcaaggtacagagagcaatgcgatagaaaaactgcttaca

SEQ ID NO: 860 - DNA, 2047 bp, Homo sapiens
cagcaatccatcaaccatctccaatttattctttacacttaggattatgaccaagttcacgtacttaaaagggagaaaccacagagacatcacactgaaagtttctctgctttgggccagcaggaaattccagttgcttcattcaccggagccagttaagctgctgaaatgaaatggatcaccggagagatcactatatcaggacatagacttgactttcagggttggaggaagccggacaaagatgaatgggattcagagcctgaactcaaggtcaacgtcttctgaatcacaaagagctggtgggtcagtctgggagaagaaagaaaattctgcgccaaatgggaaaacccttaaagtctgcatagttttgcttgtcggtaagaacacaggtaggcggcgggaagagaggtggcaagcagccccaacgctcgccgagatccccagggttttacaaacggatcgtcctgaagtctccaaaactgtaactactatatgcccaaatttatattctcccctggcttttccaacaggctacctgcctgtgacagttttcccacgaacttggctctcctctgtctacagcgccccggggtctcccaaacagacagacacagacagacagaaggagcagacaaggggactgtccaattcccaccctccgcgcccactctctcgaggtagccaagaccctccaggagtccgaaagtcacagagcgctctgcgcccctgccacctgcccagcctcccgctggggtccggcagtccccactggagaccccgacatcgcggggctccgcggcccccgcgccgacccagggccgccagggggcgggcgggagcagctctccgggtgcctcccccgccggttcccctcccccggcccgccggccactcacggattttcactcggcggtggtccaggcgcgcagcggcggcttgcagggcgtcgaggcggcggtgcagcgcggcggtgcggtggcccagcgcggccgcctggccctcgagctcgccgaagatgtccccggcgcagcgcgacagggttgttatgaggctcaaaggaacggctgctgtgaaaaaacatgctttgcaatttatgaagcactggataaacatcaggaacggtataaaagcatgctgcttactcaagaaatactagttgagtgcctgtgtgttgggcactggctagagataagggtctcctatggacagaagtgcgggcaaggagctttgttcctccccgatgtcaccctcccacagcccacttgctagcaggcaagagaggggtggaggccggcagtaaggcatgtactgaactggacctctggtggaatgggtcacccacgctgggcttggactcttaccatcagggtcctgccaacccttcagtgagactttttccgaagaatcccttttaaaatgacctcaagctgaccttcctgatgcagattccacatatggtatctgagactcacacagtgtggttggaagatagcacagtgacctcccaggcacagccctctgccagccctccactggctgccctaggatgctggccttcctccgatgggagtcgggcccagtctgctgtgagccaggagaagccagcaagctccctgcgaggcctggaggagcccttctcactcagcttggtgttcgatgccagtgcccccgcccattgtggggtgagggtgggactctcagcacagccctgtccaaataaatcctctaaagccctcttccatctgcagtcacttgagtcttttgtagcctgtgtgattgagcatctaagcagtcctcagctatttactttgaaatttcgtaagtgattttggtatctgtcatttcttgatgcatcagtcacaactccccatctaacatcccattaaataatatataaaacagaacaaaaacattgtgccaacttcttctaagaagaatttaatgtcacttcctaagttaagcagttgggccctgtcccatgactgttcatctctgctcaatagtcatcaagagctgagaaagaagaaaggagccctgggggcct

SEQ ID NO: 861 - DNA, 1381 bp, Homo sapiens
aatccatcaaccatctccaatttattctttacacttaggattatgaccaagttcacgtacttaaaagggagaaaccacagagacatcacactgaaagtttctctgctttgggccagcaggaaattccagttgcttcattcaccggagccagttaagctgctgaaatgaaatggatcaccggagagatcactatatcaggacatagacttgactttcagggttggaggaagccggacaaagatgaatgggattcagagcctgaactcaaggtcaacgtcttctgaatcacaaagagctggtgggtcagtctgggagaagaaagaaaattctgcgccaaatgggaaaacccttaaagtctgcatagttttgcttgtcgggttgttatgaggctcaaaggaacggctgctgtgaaaaaacatgctttgcaatttatgaagcactggataaacatcaggaacggtataaaagcatgctgcttactcaagaaatactagttgagtgcctgtgtgttgggcactggctagagataagggtctcctatggacagaagtgcgggcaaggagctttgttcctccccgatgtcaccctcccacagcccacttgctagcaggcaagagaggggtggaggccggcagtaaggcatgtactgaactggacctctggtggaatgggtcacccacgctgggcttgactcttaccatcagggtcctgccaacccttcagtgagactttttccgaagaatcccttttaaaatgacctcaagctgaccttcctgatgcagattccacatatggtatctgagactcacacagtgtggttggaagatagcacagtgacctcccaggcacagccctctgccagccctccactggctgccctaggatgctggccttcctccgatgggagtcgggcccagtctgctgtgagccaggagaagccagcaagctccctgcgaggcctggaggagcccttctcactcagcttggtgttcgatgccagtgcccccgcccattgtggggtgagggtgggactctcagcacagccctgtccaaataaatcctctaaagccctcttccatctgcagtcacttgagtcttttgtagcctgtgtgattgagcatctaagcagtcctcagctatttactttgaaatttcgtaagtgattttggtatctgtcatttcttgatgcatcagtcacaactccccatctaacatcccattaaataatatataaaacagaacaaaaacattgtgccaacttcttctaagaagaatttaatgtcacttcctaagttaagcagttgggccctgtcccatgactgttcatctctgctcaatagtcatcaagagctgagaaagaagaaaggagccctgggggcct

SEQ ID NO: 862 - DNA, 1381 bp, Homo sapiens; identical to SEQ ID NO: 861

SEQ ID NO: 863 - DNA, 2322 bp, Homo sapiens
gacgcgcacgccgccctctgaccccgcagcgtcgtggctagagtagggtctggagagagctcccactgtggcgagtcctgtcgttggattcccgcggcgccccgtaaggctccgccccggcggtgctaccaaaccctgttcgattttagaatcgtacattcccagagggaatcctagacccctcattttacagttgaggaaacaggcccaagtagcatgacttgttcgcgccgctagtcgaaggagcagcagccccgatcccttgactctggggcactgctttccctttagctcatttttggaggaaatgggtgcgcccttgctcgacctttggtgattgccgccacaggccttcccgccggctaactcagcgtgcccaagtcccgtgacttagtgccaggacggtgctgtgacccgttatcccctgtcgggttttacctccccccgggagagctcagccctggatcccggcgggcggcggagcctctctggagcccggacgggacagcccaccagggtctgcttctgtgaggggccgaggcgtcattccgcgaagccttctccttgctgttgccatgtgaagaaggatgtgtttgcttccccttctgccatgattgtaagttttctgaagcctctccagccatgccaaactgaagctgctggaaggtacacatcttgggagtttgccctttgaagctcacctgtggaccttttttcctttcgaaaagaagcataagctgcaataaaaatttggtttcaagataacaaagtcagtccccaaaaatcagtattgagagtcactgacattaaatgatgaagatacgaggatggtgtggggacctttactcttcgaagatgagctatacatgcccctgaaaaggctgtctgaagacaggggaaggctggagatggcaactttggcctctgccaagtactcgtgctattttctgtatgtgatactatctgttttgtaactcagaggcaacaccacatacctagcataaggcttgaactccctttggggttatcaattacttacatagccttcctctaagggaaggcttgcaagtggttcatattcgacccttccatgtgataagcattcatgtgggcttcacaatgtaacagaggtacacagagattcttgtaaacagaaaattttataaaactgttaactgatctcactttgaagaagtcttactgactagatgtcatttatcagagtagacaggcttaaaatgcattgcttgtactagactgttgtaatgcatttttttgtttttgcattggtttttaattcatttaattggtttacactcatttttttttttacattccatttttgcatttgtatgccagttaaaaattatgaaatggcacattgtgggattttgtttagctaaattctagaaaaattgaaagataccttttattcgacttaagcctgaggttattcagcacggtgatctctgcatttttgaaaggttgtctcgtcgtttaataaacgtaaataacttaagcacattggaagagctattaaatgagagcaggagattaaaaagacatgatttcttactttatccacctgacaggatagcttgcattggtgattaaccttgcattgttaaattcatttcctaaatatttaggtaagtagttggtttgatcattatttgtaaagtattagtagttgcatgttgaattatcatgttaagatttttagtttgttgttcatgtgatatgaaagataacaattcctaaaactgaatgcatgcatggcttattcagctcaggtcacatacaaagagaaatgtgacgctgcaataaacatagcagagctatctgggtttgaagcaaaaaggctatgacgttaggtatatgcactttacattgtatgtatctttttagttctagtgaactcatctggaatcatgttacagaaaatgattctccaggtccaaacacatttaagtttaatgactgggactactctaacaattgcggctatctcattttgtctcattggttcattagcatagcacccatttaagaacaactacttctaaacacagtaatatttcagaggctataaaataatagagaaagaaaacttaaaaaatcctttgtttgcagccaagaaaatgtgaggatcagatttgtacttgttttgaacaattggaaactgtcacaattgtttttaagatgtaataaatgtatataaaatatgggattctatagtattagccattttgatatcttttgttgaaagaaaaaaccaaaaaaccccatatgttctaagtctcagaaatcaaagaattccac

SEQ ID NO: 864 - DNA, 2286 bp, Homo sapiens
gacgcgcacgccgccctctgaccccgcagcgtcgtggctagagtagggtctggagagagctcccactgtggcgagtcctgtcgttggattcccgcggcgccccgtaaggctccgccccggcggtgctaccaaaccctgttcgattttagaatcgtacattcccagagggaatcctagacccctcattttacagttgaggaaacaggcccaagtagcatgacttgttcgcgccgctagtcgaaggagcagcagccccgatcccttgactctggggcactgctttccctttagctcatttttggaggaaatgggtgcgcccttgctcgacctttggtgattgccgccacaggccttcccgccggctaactcagcgtgcccaagtcccgtgacttagtgccaggacggtgctgtgacccgttatcccctgtcgggttttacctccccccgggagagctcagccctggatcccggcgggcggcggagcctctctggagcccggacgggacagcccaccagggtctgcttctgtgaggggccgaggcgtcattccgcgaagccttctccttgctgttgccatgtgaagaaggatgtgtttgcttccccttctgccatgattgaagctgctggaaggtacacatcttgggagtttgccctttgaagctcacctgtggaccttttttcctttcgaaaagaagcataagctgcaataaaaatttggtttcaagataacaaagtcagtccccaaaaatcagtattgagagtcactgacattaaatgatgaagatacgaggatggtgtggggacctttactcttcgaagatgagctatacatgcccctgaaaaggctgtctgaagacaggggaaggctggagatggcaactttggcctctgccaagtactcgtgctattttctgtatgtgatactatctgttttgtaactcagaggcaacaccacatacctagcataaggcttgaactccctttggggttatcaattacttacatagccttcctctaagggaaggcttgcaagtggttcatattcgacccttccatgtgataagcattcatgtgggcttcacaatgtaacagaggtacacagagattcttgtaaacagaaaattttataaaactgttaactgatctcactttgaagaagtcttactgactagatgtcatttatcagagtagacaggcttaaaatgcattgcttgtactagactgttgtaatgcatttttttgtttttgcattggtttttaattcatttaattggtttacactcatttttttttttacattccatttttgcatttgtatgccagttaaaaattatgaaatggcacattgtgggattttgtttagctaaattctagaaaaattgaaagataccttttattcgacttaagcctgaggttattcagcacggtgatctctgcatttttgaaaggttgtctcgtcgtttaataaacgtaaataacttaagcacattggaagagctattaaatgagagcaggagattaaaaagacatgatttcttactttatccacctgacaggatagcttgcattggtgattaaccttgcattgttaaattcatttcctaaatatttaggtaagtagttggtttgatcattatttgtaaagtattagtagttgcatgttgaattatcatgttaagatttttagtttgttgttcatgtgatatgaaagataacaattcctaaaactgaatgcatgcatggcttattcagctcaggtcacatacaaagagaaatgtgacgctgcaataaacatagcagagctatctgggtttgaagcaaaaaggctatgacgttaggtatatgcactttacattgtatgtatctttttagttctagtgaactcatctggaatcatgttacagaaaatgattctccaggtccaaacacatttaagtttaatgactgggactactctaacaattgcggctatctcattttgtctcattggttcattagcatagcacccatttaagaacaactacttctaaacacagtaatatttcagaggctataaaataatagagaaagaaaacttaaaaaatcctttgtttgcagccaagaaaatgtgaggatcagatttgtacttgttttgaacaattggaaactgtcacaattgtttttaagatgtaataaatgtatataaaatatgggattctatagtattagccattttgatatcttttgttgaaagaaaaaaccaaaaaaccccatatgttctaagtctcagaaatcaaagaattccac

SEQ ID NO: 865 - DNA, 1126 bp, Homo sapiens
cgccctctgaccccgcagcgtcgtggctagagtagggtctggagagagctcccactgtggcgagtcctgtcgttggattcccgcggcgccccgtaaggctccgccccggcggtgctaccaaaccctgttcgattttagaatcgtacattcccagagggaatcctagacccctcattttacagttgaggaaacaggcccaagtagcatgacttgttcgcgccgctagtcgaaggagcagcagccccgatcccttgactctggggcactgctttccctttagctcatttttggaggaaatgggtgcgcccttgctcgacctttggtgattgccgccacaggccttcccgccggctaactcagcgtgcccaagtcccgtgacttagtgccaggacggtgctgtgacccgttatcccctgtcgggttttacctccccccgggagagctcagccctggatcccggcgggcggcggagcctctctggagcccggacgggacagcccaccagggtctgcttctgtgaggggccgaggcgtcattccgcgaagccttctccttgctgttgccatgtgaagaaggatgtgtttgcttccccttctgccatgattgtaagttttctgaagcctctccagccatgccaaactaattggaaaaaactactttaaagttcatatggaaccaaaaaagagcccgcatcgccaagtcaatcctaagccaaaggaacaaagctggaggcatcacactacgtgacctcaaactacactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgagcaaggacttcatgtctaaaacaccaaaa

SEQ ID NO: 866 - DNA, 1126 bp, Homo sapiens; identical to SEQ ID NO: 865

SEQ ID NO: 867 - DNA, 3222 bp, Homo sapiens
ctcacggcttatctcaacccctcaaatatttaccttaggcagcaaatccagtatcaccaccacgtaagtctaataacatccagacttcaaggaatatacaagaacaatattcaagggaagattagggtgggaaggtgaacgctggggtcaatgtctctaggagtgtcagagattcttcaaaatctttgaaactgcaggcaaaaatgaatcatgtggaccctgttacaagattacagctctccacacctgctctgcagacaacagcttgaaccttatgaaacatgaagttttctctttgagatattccttcaggtcttgcatactcatgaaagtaatgacttgtttgatctgaaagaccctgctgatgccagctggtctgaaggaacccacaggagctgacttaccaaagaatgcggttttcaccttctgatgatttcattcccctgaccccaccaatgaacagcccctcatcctccatgatcctcttaaaaaccccagaattcctcagagagatggatttggaggtctccttccatctccctgcttggggtcctgccatcgctaaactgtctgtcctgcaaattctgctgtctcagtgcattggtctgttactctgcagggggcacaggaacctgttggttccgtaacagcagagcctgccttttcagcccttccttgctcagccaccagatgtaggccacccaggaagtcgtgaccttgggcagggtggctctctgccactgaggctcaccttcaggagctggtggctgaaggcacacacggtcacattccccctagttgggcagcaaagccttccttgaatgagagtcctttccacagctccatgtccaccacaactgtgttctcccttccagaattactctaacaaagtcctccaagaacatctgtttcccttccatggtttgttttctttgcccaaagaatcagggggccatgtttagcttaggttcaaaggacccttctccctcccactggaggttcgtaatcctaatgccagcccaagccagtggaggagagtcttaagtttaataaaatcagggggttttagtattagagtgttttaatccccgaaagagatactatttacttatattttttggaagacataaaataacctacgtgatctgcctgaaatttcattaagggctaagaaaaactagccaagaaaatgggtttgaagagtccatagccaaaaagaaagatggagctttgtgtttgctgcccaagaccagctcctttgataaatcttacatgggtttttcaggaagtacaaaaaagcttaagccaaattaaaaattcattttcctaatgcgagagtcacccaactcttccaggctctagatgagaacttacggcttatctcaacccctcaagctgtaggtatggctttaacttgactcaaatgtgctatttcagaagacgctccaacttttaaagaaaaccaagtctaaagttcaactcaggacctttctcacgaatcatgcacaattgtaatttttagaactaaaatcgcaacttctgaaaataaaagaatttgaaaagcaacaaaccgataaacagagaggcatcctcaccttcttcgtgcaccttctggccttgctgccggcgcagcgggctctgaccgtgctgtgcttctgcgattcaggtcttcacctgatctcaacagctcaccagctggcccttctctccccaattagagattttaccttcacaaacagcgtccttcctaggaccacgctcagaccacccagaagaacgcttgccttttgccttttcaacttctgtgcccttagctccagtttaattcctcgccaagtgtcagaaacaggaaggggaaaaaaaggggtcagctgtcagggcagctttgcgctgggagcattacactctcacggctgttttccccaattagaatgttttctggacggtttgcttgtgaactagggcataacctgttcagctttctccttttggaaaagcccactgattctctctgtgcctgaagtgaagtgttaaaaaaaattccctattgtatatattcaacttttgatacagctctggaaaaattgagcatatactaagaatacagaatgtgatgacattagttccctaagcatatttgtgattaagtagcttataacatcgaaggatcaaccaatagacggctaagatagaaattaacatggtccttgattttaaaaaaaggtttaaattcatttaaaagaaaaaaaatacaaaactgaagactggacgtttccagttttccttcctggagatttaattgagccatctgaaactcatttgagaaactgatctttaaaaaaaaaaaaaaaaaggctttgtgataaagtttaaattttgctcaagtactgctgatgcttattctgctgtctctccaacaagaaatgcccctgctctagaggagagaggatcacaggcaacaacttagaacctggggtttgtggcctcgtgtggtggctcacttcttaagcccagcactttgggaggctgaggtgggaggattgcttgaggccaggagtttgaggccagcttgggcaacatagtgagactttgtctctactttaaaaaaaaagagaaaaaaaaaaaaaggctgggcacggtggctcacgcctgtaatcccagcactttgggaggctgaggcgggtggatcacctgaggtgaggagttcgagaccagcctgaccaatatggaaaaaccctgtttctactaaaaatacaaaaattagctgggcgtggtggtgcatgcctgtaatcccagctactggggaggctgaggcaggagaatcgcttgaacccaggaggcagaggttgcagtgagccaagatcatgccattgcacaccagcttgggcaacaagagtgaaactccgtctcaaaagaaaaaaaaaaaaaaggaagaaagaaagaaaaacggggtttgtggactctataaccaacttctgagtcaacatggggctacttggctacatacattctctcttcatggaacttatggtggtgatcacaggtccagccctccttcaaacagagctcatgaaaatggacagtacccttgccaagtgacttgtatgtattcacatttaagactgagttctttttttttttctttaaaatttcaaggtaataaatatatccatcttgttcaaaagcttctttgtgtccctttgtggtctgtgtgttaagaat

SEQ ID NO: 868 - DNA, 912 bp, Homo sapiens
catatccttaaagaaaaatttctgttggcaagattgccaatgttttggaaaaataaaataaggaaggatggaagtacctgacggcatatcgtttttataaagttttggattatggaattttcctggcttttgagcctcacaagactttgagattttatggatatgaaacctgctatcatttagcatcctgcctctgggaatagaagctggactgtactgctgccatctcggctcactgcaacctccctgcctgattctcctgcctcagcctgcccagtgcctgcgattgcaggcgcgcgtcgccacgcctgactggttttcatattttttgggtggagacggggtttccctgtgttggccgggctggtctccagctcctaaccgcgagtgatccgccagcctccgcctcccgaggtgcccggattgcagacggagtctccttcactcagtgctcaatggtgcccaggctggagtgcagtggtgtgatctcggctcgctacaacatccacctcccagcagcctgccttggcctcccaaagtgccgagattgcagcctctgcccggccgccaccccgtctgggaagtgaggagcgtctctgcctggccgcccatcgtctgggatgcgaggagcccctctgcctggctgcccagtctggaaagtgaggagcatctctgcccagccgccatcccatctaggaagtgaggagcgcctcttcccggctgccatcccatctaggaagtgaggagcgtctctgcccggccgcccatcgtctgagatgtggggagtgcctctgccctgtcgccccgtccgggatgtgaggagcgtctctgcccggccgccccgtctgagaagtgaggagaccctctgcctggcaaccgccctgtctgagaagtgaggagcccctccgccca

SEQ ID NO: 869 - DNA, 912 bp, Homo sapiens; identical to SEQ ID NO: 868

SEQ ID NO: 870 - DNA, 1465 bp, Homo sapiens
ataaaaacgagaaacagaattgtgactaggggaaatattaattatatcattagtaaaatcgaaattttcctaaagtagatgacactcacatttccaaataaaacttctccagacttgtccattctccagaaggtcttaaacctgctttcttttccttccttccttccttccttttctcttttttttttttttttttgagaaaggatacagtgtcatgagaaggtcttaaacctgttttcttttccttccttccttccatctttatctttcttttttttttttttgaaaaaggatgcagtgtcacgattatggctcactgcaaccttgattgaactcctggtctcaaacaatccttccaccttggcctccagagtagctgggactagaggcatgtgccaccatacccagctaatttatttttttaattttgtctgtagagacagggtcttgctgctatgttgcccaggctggtatcaaacacctggcctcaagcaatcctcccaccttggcttcccaaagtgctgggattacagctatgagccattgcactcagccttaaacctgttttctattataacaaaacttaaatataaggaaatattacagttttcataaagatccacacagtactttgaggagtgcaaaaacaactagatttgaggttctaaaggtcttatgaacttgggatatggcactaatgtgacaaaaagcttctaagtatacgatcttgcaagctaatctgcatgtcatgaaacaggaagtttcacaaaccaaattgaaatgcttacatcacacagcttattgagtcaatcttaaacacacaacaaaaatcaacaggaaagagataggtaaattaatacactttgcacagggtataagcacttactgaatcctacttaagccacatgcatttgtcctgaattcctcatgaacattttgtgcctaagtccttctggattagtttgctagagctgccataactgggtaccatgaattatgtggcttcaacaacagaagtttactgtttcaaagttttggagactagaagtctgaagtcaatatgtccacagcattgattcctgctcagagctttcaaggagaatctatcccacatctccatcctagcatctggtggtctgcttgcaatcttttgcattccttggcttctgctacatcaccccaatctctgtcttcatcttcacatgccgttatccctctgtgcatgtctgtgtccaaatttctttttttataaggacaccaagtcatattggattaggagctcaccctactccagtatgatgtcatcttaaccatttacatctgcaacaccactaattctaaacaaggtcacattctgtgatactgggggttaagaccccaatatatgaatttgggggacacaattcaacccataataccttccattccttctttatttatttatttatttatttttttattgatc

SEQ ID NO: 871 - DNA, 1465 bp, Homo sapiens; identical to SEQ ID NO: 870

SEQ ID NO: 872 - DNA, 5240 bp, Homo sapiens
gcgacgaagctgcgtctctcagactgccactcttactcctcgccctgtagcagaaccccaacccccggcctgagactccagggatcggctgagctcgcgggctaacgctgtgaagcctgcccagctaccgtgacgtcacgagacccccgctatctcgttggtggctatttcctctcccgctgtggtccctggagacgccggaggagatttccgtgacaacggcaagctggctgcaacgaagccgcccacgtaggcctccccggcctgctggaggagaggggatcccccggggcagaggcggctacacccggagaacccggaaaccggaagcgcagatcctgccggctctggactagccgctcagcaccagggcggaaggaagacgaggcgaggcaagcgccaagcttccatccggacttcaaggccagtggctgggtctggttttctcaacacggcctcctagtctccttcccgcttgggcatctgtttttcttatatagaccctgaagccgcccgtgatgttctgtaagcaggttccgcttcagaatcagaggtacttaagagggaacctggatgctagacctgcccttgctgctggcctcagtttctttacctgtaaaacagggattttggaactgttaaattaaatcaaacttaaaagaattacaacttaaagctgctggaactttacatgatcccgagccttgagaggaatgtggctatgcagcctgagtcatgtggcatgcagatgcaacctctgcctttttccgctgtaaataattaagaagaccaagtagcatccaagtctcttgtccttctgcctgctgttgtgggatgatgtgtagaggaagatagtcttcctctacacagcaagaagatccctaccagatgcagccctctcaaccttggacttcctgacatccagaactagtcacctaagctgaagattcccttgagaacaagtactgtcctgtggtttcatggcctttcttccatttgtggttcttgccaagcggaatttaaatgacatcttatcaagatggataaaccctagtttcccagtgctggaatatagaaaatggatggacaagtaaatcccactcagcacccatagcccaggcatggggacctcaacacatttgagccgcagagatcacctttcattgtgaatagctctgagatgatacttctggttgaatgtctttttgtcacttccggctggatctaccatgaaagatttctgaatccaggaagagagattgactgggcaacatgttattcagaaacaggaccttgccctgtcactcaggatggagttcagtggtccaatcatggctcattgtagcctcaaactcccaggctcaagcaatcctaccacgtcagtcttcccagtagctgacagggtctcactctgtcgcccaggctggagtgcagtggcatgatcttggctcactgtagtgtagacttcccagcctcaagggatcctcccaccccagactcccaagtagctggaattacaggtctcatgctctcactcaggctgcagtacagtggcacaacctctactcactgcagcctctacctgccaggctcaagcaattctcctgacttagcctcccgagtagctgggattacagttgaagcatatgtcctgtgagcttaggggtgctacaagttgaccactgcagcagtaaagatgattctgaagaatggcatgggatggatcctttcgaatgcacttgagcagcggtctccaaccacagggccacagagctggagctggatctaccatgaaagacttctgaatccaggaagagagactgactgggcaacatgttattcaggagatggggtctcaccctgtcgcccaggcttgagtacagtagtgctatcacagctcactgcagccttgaactcctgggctaaggatcctcctacctgagcctcctgagtagctgggactgtagggtctccctctgttgtccaaggctggagtgtagtagtgctatcacagctgactgcagcctcaaccttccaggctgaagcgatcctcccatctcaacctcccacgtggctgagactacaggcgcttgccactatgcccaactaatatttggaattttcctatacgtggattccagaggggtgacagcgaaacgtgggaccatccagttgcaggaaaacgagcttaacacgcccactgattctacattatgctcctacctcccggcagcctctccaggcccagaactttctccagtcggcctccacagaccaagctcatgactcacaatggcctatttaggcccataccctacctcacggcagtctccgcagatgaggctactgcctcacaacagcctccacaggcacagctccatcgttacaatggcctctttagacccagctcctgcctcccagccttctctctaggccctgaactttctcaagtcgacgtcaccaggcccagctcatgcttcttggcagcctctccaggcccagctcttcctcccggcggcctctgcaggcccagactgtcatcaagtcggcctgtccagggccagctcctgcctcccggcgccctctgcaggcccaagtcgtcctcaagttggcctccccaggcccagctccagcctctcggcggcctctccgggtgcaaaagttcctcgagtcagcctctccaggcccagctcctcctgcctcccagtgcctctttcggcccagcccagctcatgcctctgggcggccttcccaggccccgcttttgacttttggcggcctctgcaggcctcgacaaggcccggcctcctgcctcccgaagcctgcacaggcccagcctctgcctcacagcagactctccacgcccagctagctctcgcctcactgcggcctccccagtccaaagctcctgcctctcggccgcttcggcaggcccagctcccgcctgccagtgcctcttcaggcccatggggctcattcctcacaacggcctttccaggccccgtttttcccttccggcggcctctccgggcccagaacctcctcaagttggcctctccagacccacttgcaccctccgggcgtcctctccaggcccagctcttcctcccggctgcgtctccaggcccgactcctgcctcccaacaacctctttggactcagtgcctgcccatctcctggcggccttggtcggcccacagcttcctcaagccaagctccccaggcccaggtcaggcctcacggtggcctctccaggatcagctcctgccctccgatggtgtctccaggccccaaatggtctccggccagtgggctcctccacgcccagcttgggcctcccggcgacctctgcaggcccaagtcgtcctgaagtcggcctctcccggccctgcctcccagcaagtaagcaagcttttttggcttagctcctgcccagctcccaaccgcctttgtaggccccgaactttctccagccaagctcttcgggcccacctcctgcctcccggtggcctgtacaggcccagctctggctggagaacagcctctgcaggccccgctcttgcctcccaggggcctctccaggcccagctctcgcccccacagcggcctcccggggccaagtccctgccccctgcctcaacaggccaccgtgagggaggagcagggccgcacgcgggctgccggaaggcggacagggacttggccccgggaggccgcggtggggcaagagcttggcctggagacgcccctgggaggcaacagcagggcctgcagacgctcttctccagccagagctgggactgtacaggccactgggaggcaggatgtgggcctgaagagcttggctgcagaaactttggggtctacaaacgccggcgagagctgagccgaaagagcttgcttgctgggaggcaggagctgggccgggagatgcagccaggaggaacagctgggcctgcagaggccgccatgcgggaggcagaggctgggcctcctcaagttggcctctccagacccacttgcagcctcccggcgtcctctccgggcccagctcttcctcccggctgcgtctccaggcccaactccggcctcccaacaaggtctttggactcagctcccccgcagcttccagcggccctggtaggcccacaacttcctgaagccaagctccccaggcccagctcaggcctcacggtggcctctccaggctcagctcctgccctccgacagcgtctccaggccccaaacggcctccggtcggtgggctcctctaggcccagcttgggcctcccggcagcctctgcaggcccaaatcgtcctgaagtcggcctctccaggcccagctccagcctcccggcggcctctgcaggcctaagtcgtcctcaagtcggcctggaaatgggcctggaagagctgcaagtcggcctccccgggcccagctccgtcctctcggcggcctctccaggtgcaaaacttcctcgagtcagcctctccaggcccagctcctcctgcctcagtggcctctttcggcccagcccagctcatggctctcggcggtcttcccaggccccgcttttgacttttggtggcctcttcaggcccagaacttgacctccagtcggcctttgcaggcccggcctcctgcctctcgaaggtctgcatgggcccggcctcggcctcacagcggactctccacgcccagctagctctcgcctcactgcaccctccccagtccaaagctcctgcctttcggccacttcggcaggcccagctcctgcctgccagtggcctctttaggcccagctcattcctcacaacggcctttccaggccccgtttttcccttccggcagcctcttggcctctaatttttttatcttttgtgtataaatcccaaattatggaattttggaatatttccaccattatataaatattttggtaggtaatttatttggagtgagtttctgcaccaagcccgaattttttattttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtacagcttaagttgggagtgcagagggaatggggagaaaaccctcccactgcctgtgtcgaagtgcaggagcccccacccccatactcacctgagtccagcccctct

SEQ ID NO: 873 - DNA, 2798 bp, Homo sapiens
tagtctcttctgtagttgtcagggttctccagagaaacagaaacagaagcaataggagatatatctcttattacattaagtctcctattgcttctgtttctctggagaactctaatacataaaagattatgattagaattatgcttgaagaaggttaatcttataatggcatgcagagcggagctgggcaaggccagaggctaaatatggagccagaaagatactgcagaaagtgagcaaaaaggatgagtggatggcctggggtggaatccgtgaaaaagggcagattgtcagtctcaggaaatcaacaggactgagttctaacttcagctgggctactatgccctggggaatcagaagattctccctaacattggagtccaaagaagaggagccaccatctccttaactacaaaacaactgagagaagaaatgtctccctttagtgccagtgaagagttttgcttctctagaacaactgtttatttttgatcttatgaaacgcgtgacacttgtaactgatttgccttctttttgcttgctgctagaaatctcagaaccaaattcgaggtcatttctgaatgtgctggactacacagcatgaattctgtgtcctctcacctcattcatagatacatttttttattcctacccatcttttcctttccccagattttcctattgctcttttatcatcttgagtaaagaaggttaaactatgaataaaaagtacaatctcaatgacgagtcagggaaaagtaagttttggacttccatttagagccatttataggtcagcaatcttttgtctctgtgtcttctttctgccctgaacaaccaaggcatcctagtcagtctctcttcatctgcataccactttaaagagcccaggggtcttccaagtacagtcactactaagaaaatgtcttcagtaaattttttttttttttttttgagatggagtctcgctctgtcgcccaggctggaatgtagtggcacgatctcagctcactgcaagctctgcctcccgggttcacgccatcctcctgcctcagcctcccaagtagctgagactacaggcacctgccaccatgcccggctaattttttttgtatttttagtagagacggggtttcactgtattagccaggatggtcttaatctcctgacctcatgatccgcccgcctcggcctcccaaagtgctgggattacaggcgtgagcccccgcgcccagccttcagtaaaattttaatgcatgttgcttatcattctttgtattgtaagcaccaatccttaatctgtgctgtggtttttgttcagaaacatttctttaaaaaaatttccccagacgctcagccttcatattctaatctttattattctgaactacctacaaagctaaatataccttgtctacatgcagtgcttatgtaacaatggtgcttattttgttttacattgcttcaacctctgaccagaaacttagaggacagaatgccctgcttttacaaaaaatgtggtgaccacaacggtaaccttatctaattgagaccattttaggaaggaggggaggagatatttttactgcaaagactgagtcataagccttcattttttaccctgggttgtgcagaaactttaaactttctatattatttcatttcttccataccaggacatttatttcctattcagtgacaatcttgatgtcttcatccttcaaactgctctctaacatagtttcaaaatccaagcattaaacattattaatgctcaggggatgaatatgttcattacctttactgtagtgatgatttcctatggcaaaatgttaaatgatgtaaagataaaaataattatcatagttattaatcatagcaataaaactggactacctaaagcacagtttatggtataatatttatgaattaagagcaacacaaataataatgttaattgctcacctacagatgaatgcaaatgaggatataacagagtcgaaataaactaagcaaaggaaacaatgtttcatagctatcgtgttcattattctaaccaaaaaaaagaacacagaaatcagatatatgcaatagggtacactgaaatgattctcaatgattatataaaacatatatacattattttctcaacttcctgaaacatcaattctcttgctcataatgtagttaaatcgtctaagattagcctcatgtgaccatgtttggacttcttaaaaaaatcgcttcaggaacattacattttcatgatcagatagtttcctgaaagtattaaacaaaactaggaaaagtgtttaatagttatttggattacatttcattaaaaatctttacgatctctgttaacagtccagtacatttgaatgttaaggaggaccctgcactgaaggttttataatgctttatctattccaagttatacaacacaaaaattttctcaaacaagcacatgtgactttgcctacatctgcatttaagattctaatgtacatttttttattcttttgtttaaattattaactatcaacactagaattgagcatggtatgtattcagaattatgttcaagtaattagtggctattttgttaataaagatgaagcttcaattgtagatttgataattttaccctaaaatttttaaatatataaaaaatagcattttttaaaactataatggtaaggcaaaatgttctcatcagattcggtgggcagatgggacagggaacacagctttcctgaacctggaactcacagttctgccacgcagctatagcaaaa

SEQ ID NO: 874 - DNA, 2798 bp, Homo sapiens; identical to SEQ ID NO: 873

SEQ ID NO: 875 - DNA, 2795 bp, Homo sapiens
cgcctcccagcaaacactgaccacatcctgaacgaagctaagcactgtgtaatgctaagcagacctgggcccgtaggaaacaagatgccacattcgggacagctgtcagcactcatccaacaccctgccttccactcgtccatccctgcaattagtgaggagtgaggtttggagctgtgccaattcaacctggaatgggaaacatcgagctctgacacccttaagagctaccaagattttgtgatggaaatgaagctgacagttttgtcagggatgtgagaagcagaatcagattcagctagttcctgcggagatgtgctggctctatcaagatgaagataataaaagaatcagaagattctccctaacattggagtccaaagaagaggagccaccatctccttaactacaaaacaactgagagaagaaatgtctccctttagtgccagtgaagagttttgcttctctagaacaactgtttatttttgatcttatgaaacgcgtgacacttgtaactgatttgccttctttttgcttgctgctagaaatctcagaaccaaattcgaggtcatttctgaatgtgctggactacacagcatgaattctgtgtcctctcacctcattcatagatacatttttttattcctacccatcttttcctttccccagattttcctattgctcttttatcatcttgagtaaagaaggttaaactatgaataaaaagtacaatctcaatgacgagtcagggaaaagtaagttttggacttccatttagagccatttataggtcagcaatcttttgtctctgtgtcttctttctgccctgaacaaccaaggcatcctagtcagtctctcttcatctgcataccactttaaagagcccaggggtcttccaagtacagtcactactaagaaaatgtcttcagtaaattttttttttttttttttgagatggagtctcgctctgtcgcccaggctggaatgtagtggcacgatctcagctcactgcaagctctgcctcccgggttcacgccatcctcctgcctcagcctcccaagtagctgagactacaggcacctgccaccatgcccggctaattttttttgtatttttagtagagacggggtttcactgtattagccaggatggtcttaatctcctgacctcatgatccgcccgcctcggcctcccaaagtgctgggattacaggcgtgagcccccgcgcccagccttcagtaaaattttaatgcatgttgcttatcattctttgtattgtaagcaccaatccttaatctgtgctgtggtttttgttcagaaacatttctttaaaaaaatttccccagacgctcagccttcatattctaatctttattattctgaactacctacaaagctaaatataccttgtctacatgcagtgcttatgtaacaatggtgcttattttgttttacattgcttcaacctctgaccagaaacttagaggacagaatgccctgcttttacaaaaaatgtggtgaccacaacggtaaccttatctaattgagaccattttaggaaggaggggaggagatatttttactgcaaagactgagtcataagccttcattttttaccctgggttgtgcagaaactttaaactttctatattatttcatttcttccataccaggacatttatttcctattcagtgacaatcttgatgtcttcatccttcaaactgctctctaacatagtttcaaaatccaagcattaaacattattaatgctcaggggatgaatatgttcattacctttactgtagtgatgatttcctatggcaaaatgttaaatgatgtaaagataaaaataattatcatagttattaatcatagcaataaaactggactacctaaagcacagtttatggtataatatttatgaattaagagcaacacaaataataatgttaattgctcacctacagatgaatgcaaatgaggatataacagagtcgaaataaactaagcaaaggaaacaatgtttcatagctatcgtgttcattattctaaccaaaaaaaagaacacagaaatcagatatatgcaatagggtacactgaaatgattctcaatgattatataaaacatatatacattattttctcaacttcctgaaacatcaattctcttgctcataatgtagttaaatcgtctaagattagcctcatgtgaccatgtttggacttcttaaaaaaatcgcttcaggaacattacattttcatgatcagatagtttcctgaaagtattaaacaaaactaggaaaagtgtttaatagttatttggattacatttcattaaaaatctttacgatctctgttaacagtccagtacatttgaatgttaaggaggaccctgcactgaaggttttataatgctttatctattccaagttatacaacacaaaaattttctcaaacaagcacatgtgactttgcctacatctgcatttaagattctaatgtacatttttttattcttttgtttaaattattaactatcaacactagaattgagcatggtatgtattcagaattatgttcaagtaattagtggctattttgttaataaagatgaagcttcaattgtagatttgataattttaccctaaaatttttaaatatataaaaaatagcattttttaaaactataatggtaaggcaaaatgttctcatcagattcggtgggcagatgggacagggaacacagctttcctgaacctggaactcacagttctgccacgcagctatagcaaaa

SEQ ID NO: 876 - DNA, 1608 bp, Homo sapiens
ggagaagacaagctagggggaggggcagggagcagtggggaggcaaaaggagagccagggcagggggcatctgggagagcctgctgagcagcccaagggagtgagctgtgaggggtcaggggaagagaggcagcttggccaaggcccccgaggcagggagtgcctggtgtgctctggggagagagaaagcaaatacgatgatccctcctcctccattcctctcttccctggcaaccggctcagagcttggagactcaaaaattgattcgctctgaatttcctaagtttatctattaactacctaacaggccattcgcttgttcacagtgtgcctctcggcagaaggcatccgccagctgacagtgatgcccccgcgagcggtcaggccacacacaccccaggatatagtcgcttgctggcgactggggtaccactggatggagtcaaggacatatcaagggagatctccatgtttgaaaagagacaactccccaaaaatggaagattcacgaggctgaatacaaaatgtgagacctcttcctacccaacaaacggtcgacactgacaacccatcaacactgacaacctgccaacctgaggaatggcagcacccagggaaaggggcggccccaacgctgctgtgtgagtggacactgcagggagagtggcggcacctgcaaagacagaagactcgaggaccctcctcggcagccccactgccagggacacaccctaaagaaactctcacacctgcgccccagacgcattcagggcccgggccgtgacggtgctggccacagtgtgctgagtgacaatggaacacaggagacaacctagatttccattgggatgggggcacgcaggacagtgttcacactacaggtcgccacgcagcagcctgcgatcaaacacatcgacgagcacaggtgtcaacaagactgttgagtgaaaagtacaagttccaggttttttatgtaaagttaagaaaaacacccacacaaaacaatcctatatattagttatggatacttatatccatgtgtaaatgtacccgaaagagcctgggaggaaaaatacaaaagcagtagttggaaggaaatgggttacttaatatttctttgtaatacttcttataatttttttaaaaaaggacttaaagccaaaatgacaaaagagtaaccattttcaattctgtgtagaagagatactgtgttcattttattatttctgggatttttctggatttttaaagtttatccaatataaaaaaaataaaaactgcactgttggctgggccatgccgggctgagggcttccttgccttgctctgtacctgctcccacatgggccaccaggctagtgtctgtgagccctgccaggctgagcagggaagggcacacactccctatagagctgggcagggcagggccccagaaagcggcccctcttggctggctgaccctgctgcccaggcctctggggaagattcgggagcagagacagcagaaaaggatggggcaagggaggggaaaggccagtggcctcgtcacacatgagcagctgtgggcctgaggccaagcccttcctttgggcagggagctcagcgcc

SEQ ID NO: 877 - DNA, 1717 bp, Homo sapiens
ggagaagacaagctagggggaggggcagggagcagtggggaggcaaaaggagagccagggcagggggcatctgggagagcctgctgagcagcccaagggagtgagctgtgaggggtcaggggaagagaggcagcttggccaaggcccccgaggcagggagtgcctggtgtgctctggggagagagaaagcaaatacgatgatccctcctcctccattcctctcttccctggcaaccggctcagagcttggagactcaaaaattgattcgctctgaatttcctaagtttatctattaactacctaacaggccattcgcttgttcacagtgtgcctctcggcagaaggcatccgccagctgacagtgatgcccccgcgagcggtcaggccacacacaccccaggatatagtcgcttgctggcgactggggtaccactggatggagtcaaggacatatcaaggtgttgttacaacatggcccagccctagctgccatctccgccaaaaaaggaggggcccatgaacccctgaaatgaaatccaaaacctcgtgggagatgctttcttctagggagatctccatgtttgaaaagagacaactccccaaaaatggaagattcacgaggctgaatacaaaatgtgagacctcttcctacccaacaaacggtcgacactgacaacccatcaacactgacaacctgccaacctgaggaatggcagcacccagggaaaggggcggccccaacgctgctgtgtgagtggacactgcagggagagtggcggcacctgcaaagacagaagactcgaggaccctcctcggcagccccactgccagggacacaccctaaagaaactctcacacctgcgccccagacgcattcagggcccgggccgtgacggtgctggccacagtgtgctgagtgacaatggaacacaggagacaacctagatttccattgggatgggggcacgcaggacagtgttcacactacaggtcgccacgcagcagcctgcgatcaaacacatcgacgagcacaggtgtcaacaagactgttgagtgaaaagtacaagttccaggttttttatgtaaagttaagaaaaacacccacacaaaacaatcctatatattagttatggatacttatatccatgtgtaaatgtacccgaaagagcctgggaggaaaaatacaaaagcagtagttggaaggaaatgggttacttaatatttctttgtaatacttcttataatttttttaaaaaaggacttaaagccaaaatgacaaaagagtaaccattttcaattctgtgtagaagagatactgtgttcattttattatttctgggatttttctggatttttaaagtttatccaatataaaaaaaataaaaactgcactgttggctgggccatgccgggctgagggcttccttgccttgctctgtacctgctcccacatgggccaccaggctagtgtctgtgagccctgccaggctgagcagggaagggcacacactccctatagagctgggcagggcagggccccagaaagcggcccctcttggctggctgaccctgctgcccaggcctctggggaagattcgggagcagagacagcagaaaaggatggggcaagggaggggaaaggccagtggcctcgtcacacatgagcagctgtgggcctgaggccaagcccttcctttgggcagggagctcagcgcc

SEQ ID NO: 878 - DNA, 3151 bp, Homo sapiens
ccatgagctccttgtacagatgccggagggcgggggccatgcccttgtctgcaccgggacagagaggagaggacatgtgaggcttatgctgaattgagggttcccagccgagcccacttcccccacaaggggctccactctgatggatgggggctaccgtgctttcccagggctctctggagggagatttcattccaggatgaaatctcttttctgtatctccttcctttcttcaaaagtctcagatcccaaccctttctttgggctagaatatttttctctgttcttaaattatgaaccctaaatattttcttcctgttttttttttttttttttttttgagttggagttttgctcttgtctcccaggctggagtgcaatggcgcgatgtcagcttactgcaacctctgcctcctggatgaaccctaaatattttctttcttcttctttttctttttttttttttttcagacagggcttccctttgttgcccaggctgaagtgcagtggtacaatcatagctcactgcagcctccagctcctgggctcaagccatcctcccacctcagcctcctgagtagttgggactacaggtatgtgtcaccacatctggctaatttgtaaatttttttgtagaggcaggggtctccctgttgctcagtcttgtctcgaacttctggcctcaagtgatcctcctgcctcaatcttccaaagtgctgaaattacagtcataagccaccttgcctggccttagttttttttttcttttcctttctttctttgtttctttgtttctttctttctttctctctctctctttctttctttcttcttctttctttctctctcttctctctctctctctctttcttttcttttttttgacaggtctcactctgtcacccaggctggagtgcaatggtgtgatctcagctcactgccacctccacctcccgggttaaagtgattcttgtgtctcagcttcctgagtagctgggattacaggtgcaccacctcatcagactaatttttatatttttattagagacggggtttcaccgtattgcccaggctggccttgaactcctagccttgggtgatcctcctgcctcaaactccgaaagtgctgagattacaggcatgaggcactgtgcctggccttagatttttttcctatagtgatggctatgctaagtatttcacaagtgtaattccatgaattcttttattttttttttttgagacggagtctctctctgtcgcccaggctggagtgcagtggcacgatctcagctcactgcaagctctgcctcctgggttcatgccattctcctgcctcagcctcccgagtagctgggactacaggcgcctgccaccacgcctggctaattttttttgtatttttagtagagatggagtttcactgtgttagccaggatggtcttgatctcctgacctcatgatccgcccgccttggcctcccaaagtgctgggattacaggcgtttgagccaccgcgcccggctcatgaattctttaggacagcaaataatcctcattttgtagatgggcaaacttaacgaggttaagatcacacggtggtgaataagcggtaaatctactggtcagacacccttggagattcaagggtccagtgacttggagtgtagtgggaagaagatggggtggcccctgcagcacagctgtatggggcttggctcggctaagccagagccagcctttccttggcttctggtaggtctgttctgcatgccacccacctcccctggtgtcccgtggctcaccatcaatcttgaatcccatagctgcttgaatctgctgctgggtttctcctcctgttgtcagctggagcatggccaacaccgaggccaccccatagggtgagaaaaccacgttgcggtccttggagggctggagacatctgcatcctagagcaatggaaagagggctggtgaaggaatcgttctggaagacaggcgggaggggaggggagctggccagctgtgggccctgctcttcttgtttcctgcaagcaggtggtaagtgaacactagggcaaggtgcaggaagagaccatgacatgttcaggttctaagcccatcccactccgtctcactcagactgacttatccccgggcagtggcagggagtcttcgcccatcttgccctgtgggaatcttggaatccagtccatctcccttccctctgtgtcccgtaaaaaagccttagaagaaaagcaggtgagaagtcattaccactctctgcctttgcagcccagggggaatttagcccagactcaattatcaattatcacaacatctttgatttgcataagctttaaatttgctttcttttcttttctttcttttctttctttcttcctctttcctctttctttctttctttcttctttacttccttccttctttcctctctctctttctctctctttcttccttcctttcattcatttttagagacagggtcttgctctgtcacccaggctgggtgcaatggctcagtcttggctccctgcagcctccgcctccccagctgaagcaatcctcccacctcagcctcccaagtagctgggaatacaggcacaccagcacgcccagctaatttttgtatttttttgggagagcagggttttgccatgttgcccaggctggtctcaaactcctgggctcaagttatctgcctgcctcagcctcacaaagtgctgggattacaggcatgagccacagtgcccagccttaattctcttaatgctttcccagcgattgtttcattcaagttagcaggcatgaggtgggaaatgggtaagtgtcttgatgcagagggactgagagagtcaaggttcttgttactgggtgatggggttgttggtgacgcctgaccatcctccctgctctcctgcagtcacccctagggcagggtcgacccaaggctgcaggtccgaggaaaagaaaatagaggaatagcgggggatcatggagggaggagattctggggaggcgagttctctgccttaagcccgaagtaagaggttggagggagtttgcttttctcctacctgaagttctcagaggtgccttgcgattggcggttcgtcctgctctggcggcggc

SEQ ID NO: 879 - DNA, 1968 bp, Homo sapiens
cgcggctctgcgagtactgacacaaatccccagcataaaaagtgaaaaatgcacacctttgtggaaaagtgtgaatagtctgctcccatttctattagcaaacacacctgtgtgcacactgagctttctgtccagtctggaaggggagggcggggccttcccgggagtgaaggggatggggccgacccggaccctccagggaacgcccttgagtaactcccgcacttgggaccccgtttccacccaggaccacaggctcaagatggcctggtagatgcagccggcacgcgcctctcctccgacgggaacagaaggagccggtaggttttcacacttgcagcagatccgctaagagaacgagggattcagccgagaagccactgggagcccgaggagtggagcagaggcacccaggcagcctgcgcggagaaatcggatcggctgggacggcctgcagcccccgcgcgcggggaaagggaagaagtcctcccctacaaagcgaattcacaaacggaagaagtgactgttccacaggatgcgcagatctcaacggaaggacccaggagacatgaaaaagcaaggaaatgtgacgccttcagaagaaaccagtaattctccagcaacagatccccatccaaaagaaattcaggaaagctcaaacagagaattgagcagagaattgaccggactgattgtaaagaaggtcatcaacatggaagagtcttttgaacaacaacataaagaaatgaggaaaagaggtggggagatatatgagatgattacctgccagaaagaggttttaaaattcaacagaagagtatttctggaactgaagaaatcattggatgaaatacaaagtacactcaaaagcttcaatgatagactagaacaaatagaagaaaaactctcagggcataaaatctgaagcatttttctcactttaaagattcatgggttgtactctggccattaatgtgaacaaaacctgctgggaccataggctcaagatggcctggtggatgccgccggcacgcgcctctcctctggcgggaaccgaaggcgccggtaggttttcacacttgcagccgatcggctaagagaacgcgggattcagccgagaagccactgggagcccgaggagcggagcagaggcacccaggcagcctgcgcggagaaatcggatcggctaggacggcctgcagcccctgcgcgcggggaaagggaagaagtcctcccctacaaagcgagttcacaaacttggaagaagccactttcacaggatgcacagatctcaacggaaggacacagaaaacatgaaaaagcaaggaaatggggcgcctccaacggaacccagtaattctccagcagcagatccccatccaaaagaaacagaagacattttggagagagaattgaatatacatattatacagttgtgggcataatacaagcatcatttggaaaagaacagagaaaaaagatggaaggagttaccgtactgcaggaaaaaattatcaactccagtgatattattaaatacaacctaacgacacttctgaagctgaagaaatcactggatgaaatacaaagtaaactcaaaagcttcagtgatagactagaacaagaagaagaaagactctcaaaacttgaaatctgaagcatgtttcttaaagatttaaagggttattatactctggccattaatgtgaacgaaatctgctgggttaattcttatactggggtcttggataatcattaaagtgaaatgagaataatttctttttgagatgatcaattttatgaggtcgattttttttttttttttttaatgagactgagtcttgctctgtcgcccaggctggagtgcagtggcatgatttcggttcactgcaacctccgtctcccaggttcaagagattctcctgccttagcctccagagtagctgggactacaggcgtgtaccacca

SEQ ID NO: 880 - DNA, 3877 bp, Homo sapiens
aggagttcaggaccagcctggccaacatggtgaaaccccgtctctactaaaaatacaaaaattagctgggcgtggtggcgcttgcctataaacccagctactcgggaggctgaggcaggataattgcttgaccctggacccgggttgcagagagccgagatcgcgccgctgcactccgtctcaaaaaaaaaaaaaaaagtgaaaaatgaacacttttgtggaaaagtgtaaatagtctgctcccatttctattagctaacacacctgtgtgcacacggagctttcagtccagtctggaaggggagggcggggccttcccgggagtgaagggggcggggccgacccagaccctccagggaacgcccttgagtaactcgcgcacttggggcccgtttccacctaggactacaggctcaagatggcctggtagatgcagccggcacgcacctctcctctgacgggaaccgaaggagccggtaggttttcacacttgcagcagatccgctaagagaacgcgggattcagccgagaagccacggggagcccgaggagcggagcagaggcacccaggcagcctgcgcggagaaattggatcggcggggacggcctgcagctcccgcgcgcggggaaagggaagaagtcctcccctacaaagcaaattcacaaacttggaagaagcaatttacacaggatgtgcagatctcaatggaaggacacgggaaacgtgaaaaagcaaggaagtgggacgcctccaaaggaacccagtaattctccagcaacagatccccatccaaaagaaattcaagaaatgtcatatagagaattgtggaaactgattttaaccaagattagagggattcaagagacttctgaaaaagaaagtaaggaaatgtcaacagcaattctggatatggttgaggtatttaccaaccagatacagagttttccagagcacatggcaaatgtggaactgaagaaatcactggatgaaatacaaagtatactcgaaagcttcaatgatagactagatcaagcagaaaaaaaactctcaaaacttaaaatctgaaggcttttactcaattcaaatatttaatgggttgtactctggccattcaggtgaacaaaatctgctgggttaattttttttttttttttttttttgagatggagtctcgctctgtcgcccaggctggagtgcagtggcgggacctcggctcactgcaagctccgcctcccaggttcacgccattctcctgcctcagcctcctgagtagctgggactacaggtgcccgccaccacacccggcttattttttgtatttttagtagaggtggggtttcactgttagccaggatggtctcgatctcttaacctcgtaatccacccgcctcggcctcccaaagtgctgggattacaggcgtgagccactgcgcctggccttgggttgttatactggggtcttgaataatcattaaaggtgaaatgaaaataatttccttttgaggtggtcaattttgtgagatggattcttgttaggcagctgtcatggaaagatgatttagttcagttgacattaataatacgcatggtaatcctaacaggtgaatgtggttcaaactaaattgccagggaattgtcatggtctagaaaagccactctctccagtagactgctcacacagctacatgtcagccctcctcactgtgaaagtgacagacaccctagcatttttattcatctcccttaggtgcctcaactttttctcccactctcagctgaaaagagctacatctaccatttcatctacttagtgtattttcttattggctatgttaaaaaattacaaacataacaattatgaatgaaaaataactccatggctgggtgcagtggctcacacctgtaatcccagcactttgggaggctgaggcgggtagaccacaaggtcaggagttcaagaccagcctggccaagatggtgaaaccgtctctactaaaaatacaaaaattagccgggtgcagtggcaggcacctgtaatcccagctgcttgggaggctgagggaggagaatcagttgaacccggagggtggagattgcagtgagactctcaaaaaaacaaaacaacacaaaaaaatctcctaagatgattaaaacaaacttgcttctacaataaaccgtaaactcaccgtatctagtgattctgtacattaaatcttttgaacatgtttaccaatttggtgttatgaaaaattttttagaggttgtgtatgggctgggcacaatgactcatgcctgtaatcccaccactttgggaggctgagacgggcggatcactcaaggacaggagttcgagatcagctggggcaacatggcaaaaccccatctctacaaaaagtacaaaaattagccaggcgtgcactaattagtgggctggaccattactggtgtgtgtatctctagtctcaactactcagaggctgagctggcgagatcagtggagcccaggagattgaggctgctgtgagctgtggtcatgccactgcactccagccgggatgacagagtgacaccgtgtctcaaaaaaacaaaaaacaaaaaattgtgtctgtactccactttccaactggatatagtgtccatatcaaggtcatctaaataaatataatgttttggagagagttgttttttttttttttttttttgtgacggagtctcgctatgttgccgaggctggagagcagtggcgcgatcttggctcactgcaacctctgcctcctgggttcaagtgattctcctccctcagcttcctgagtagctgggattacaggtacccgccaccaggcccagctaattttttgtgtttttagtagagtcggggtttcaccatgttggacaggctggtctcgaactcctgaccttgtgatttacctgccttggcctcccaaagtgctgggattacaggtgtgagccactccactcggcacttttttcttttttttgagatggagttttgctcttgttgcccaggctggagtgcaatggcacaatctcggcttactgcaacctccgcctcccaggttcaagcgattctcctgcctcagcttcccaggtagctgggattacaggcacgtgctaccacgcccagctaatttttgtatttttagtagagacggggtttcaccatgttggacaggctggtcttgaactcctgacctcaggatttccacccgtctcagactcccaaagtgttgggattacaggcgtaagccactgcacccggcctccaggctcaagcaattcttatgcctcagccacatgagtagctggtattacaggtgtgtgccaacatgcctggcgaatttttgtatttttagtagagatggggtttcgccatgttggccaggctgttcttgaactcctggcttccatcagttctcccatcttagcctcccaaagtgttgggattacaggtgtgacccactgcaactggccaggcacttcaatttttttttttttgctctgtcaccaggctggagtgcagtggtgcgatctcggctcactgcagtctccgcctcgcgggttcaggcaattctgcctcacccttctgagtagctgggactacaggcatgccccaccatgcccagctaatttttgtatttttagtagagacggggtttcaccatgttggccaggatggtctcgatctctggaccttgtgatccgcctgcctcggcctcccaaagtgctgggattacaggcgtgagccaccacgcccagccaggcacttcaaattttttgtctctgtgtgtctgcgaataactgagaaagtgccacagtattgatttgggggttacaaacatattttagtgagtaggc

SEQ ID NO: 881 - DNA, 3877 bp, Homo sapiens; identical to SEQ ID NO: 880

SEQ ID NO: 882 - DNA, 3877 bp, Homo sapiens; identical to SEQ ID NO: 880

SEQ ID NO: 883 - DNA, 3877 bp, Homo sapiens; identical to SEQ ID NO: 880

SEQ ID NO: 884 - DNA, 1064 bp, Homo sapiens
ctttggagagttgtgaggagataagtgacataaactggcatgttctgaaagaatcactctggatgctgtgtggagaaaacactgaaaagtctttatagggggagaataattgactccattcaagtgttcgctcctgtttcaatcaactatggctgaagagtgaggagacatttggaataaatatggcttctgggggcccattcctatggatcagcagctggcttctggaggcccattcctgtgaatcgtcgatctcatagaagataatattgttagaaggcttacctcattgatgctgaacatcctaaaaagcttctgctgctttgagtcactgaaaaagaccaagaaacatgaatttaaaaaaaaatttcaaatgttataaaataaataatatgaactcattatacctacaatgaataatttaaattcttctttggtagtccaggtaaataacttctcaaatagatttttttaagcatctgtataagttcaagatgtacatcacttcatgtagaataacatctcctaaaaagaactgaaatgcctcagtatacaaccagctgacctggctatcaaacacttatttagcacatattacatgatggacactttgatgtagatacggaccttgggttgtgtcctcaaggatcatacagtgggttgaggaaataggatatgctatccataggaaagtaaataataatatgacagcttattttcaatgagaagtgaatagtacaaagaataggagttgccagatttcaaaaggaaagagctatcacacagaggcggaacaattagaaatttttcatgaaggaagtgttctttgtgctggacctttgagaaagtatagaatgtagattagcaaaaaggcatggaaaaggcatgataggtaggagaggcaagttaggcaaaggtccattagaattgctcaagatataatagaccaacttggcctgaaaaaggcctggaagtatcctcttttgtgctctgtgagaagtttgccaccatgtaaaaagtctaactaccctaaggcaaccatgctctgagaagcccaacctatc

SEQ ID NO: 885 - DNA, 695 bp, Homo sapiens
cccacacacaagaacttccaaacgcctgaaccgcagcagccaggcattcctccagaacctcctctcccaggagcttgctacaagtgtgggaaatctggccaccgggccaaggaatgcccagagcccgggattcctcctaagccgcctcccatctgtgtaggaccccactgaaaatcggactgttcaactcacctggcagccactcccagagcccctggaactctggcccaaggctctctgactgactccttcccagatcttctcggtttagcagctgaagactgacactgcccgatcgcctcggaagccccctagaccatcatggacaccgagattcaggtaactctcacagtagaagggttcctccaaatctctctccaaatatttgttatctactcattcaatacccttcttcaaccatcctcttgctttggaattgacatgaaccaactaggcccgccttattggtaggaattcatttgccctgcctgccagcccccatagagacagaaccattgcctagtgaaagaagattttaatgacgtgatgaaaatattttagaaagcaccttgaagattagtatttttatgtaacttctgttggagagatgtcttcaggagactgaagtagaagagcgactgtcaaaatggaaagttgagtgtacgctatgcttattcttagagggattaattacc

SEQ ID NO: 886 - DNA, 5210 bp, Homo sapiens
agaacttccaaacgcctgaaccgcagcagccaggcattcctccagaacctcctctcccaggagcttgctacaagtgtgggaaatctggccaccgggccaaggaatgcccagagcccgggattcctcctaagccgcctcccatctgtgtaggaccccactgaaaatcggactgttcaactcacctggcagccactcccagagcccctggaactctggcccaaggctctctgactgactccttcccagatcttctcggtttagcagctgaagactgacactgcccgatcgcctcggaagccccctagaccatcatggacaccgagattcagagattcattaagtttaagtggtctcttgtcgattgcaaatatcctgggagttgcatcgtcatctgtatcttcctcctccaggacttggactgtgcaccaactagatgctgaaggctataactgcagccctaataaacaactttgaaaattgtggcagaccttattaaaaaaggggagcaggagccacggtagctcaggctggttgccctggcactcagggagggttcctccaaatctctctccaaatatttgttatctactcattcaatacccttcttcaaccatcctcttgctttggaattgacatgaaccaactaggcccgccttattggtaggaattcatttgccctgcctgccagcccccatagagacagaaccattgcctagtgaaagaagattttaatgacgtgatgaaaatattttagaaagcaccttgaagattagtatttttatgtaacttctgttggagagatgtcttcaggagactgaagtagaagagcgactgtcaaaatggaaagtcccagagacatccaatttatgtaaatcaacatcacctgaattcagaatctcatccagatttcaacaaagacttctgaatgccaacaaagaagaggactgaatttacagactctcactctaacaatatatgctgttcaatttgaaaacagaataaaattattttggcagaaactgatttttaatgacatatattgtttaaatgtacaactttttatttttacacatttgtggtaaaaacagtgaataaggaaaagcaaaggaaatatatcaatatggaagttttacttaatttgttcataaactaaccagaggcaaacaattttagtacttcacttattttttgtattatgttgattttgtgtttgatatggccaaaaatacctttctgatcaaaattatatattgatagaaatgacttatgtaggcaaagttttcatttttactgttacagacagtgtgtttgtatatttttacatgctgttcaataatttttagccatgttgatctcaatttcatttgactcttttagtagtgtccaccatcatttcagactattgaatatataagagactcctgagtataaaagtccttgcccaaataagaaaaggttgtggaacagaagagagaaaaacacatttgtgtgcactcaatcatctcttcttctttcgactcttttaatactgatataaccactatttttaacccttaatggatatgcaagcagaaccattttcctacttgttacgctaccatttttgtctcttcctgaaccataggagctagggatttagatgccatgtaagtgacaacatgagtgcagaagacacaccctgggaaccagcacaggtgtgtagacaacacagattaatctcaggtacctgttagacagaggtgttctctccacacatctgatctgaatcgtgctgagttcttgtatactaccttgatggcttcctgatacattggcatttgggatgcgaaaagtttttttgtgtcgtcgtgaacagcaggtgctggtgactccttgttgtgaagacagtgaaggactgtgacttgaaggacgattaacagttgcaacttccatgcagctttcttcaaagacttgttcgtccacaaactcgtgattctgttccacagttgtaagtaaatgaagaaacagagaagcacatttttaaaaacgaaatacatagctttatttttaaagctcaaatctgcccaagtatagttagacttgatacaatggttaaataaaaccattttcataaagattgacatcaaaaccacttctttttggcatttatgtggaactatctctgtagttaaacctagagattgacatctgtaggctgatttagtgtccctttatagactaactttatcttgaaatatcatttatttatttaaacataaaatctggaaggtatatgataaggaaaaaaaaaacctaaaaaatgcatatagataaaacccacagggaaattagaaattcccactgactttattttttaaaaaggttgaagttatggaaaatagattattttaataggatgccccaagttagattgtctgttatatattagcaaatcttttcacatgggagtgaaaacatttctaaattagaaaatgagacccctaagacactatccatttctttatatgttcctctaaaaatgcccagtacagaaaaatatgacttattcgttacataagtaaaatataattgtctgccgaatgtgtcactctgtgttcgacccagaagggattagcattgaacttttgtggccttttttgtaatcttcgtaatacatcactggcatcactggctgtactcatgatctctgtatgcatttggggtttttccgtcactatttcctaacttccagcccagtagcaaatagcaataggcatcatttcgcatatcgtattttatagaaacatggtatcaattttgcttttaaaatgtttgacaaaaaacctcctgaaatgcctatggaagaatttcacctcagaaatataaaggaaaacatttttggtctgaactactagagaatgacctcaattactattttgtttttctttgcatgggtggggatagtcttataatggaaggctttgcacataccaaattccacttaaccatctctcatcctaaaatatgagtaaaacaattgaagcaagacactggctaataagaaatagattatgttttagctactcgttttgtcatttctttgctgagacaagcattttgaaataaatgaaatttaacattctactctttaaagtctagagaataatataatcagacaagacagaatttcaaagaaatatttgaaattaatatttcaaatattaaatttcaaagaaaaaatggtgcacaaaagattcacaatctgtttccttctcttacaatgcatggtttcacatacctaagttataatgcatgagattctaatttgtctcatcagtgattgaaagtgcaggagtcattctgttattagttactacatacttttgtaggtagcataatttatattagttggtgttagtgatttttgattttaaaaaaagccctcaaaaaaggaaaatacagggaacagaaaagataggaataaaaatattttatttatttatttatttattgagacagagtctagctctttttgcccaggctggagtgcagtgacactatcttagctcactgcaacctctgcctcctgggttcaagcaattctcctgcctcagcctcccgagtagctgggaatacaggctcccgccaccatgtctggctaatttttttgtatttttagtagagacgaggtttcaccatgttggtcaggctggacttgaactcctgacctcagttgacccgcccaccttggccttccaaagtgctgggattacagacgtgagccactgcgcctggccaacattttattattaatgtatcatttaactttcaaatttatcctactaggttacagacctgtccatatctttatttaaaaatgcaagtataatcatgttactaccttgtttaaaacatttaaatgatttccatgaactaaagatcaaaattgtccacatggctgcaaagcctaacattatctggacactgcctttcccttcagctcctcttttgccatgctacactctcttcttctgaccactcttaaattatttcacttcctcctaggctgagttctttccttcttcaggtacttgtatcacctgttagccccttcattgctctgcctagctaactcctagtcaccctgcaggtctccactcaagttcctccaggaagccttgcctgacctgtcccctcatggctctgccctctttactctcttgactgtggcaccgttgttgctttccatgttcgctgctcttttccagtaacagccctgtctgggattttgttttataaacagaggctaaatggtagcagaggccacacctcatttcatggcgtttcttgggtctggctcactcttgggcacataataggcaagtagtaaatatttgctgaatgactctattggtaaataagtacatgaacaggcaatactttggaactgagaatacaaatcatgtgtcacccgagagtgagtgagctgacatgatccaaatatggtgaagattttgttctgctctgtgattatcatagattatgactcctatttacaaactggttaagaaattggtagatttgccaatgaggaggtccaaacaagagcttgtaagtggagaaatacagactcactccttagcacccaagggcataccagtgattacatgagtcatttttctaatgagaatagtttctattatctatctctattcattatggttgtgaatgaaacaaatgcttatattccattgttctctgttttttgttattgctattgctattctcttgatctagatgctagggaccctcgagcaccattaatttttttctgtctaattcgcattttaagaatcacagaaaatgatattgtgtaggatttactattggaagaccactcttcatctgcattaactgacttcttagactagagttaagacagcagctaagaataaaacattttaaataagtttctaaaatactttccaaattgaaatgtcattacatctttcaaagtaatttcaaatattgtggggttttggtttgtttgttttttagcatgttttccagtaatgcagacagtgaaatcacactcggaagcattaagtatgcacaaaagcaaatggaattactgtcagagagcaagggaaggcagtcatgctgtctccttaccgtggttttttccaggcagtgaagcaggtggtggtgctgggtttcaaagctggagccgg

SEQ ID NO: 887 - DNA, 4908 bp, Homo sapiens
cccacacacaagaacttccaaacgcctgaaccgcagcagccaggcattcctccagaacctcctctcccaggagcttgctacaagtgtgggaaatctggccaccgggccaaggaatgcccagagcccgggattcctcctaagccgcctcccatctgtgtaggaccccactgaaaatcggactgttcaactcacctggcagccactcccagagcccctggaactctggcccaaggctctctgactgactccttcccagatcttctcggtttagcagctgaagactgacactgcccgatcgcctcggaagccccctagaccatcatggacaccgagattcaggtaactctcacagtagaaggtaggaattcatttgccctgcctgccagcccccatagagacagaaccattgcctagtgaaagaagattttaatgacgtgatgaaaatattttagaaagcaccttgaagattagtatttttatgtaacttctgttggagagatgtcttcaggagactgaagtagaagagcgactgtcaaaatggaaagtcccagagacatccaatttatgtaaatcaacatcacctgaattcagaatctcatccagatttcaacaaagacttctgaatgccaacaaagaagaggactgaatttacagactctcactctaacaatatatgctgttcaatttgaaaacagaataaaattattttggcagaaactgatttttaatgacatatattgtttaaatgtacaactttttatttttacacatttgtggtaaaaacagtgaataaggaaaagcaaaggaaatatatcaatatggaagttttacttaatttgttcataaactaaccagaggcaaacaattttagtacttcacttattttttgtattatgttgattttgtgtttgatatggccaaaaatacctttctgatcaaaattatatattgatagaaatgacttatgtaggcaaagttttcatttttactgttacagacagtgtgtttgtatatttttacatgctgttcaataatttttagccatgttgatctcaatttcatttgactcttttagtagtgtccaccatcatttcagactattgaatatataagagactcctgagtataaaagtccttgcccaaataagaaaaggttgtggaacagaagagagaaaaacacatttgtgtgcactcaatcatctcttcttctttcgactcttttaatactgatataaccactatttttaacccttaatggatatgcaagcagaaccattttcctacttgttacgctaccatttttgtctcttcctgaaccataggagctagggatttagatgccatgtaagtgacaacatgagtgcagaagacacaccctgggaaccagcacaggtgtgtagacaacacagattaatctcaggtacctgttagacagaggtgttctctccacacatctgatctgaatcgtgctgagttcttgtatactaccttgatggcttcctgatacattggcatttgggatgcgaaaagtttttttgtgtcgtcgtgaacagcaggtgctggtgactccttgttgtgaagacagtgaaggactgtgacttgaaggacgattaacagttgcaacttccatgcagctttcttcaaagacttgttcgtccacaaactcgtgattctgttccacagttgtaagtaaatgaagaaacagagaagcacatttttaaaaacgaaatacatagctttatttttaaagctcaaatctgcccaagtatagttagacttgatacaatggttaaataaaaccattttcataaagattgacatcaaaaccacttctttttggcatttatgtggaactatctctgtagttaaacctagagattgacatctgtaggctgatttagtgtccctttatagactaactttatcttgaaatatcatttatttatttaaacataaaatctggaaggtatatgataaggaaaaaaaaaacctaaaaaatgcatatagataaaacccacagggaaattagaaattcccactgactttattttttaaaaaggttgaagttatggaaaatagattattttaataggatgccccaagttagattgtctgttatatattagcaaatcttttcacatgggagtgaaaacatttctaaattagaaaatgagacccctaagacactatccatttctttatatgttcctctaaaaatgcccagtacagaaaaatatgacttattcgttacataagtaaaatataattgtctgccgaatgtgtcactctgtgttcgacccagaagggattagcattgaacttttgtggccttttttgtaatcttcgtaatacatcactggcatcactggctgtactcatgatctctgtatgcatttggggtttttccgtcactatttcctaacttccagcccagtagcaaatagcaataggcatcatttcgcatatcgtattttatagaaacatggtatcaattttgcttttaaaatgtttgacaaaaaacctcctgaaatgcctatggaagaatttcacctcagaaatataaaggaaaacatttttggtctgaactactagagaatgacctcaattactattttgtttttctttgcatgggtggggatagtcttataatggaaggctttgcacataccaaattccacttaaccatctctcatcctaaaatatgagtaaaacaattgaagcaagacactggctaataagaaatagattatgttttagctactcgttttgtcatttctttgctgagacaagcattttgaaataaatgaaatttaacattctactctttaaagtctagagaataatataatcagacaagacagaatttcaaagaaatatttgaaattaatatttcaaatattaaatttcaaagaaaaaatggtgcacaaaagattcacaatctgtttccttctcttacaatgcatggtttcacatacctaagttataatgcatgagattctaatttgtctcatcagtgattgaaagtgcaggagtcattctgttattagttactacatacttttgtaggtagcataatttatattagttggtgttagtgatttttgattttaaaaaaagccctcaaaaaaggaaaatacagggaacagaaaagataggaataaaaatattttatttatttatttatttattgagacagagtctagctctttttgcccaggctggagtgcagtgacactatcttagctcactgcaacctctgcctcctgggttcaagcaattctcctgcctcagcctcccgagtagctgggaatacaggctcccgccaccatgtctggctaatttttttgtatttttagtagagacgaggtttcaccatgttggtcaggctggacttgaactcctgacctcagttgacccgcccaccttggccttccaaagtgctgggattacagacgtgagccactgcgcctggccaacattttattattaatgtatcatttaactttcaaatttatcctactaggttacagacctgtccatatctttatttaaaaatgcaagtataatcatgttactaccttgtttaaaacatttaaatgatttccatgaactaaagatcaaaattgtccacatggctgcaaagcctaacattatctggacactgcctttcccttcagctcctcttttgccatgctacactctcttcttctgaccactcttaaattatttcacttcctcctaggctgagttctttccttcttcaggtacttgtatcacctgttagccccttcattgctctgcctagctaactcctagtcaccctgcaggtctccactcaagttcctccaggaagccttgcctgacctgtcccctcatggctctgccctctttactctcttgactgtggcaccgttgttgctttccatgttcgctgctcttttccagtaacagccctgtctgggattttgttttataaacagaggctaaatggtagcagaggccacacctcatttcatggcgtttcttgggtctggctcactcttgggcacataataggcaagtagtaaatatttgctgaatgactctattggtaaataagtacatgaacaggcaatactttggaactgagaatacaaatcatgtgtcacccgagagtgagtgagctgacatgatccaaatatggtgaagattttgttctgctctgtgattatcatagattatgactcctatttacaaactggttaagaaattggtagatttgccaatgaggaggtccaaacaagagcttgtaagtggagaaatacagactcactccttagcacccaagggcataccagtgattacatgagtcatttttctaatgagaatagtttctattatctatctctattcattatggttgtgaatgaaacaaatgcttatattccattgttctctgttttttgttattgctattgctattctcttgatctagatgctagggaccctcgagcaccattaatttttttctgtctaattcgcattttaagaatcacagaaaatgatattgtgtaggatttactattggaagaccactcttcatctgcattaactgacttcttagactagagttaagacagcagctaagaataaaacattttaaataagtttctaaaatactttccaaattgaaatgtcattacatctttcaaagtaatttcaaatattgtggggttttggtttgtttgttttttagcatgttttccagtaatgcagacagtgaaatcacactcggaagcattaagtatgcacaaaagcaaatggaattactgtcagagagcaagggaaggcagtcatgctgtctccttaccgtggttttttccaggcagtgaagcaggtggtggtgctgggtttcaaagctggagccgg

SEQ ID NO: 888 - DNA, 5017 bp, Homo sapiens
cccacacacaagaacttccaaacgcctgaaccgcagcagccaggcattcctccagaacctcctctcccaggagcttgctacaagtgtgggaaatctggccaccgggccaaggaatgcccagagcccgggattcctcctaagccgcctcccatctgtgtaggaccccactgaaaatcggactgttcaactcacctggcagccactcccagagcccctggaactctggcccaaggctctctgactgactccttcccagatcttctcggtttagcagctgaagactgacactgcccgatcgcctcggaagccccctagaccatcatggacaccgagattcaggtaactctcacagtagaagggttcctccaaatctctctccaaatatttgttatctactcattcaatacccttcttcaaccatcctcttgctttggaattgacatgaaccaactaggcccgccttattggtaggaattcatttgccctgcctgccagcccccatagagacagaaccattgcctagtgaaagaagattttaatgacgtgatgaaaatattttagaaagcaccttgaagattagtatttttatgtaacttctgttggagagatgtcttcaggagactgaagtagaagagcgactgtcaaaatggaaagtcccagagacatccaatttatgtaaatcaacatcacctgaattcagaatctcatccagatttcaacaaagacttctgaatgccaacaaagaagaggactgaatttacagactctcactctaacaatatatgctgttcaatttgaaaacagaataaaattattttggcagaaactgatttttaatgacatatattgtttaaatgtacaactttttatttttacacatttgtggtaaaaacagtgaataaggaaaagcaaaggaaatatatcaatatggaagttttacttaatttgttcataaactaaccagaggcaaacaattttagtacttcacttattttttgtattatgttgattttgtgtttgatatggccaaaaatacctttctgatcaaaattatatattgatagaaatgacttatgtaggcaaagttttcatttttactgttacagacagtgtgtttgtatatttttacatgctgttcaataatttttagccatgttgatctcaatttcatttgactcttttagtagtgtccaccatcatttcagactattgaatatataagagactcctgagtataaaagtccttgcccaaataagaaaaggttgtggaacagaagagagaaaaacacatttgtgtgcactcaatcatctcttcttctttcgactcttttaatactgatataaccactatttttaacccttaatggatatgcaagcagaaccattttcctacttgttacgctaccatttttgtctcttcctgaaccataggagctagggatttagatgccatgtaagtgacaacatgagtgcagaagacacaccctgggaaccagcacaggtgtgtagacaacacagattaatctcaggtacctgttagacagaggtgttctctccacacatctgatctgaatcgtgctgagttcttgtatactaccttgatggcttcctgatacattggcatttgggatgcgaaaagtttttttgtgtcgtcgtgaacagcaggtgctggtgactccttgttgtgaagacagtgaaggactgtgacttgaaggacgattaacagttgcaacttccatgcagctttcttcaaagacttgttcgtccacaaactcgtgattctgttccacagttgtaagtaaatgaagaaacagagaagcacatttttaaaaacgaaatacatagctttatttttaaagctcaaatctgcccaagtatagttagacttgatacaatggttaaataaaaccattttcataaagattgacatcaaaaccacttctttttggcatttatgtggaactatctctgtagttaaacctagagattgacatctgtaggctgatttagtgtccctttatagactaactttatcttgaaatatcatttatttatttaaacataaaatctggaaggtatatgataaggaaaaaaaaaacctaaaaaatgcatatagataaaacccacagggaaattagaaattcccactgactttattttttaaaaaggttgaagttatggaaaatagattattttaataggatgccccaagttagattgtctgttatatattagcaaatcttttcacatgggagtgaaaacatttctaaattagaaaatgagacccctaagacactatccatttctttatatgttcctctaaaaatgcccagtacagaaaaatatgacttattcgttacataagtaaaatataattgtctgccgaatgtgtcactctgtgttcgacccagaagggattagcattgaacttttgtggccttttttgtaatcttcgtaatacatcactggcatcactggctgtactcatgatctctgtatgcatttggggtttttccgtcactatttcctaacttccagcccagtagcaaatagcaataggcatcatttcgcatatcgtattttatagaaacatggtatcaattttgcttttaaaatgtttgacaaaaaacctcctgaaatgcctatggaagaatttcacctcagaaatataaaggaaaacatttttggtctgaactactagagaatgacctcaattactattttgtttttctttgcatgggtggggatagtcttataatggaaggctttgcacataccaaattccacttaaccatctctcatcctaaaatatgagtaaaacaattgaagcaagacactggctaataagaaatagattatgttttagctactcgttttgtcatttctttgctgagacaagcattttgaaataaatgaaatttaacattctactctttaaagtctagagaataatataatcagacaagacagaatttcaaagaaatatttgaaattaatatttcaaatattaaatttcaaagaaaaaatggtgcacaaaagattcacaatctgtttccttctcttacaatgcatggtttcacatacctaagttataatgcatgagattctaatttgtctcatcagtgattgaaagtgcaggagtcattctgttattagttactacatacttttgtaggtagcataatttatattagttggtgttagtgatttttgattttaaaaaaagccctcaaaaaaggaaaatacagggaacagaaaagataggaataaaaatattttatttatttatttatttattgagacagagtctagctctttttgcccaggctggagtgcagtgacactatcttagctcactgcaacctctgcctcctgggttcaagcaattctcctgcctcagcctcccgagtagctgggaatacaggctcccgccaccatgtctggctaatttttttgtatttttagtagagacgaggtttcaccatgttggtcaggctggacttgaactcctgacctcagttgacccgcccaccttggccttccaaagtgctgggattacagacgtgagccactgcgcctggccaacattttattattaatgtatcatttaactttcaaatttatcctactaggttacagacctgtccatatctttatttaaaaatgcaagtataatcatgttactaccttgtttaaaacatttaaatgatttccatgaactaaagatcaaaattgtccacatggctgcaaagcctaacattatctggacactgcctttcccttcagctcctcttttgccatgctacactctcttcttctgaccactcttaaattatttcacttcctcctaggctgagttctttccttcttcaggtacttgtatcacctgttagccccttcattgctctgcctagctaactcctagtcaccctgcaggtctccactcaagttcctccaggaagccttgcctgacctgtcccctcatggctctgccctctttactctcttgactgtggcaccgttgttgctttccatgttcgctgctcttttccagtaacagccctgtctgggattttgttttataaacagaggctaaatggtagcagaggccacacctcatttcatggcgtttcttgggtctggctcactcttgggcacataataggcaagtagtaaatatttgctgaatgactctattggtaaataagtacatgaacaggcaatactttggaactgagaatacaaatcatgtgtcacccgagagtgagtgagctgacatgatccaaatatggtgaagattttgttctgctctgtgattatcatagattatgactcctatttacaaactggttaagaaattggtagatttgccaatgaggaggtccaaacaagagcttgtaagtggagaaatacagactcactccttagcacccaagggcataccagtgattacatgagtcatttttctaatgagaatagtttctattatctatctctattcattatggttgtgaatgaaacaaatgcttatattccattgttctctgttttttgttattgctattgctattctcttgatctagatgctagggaccctcgagcaccattaatttttttctgtctaattcgcattttaagaatcacagaaaatgatattgtgtaggatttactattggaagaccactcttcatctgcattaactgacttcttagactagagttaagacagcagctaagaataaaacattttaaataagtttctaaaatactttccaaattgaaatgtcattacatctttcaaagtaatttcaaatattgtggggttttggtttgtttgttttttagcatgttttccagtaatgcagacagtgaaatcacactcggaagcattaagtatgcacaaaagcaaatggaattactgtcagagagcaagggaaggcagtcatgctgtctccttaccgtggttttttccaggcagtgaagcaggtggtggtgctgggtttcaaagctggagccgg

SEQ ID NO: 889 - DNA, 18548 bp, Homo sapiens
tgaagggggagtagaaactagctaacatttaacaaactcgtgatagtttcgtgtgtgtgtgtgtgtgtgtgtgcgcgcgcgtgccccacgtagccagattgattattagaaggtattagaagggctcctctggcagaaccagttttcatctactcaacaacctcttactcatgggtctttatataacttaggtgaaagtatgtccataggggaacagaaaagaaagctgagaaagatgtgccaggagacttgtgggaactaatccaagtgcaacacctccttaccacaaaggaaaaggacagggaactccggagtttcaactaccagagactgaaggcaggagagaaaaactaagacaaatgacttcaaagcctttctgaaatgccacagagggtcaggattacaatctgcctattctgattcttctactatgggaaaaaatctttttcagaattgatgtaaagcctctgttaatacttttcctgttaacaacctaactattcaactgctgaataaaaaccattaggacaactaaagaaactgagagattttggcaagaaatagtcattccaatatcaatgactacggaggaaatgcaattacttttctttgcttaagttttccagggcctttctctgttgcccaggctggagtgcagtgaggcaatcttggctcaccacaatctctccctcctggattcaagcaattctcctgcctcagcctcccgagtagctgggattacaggcatgcaccactacacccggataatttttgtatttttagtagagatggggttttaccatgttggccaggctggtcttgaactcctgacctcgtgatcagcctgcctcggcctcctaaagtgctgggattacatgcatgagccactgtgccctgccaacttgttaaatttttaatcattctgctcaccttttgcaaccttactgacttttgtgtctaccttatctagcagtggctgaaatttccttctatgattatagatttgtctgttatttcttatagatttctcaatattgcttgtattattattttaagttaataccattaggcataaaaattcaaaattgttatcgcttactgaataaataaatcttaatctattatcaagtaattctttttctttagaaatcgtttctgactgtaagtttgctttgtttgaacttttgtagctactacatacatatacatatatatgcagtagctacaaaatgttttaactacacttaaagttttacatttttaaaattaattattttattttattttgagttgacacataattgtacatatttatggaataccgagtgatactaatcaaaagaaagctgttttttttttctgctattaatatcaaagttttgggattgttaatgagataacttaatgtattaataggatatctttctttctcatttgactttcaattcgatatggatttaccatggggaatcctagcttctatgatacctgcagagacaggagagaggaatctttattctctaccttctgccagaagtatggagtactggccctgcctgggggtcatccttcacactatgatgatgatattggggttcccagctagctgagggccactactgacaggcacctattgtctgggtgccccgtgacaacctgcccttggtgggccttattgaaccttgggaccctaagtttgactacagtgagaaagatctgaatgagactctggtgagtcgcttctggggaaccagtaaaacctaggttttaaaacaacttttctccctaagaattggctaagtgaggttagagagagaaagaagaccaggatattatcaaacggctgaaaatctcaaagagcttagcccctggaaagaagcacacctatgctagaaaaggcagatgtggcattaactattaacacttgtgaaactgaaatattttatttttgaaactgttaataatcacaaccaccatgatagagtataatgcataaaattgtttttctataatctgtaatataatgaaaatcagtcacaatatgcaatagtgttatgggatctttgggatgtccattttctggctggaaacttctgtggctcatggcacctttgcctgagtttttgtcctgcatccgggaagaatgaggtatacaaacaagtgaagtgtgagcaagaggaagatgagctttattaagtgttagaacagctcagaggagaccagcactgggtagctcctctcggtaggcaggttgtcccatcaagtgttaagctcttagcagagagcaggccctggagagagcagctcctctccgctactggtcctcccaactcccctgtaggtttctgaagctctcagcagagagggaagtttctctctgcagccggccttcctatcatctctccattctctccgtcctctgccctgctctggctgagcctgggatttttatggacatcagagggcaggaagtatttgttgattggtccatgggcagccgtgggccctggaagagacaccacaagtccccattccttctgcgggaccagcagcccagtctgaagatgggtccttaccaggacccacccacttcagcccaggaacctgtctgcctcccgcggctgcccatggcatgcaggctgctgataccaaagagcacatgcaagccagcacccagcttcccccagttccccgacagattcccctccccgccctcctcatacccaaactccggagggagcctaggtagcagggggctggcatgtctgcactgctcccagcatgcacacaccaggctgggttgtgacggcaccctggctcagccccaaccccgctcagagatcagagcgggagccaagagcagggagaggtcaggcagcggaagcaggaccccttgccctcccaccctgcaagggcaaggggcgccttcccaggacccccaaaagtgcgtggatgcctgtgtctgcagcccaggtttgggtggctggaacagggctcctgactgctccgtgaagtgggatgcccagatcagcagccactctttgctcctgcctactccatgctcccaagagcacaggggtgcctggttgcagttgcagcttgagtggctgcagttgcacctggggagctcccgcccctacaccttggaagggacaggtgtccctcctgtccctggctgtcactagctcagtggaacacagcatccagccacataccctagcaacctggggcagaggttccaggtcttcgctaggcctgggccggcatctggggcgggggcaacgttgccataagatccctctgtggccctggcgttcagggtcagcccagagctacccctcgccggccgcgacctggcagggccactttgctgcggccttcagggtggtgggctgcagggcggggggggtgtccgcctcttccttgtattctccctgcagcggctggtgtgatggcaatggcggccccagatggcccgccgggaccagatggcctgagactgccatcaataataaagaaaaagatatactattttacttgatttatgatttatgtggtatttatgcatgtttgaaatctacaatttctcattctaagtattcatttttgctgctaacattacattgataatttttaatatttttggaggtgccctaaattgtatatgtctcagttcacacaaaacatagacctacctctgcattcagcttttgatatcattatatttatgaaatatttcttgtaaagaagcaattaattaggtattccatatttattctaataatctgtggaacatttgttgtttagaagtgatacaaaatcttttttgctccctatcctgtttttctatccatttgtatttttggaatgtatgattgttagcccatatttcatttttatcttctatcttgtctgctattttgtcatgcattgtgttagaaattataatattcataaatactagtgtgcaagttgaattaataccgttactaccttttaagaaaataaaaacaaaaacagtgcactttaattctatccacttttctctcattttgttattttgttatgcattttaatgtcatcttttatgaatttattaactataataataaacaattagaataccatttattaagagttagataatatctaatttgcttatttttatgcaacttgtttatattttaaaaccagttgaacaatttcatgccttctcacatctcagactttctattttaaaatacttttctcatctgagaagaatgtttttagaattttctttgatgggtttctgctaatagcacacttagctactttttttttgtcaaaattagtttgttttaccctctacttaaaaaataaaagataaaaccaaaagcaatgtactggacacacagttcaaggttggcagttactttctttcattacatcgaattatggcttatttttgctttccattgtagctattgaaaaattgggtgtgcagtcaaagaatttttaaaaaaccttctagatattcattaaatcagttaatataagttattactattgaaaatgtttgagccgtcacaatttcaagtaatttctctgttacattcatttctcttctccttctagaactctgatcttacatatcacactattcttcatatcactctcatcattctaatcttcatttctgtctcttttttgataattactttaaacttttgttaaagttcaataattttctattaaactctattcaatctcctaaatctatccttgagttttgatttcaattgtgttttccattctagaaatgaaatttggttcctttttttaagtatgttatgtcatttattatgtttcttgctccctgccgacattgtcaatcttgatttttatttcttaaaatatatcaggcattgttattttgttgtattatttgataattccactgtttaaagttctagtgctctatttattaatttgttacttctgcttattcttactctactcttgtttacaacgaggttttgtccactgtatgatgctaggtttcttcaggaaattatatgtggaggatctctgtggcccaggatgagggtcccacagaagatttttaggtacttatggctcttaaatctactctgtgatttgatttgggcttgtaaatgttcagaggcccagtttatatttctaacttctctggggttctaccaatcctctactcttctcacagccaaagcaattatctttactcttgcctggttgaggaaggtaagtgaactaaaattactccataagaaactgctctggaggcctataagggactcagttgtggacaagataagtttaggttgtctattaacgttccaaagggggaagtcaaggaggcaacgggatatgccaaaaagaatttcactacaaaggtctgggatggagctataatattagggatagaaaaatataggtggttttcctctgatgaagtaaataggtacagcctccagggtaattttttaaaaagataaattagaccaggtcattctttttttaaaagtctcctcaatcactttctatcaatcagtagagtagaatctaaactcatgaatatagtttagattctagtttaaaagacatcgcgttatttagtcctcatcacctttatggatcttgtctctttctactctcatattggtgaattaagctggaattacatttttcttctccctttttccctatcacacatgaaagaaaaatgaaattggacccatataccaatcacaaaaatcaactcagtggatctgaaactgtaaaactcctagaagtaaacataggggttaaaccttgttgacaataatttttcttagacatgataaaagcacaagcaataaaagcaaaaatagataagtgggacaacatcaaattaagagacttctgcaaggaaatcattaacataatgaaaaggcaatctacagactaggagaaaatatttgcaagccatgtctctcgtaaggggttaatatccaaaatatataaggtacttctgcaactcagtagcacccacaaaaaataacctgattaaaaagcaggcaaaggacatcaatagacatttctctaaagaagatatataaatattcaacagatatatgaagaaatgttaaatatcattaatgatcagaaaaaaatacaactcaaagccacagtgagatagcatgtcatacctgtcaggataagatcatatttgtaaaagtcacagatgatagtgaggaaatggagaaatttgaagccagctggcattgttggtggaatgtaaagtggtacagccactgtggaaaccaatatgaaggctcttcaaaaaattaaaatagaattgtatatgtctcagttcacacaaaacatagacctacctctgcattcagcttttgatatcattatatttagcctgtaccaggctatctagtaccaggctaccatattatgcagcaatctcacttctgagtatctacccaaaataattgaaatattgaagagttatatgcattccaatgttcactgcagcattattcacaatagtaagatatggaaaaaacgcaaatgtccattaattgatgaattgatttttaaaatgtggaaaactgaacacagtggctcacacctgtaatcctaatattttggagactgaggctgcaggatcacttgaggtcaggagtttgagatcagcctggacaacgtagccagatgtggtggcatacccttgcagtcccagctactgggaggctgacgtgagaggatcacataaacccaggagttcaaggctgcagtgcactaggatcaccccactgcattccagcatgggtgacagagtaagacctcatttttaaacaaaaaaaaaaatatggtacatacatacaattaaaaattgttcagtctttaaaaagaaaaaaaccctgctatttgtgacaacacagatgaacctgaagaagcattatgctaagtgaaataagccaatcataggacaaatgctgcattattctacttatgtgaattacctacaattgtcaaattcacagaagcagagaatagaatggtggttagcaggggctgcctgctagaggaaagggaaaatgaggtggggaaatggcaaatttttattcaattattttaaagttacaattatgcaagatgaattacttacagagctgtgctgtatagaatagtgcctatagtcaataataagcacatacaactttgttaagagggcagagcctatgttaaatgttcttaccacaaaacaacaatagaaagcaaagggacacaaggaaacttggaattgatagctatgtctattaccttgattgtggtgatggtttcatggttcaggcacatacccaaacttattgaattctgtatattaaatatatgtggatttttgcatagcaattatgcctgaaaaaagaggtgcctttttacaattttgtttaaagttaagaataaaaaaactcagaaaagggtgctttttattgctaccatatactgagaagtctgaataatagcagtgataaaatactctctcaaaaatctttgctgtctaaattgtgaaattttgaatagaggaatttgaagttccaagttgaagttttagtggtttagatgagggacctgtgtttagataaatggctttgaatagcttgataatgtcattaaataggactcatgtgctaagtgtagacaaatagtaaagagtgagctattttggggtttctgaatataggtatatcaatcaaggtcctatcaggatacagaaactacagttatttacacaggcaaaatttaataaaagatactattaacagaagattggagtaatggggattgtctaataagagtgaaagagacacaagaataaagagagattaccacctctaggatagagataaaacacccaagcaaagtccagctcttatcagggctgatattcagatggtattgaagtgggtactgctgcagttcagtagaatatgaagaggttcactgggatgctttcaagactccctgaaaatcaatgctgtgaagaagctctcctcagtggagtgtgcacctgcagctcactgcaaagctgccagtgtggatgctggaggagccatccaaaggcaggtgcctcactggcagcactccactacaagcccatccgatgggagtgtgtataaaatgggaaactgttcatgagtgccctgcccgactcccactctgctgtgaagccacagccacacaagaaatatatgccagaagctgtccagtacctgctgaaaaaaaaaaaaagcccaatttgcagacacctgatgaaagggctgcactgggttgaggaagagaaaccctttcttcctccagtgtctctccagtgccaggctatatgacaaggggaaaacacttgcaggctccagctccactgccacagagcagtcaaggaaaggtggattttgagttccgaggcaataaattggtaaatggcacagtaggtaaataaaatacaacatctcattttccaagaatatgtgaggtaggttagggaaattcaaatgaagtgcattttctcaaaatctgttttattttaatagtgtgtattagcactgttttattacctttatgatcgttgccttctgcatggagcttaattaatggaacttctaattattcagtcagcctctgtctcttcatcctcggatacctgtgtttgtttttttgagtaggaagagcctgatgattttagaattctatgagctttcttcaagaggttcatatttccagcctatgtggaacatatttctacatttaaacaataaattagaaacaaaactatgatggcacagtgactataaagataaaacaaactcaggtaattatattctattattctatgcagcaatttggcatttttattgaagattaaaacttaaaacaagaaaacagtgtcgcatgtgagctgtaattttttagtgataattacaaatttcattttatatatgaaatgcatgtgtttcatgttacaattcttaccaaaactggtattataacatgaaacacatgaatttcatgtatgaaatgaaatttgtaacctggcaagatgtctcacctatgtaatcccagcactttgggaggccaaagcaggcggatcaccggaggtcaggagtttgagaccagcctagccaacatgtgaaaacctcgtctctacaaaaatacaaaaattagccaggcgtgatggcgggtgcctgtaattctagctactcgggaggctgaggtggaagaatcgcttgaacccaggaggcagagattgcagtgagccgatatcacgccattgcactccagcctgcgtgactgaacgagactctgtatccaaaaaaaaaaaagtgatcttctctgaatgtcaaatgccctgctatcctgcagagagtagccatattttgccaagcagatcaatttccattaattagatatctgaatgtaagagacattaaaaaaagtgtgtgtaaagggataaacagcggttacagagtgttgtgctggagctaacttgtagtgatttataagattcaatttccaaattttcagaacttgcagaacagtcaacatcagtttggtagtttataataggtcatgatggaaatacagcacaacagctggcagatgttacaaatcggagtattgttttgttttttctttcacatccgtaacaacagaaacaagtcgtgaaatccattttaagtggatggtatctttttcacattcccaacctaaagatgaagtttcgaatatattttaaaatggttttgaaatagtaagctaaaagtatgaggaatttaaatgagaatccctgattttctttctttcttaaacagtttcaaataatcagataagcctctaaaccatctagatattaaataagattcacatgctaaaggtggtgactaagatatagtaatgtatcatcaggtttctgagtacagagaattagcaaagtgaaatggaaattttgctgaaaaggatagttgagaataggggttggaaacagatgggaatatgccaatagtctattttttcaaatactgtaattagcaggagttcaaaacgttcaaatggcaatgtaattaccaccaatccagtgttaaggtagcaaaccagggaggattacaacatattatataaaatctagaaactttaagagtatcaagttatgtatatccaactacttatattcatggacaaaagaaatacacattaatgattctgtggggatgcatcattgcatccatcattactattttagtattggtaaagaaccaaacaatttgttctaagatgtgctgactatttagcagactttgtgatggaaacacttgccatcttctctaacacacttctaccatacaaagtatacttactgtgcccaaaatgtggtcacatacttctttgtcagctctcagtagacaaagcaaaggtttatctagtgcaatttttttctccttgccttgcgattttttttcctactccattgagctctcaaattaaaagttctcgaattatcctatggtatgttgtcctccatctctgtacttggctggaaattatcttgctaagacattctaatggttggaaaatgcacgtgaataaataaaatgaataaaaaaatctactaagtggcaccagagaataattgtatcattactaattttgaaacatgaaggaggtttttgttttccttttactcccacttctcctttagtttttgcacaacgttttgtcatatttagcctatatattttatatgactaccctatacacaaaaagggtatttaattaaggagcaaatcatataatacaaaattattacacataatatttttaaatgaagaagcactattaatcctgctattagaattgaatttcaaatcaaataaataaaatcaatgtctatgtagacttgtaaattctaaggagctaagttcttttttttctagtataaggacatagttttgtaattatcaattattgaaagtttagggatttttaaagtaggataagaaaagtgagtcagtcatcgaatcaataatcacttattgaatagctgttatataactggggttcatatgtgtgtgtatgtctgtgtgtgtgtctatacacacacatatatatgtaagattatataatatatatactatatgacacagggatggtgagatgaatgaaaaatgttggaagaacttacactctagtgtgatagttttgaaaccagacagcagactaaaatcactcagaaagcttcaaaaatactgagaccttggaccaaagcaactaaatcagtttcttcggtagtaaggtagcagaaacagaatgctctctaggttatgctgattagttgccaatatcgagaataattggtttggtggcttttaaatagatgcttgctattcaaattgtcttgttgccaccactgaaagtgtcaatatttttgtttttgcttttaaaatttactcttgtattataaccttaaagctgtatagttatccactgacttaaaagcaacaacaactcttcttttagtgtgtttttcagcacactagctacttagtaacctgtttacaggataaccaaactttaacgtacaagctcaaattattgggatgtgatttatcggttaatttacacagatattttactaaaagataaatcatcttaaatgacagttttaatattttattaaatgttttcttttagtcttagaaaaggaacttcattctattgcctagaagtgggtaatacacttgtatgcttttactccctgagttttggaataaatcatccctaatacgctttggtagctaaggaaacaaggacatctttagttcccatcttctcactgagcctaaatgagaccaccaggcagtcctctgacatgtccccagctcagtgttgctgaaaccactgtttgtgttaccaggacccgtgcgagctcttagtaaaacatggtaggtatagaaagtgagaataagggtgtagtgacatcacagttttggagaataatttgtgtttattgaatctactgtggtttttttttattactatactttaagttctgggatacatgcgcagaatgtgcaggtttgttacataggtatacatgtgccacggtggtttgctgtacccatcatcccatcatctaggttttaagcctgcatgcattagatatttgtcctaatgctatccctccccttacccccatccctgacaggccctggtgtgtgatgttcccctccctgtgtccatgtgttctcattgctcaactcccacttatgagtgagaacatgtggtgtttggttttctgttcctgtgttagtttgctgagaataatggtttccaccttcatagtgaaacttatattttataattctttttttcactttgtattttagtaatttttgtaattgtgttttattttaaaaaatctggctgggtgtggtggctcacgcctgtaatcccagcactttgagaggctgaggcgggcagatcacgatgtcaggagttcgagaccagcctggccaacatagtgaaacacagtctctaccaaagatacaaaaaattggccaggcggggtggcgtgcacctgtaatcccagctacttgagaggctaaggcagaagaatcgcttgaacccaggaggcggagtttgcagtgagctgagatcgtgccatcgaactccagcctgagcaacaaggggagactatgactcaataaataaatgaataaataaataaaataaataaataaataagtaaatctgtctgccatgggttaaaataaatcgaactagtcctttgccggtgatgggatgacaagtctttcccaggccacactcacatgtgtattgtttggcctttctataatgtgaacatggtctctaggaagaaaatttgtgcttatccaagatttacctagaaagattctattgcttcattaatggataagaaagaagggctaatacaaagagcttcacaagcaacatagaggaagaaaaaagaaataagtaataattagaggaaaataaggaagaaacagatacaaacaagaatgggaatagagggaaaagagaagaagagagattaagcaatgcactgtctacaccaatacatttaaaattagatgcaattcctgatctaagtatgtttaggagtaatgaaaaaattttaagccaagagacaaaatagaaatagctttagagatagtttattggtttcgattattcattactgcactatataatcaattatagaaaacttctgaaatctagataatattcaggaaactatttctataaaatgccaatttgcacagaagagtaagacagacaattatagagtacttcaaaaaatataatttttgagaaattttaggtatatgaaatggcataataacttgtataattacaaggtagagacaagctaactaggagttctttgagtaaatttctctagtccttaattctttacattttccttttttaggtatattctatagtcagcagtatcctggtgactcataagagaagattcagccaagctcggtggctcccgcctataatcctagtactttgggaggccaaggcgggtggattgcctgagctcaggagtttgagacccagcctgggcaacatgatgaaaccccgtctctactaaaacacacacacaaaaacaagtagccgggattggggcgtgctactcaggaggctgaggcaggtgaatcgcttgaatccaccaggtggagattgcagtgagccgagatcacgccaatgcactccagcctgggagacagagcaagattccgtctcaaaacaaaaacaaaaacaaaaacaaaaaacagaaacaaaagaagactcataaaacaaactttcagttctgctaataaattcaagggactggaattactacttgttgaacatcaccatactattttgtcctcaatttatcttgattgagagatatggtctttaaggaaacatgctttagttatttgggaagattcttcagcagctcagtgtttgctatgaagcttctatactcgccatgcctgtattctttctaaataattgaaaacagtaatgggttttgatatggtttggctcttcgttcccactcaaatctcaccttgaattgtaataatccccacgtgtcaagggtaggagcaggtggagataattgaatcattggggtggtttcctccatgctgttctcttgatagcgattgagttatcctgtgagctaatggttttgtaaggggcttcccccttcactcagcactcattctctctgccgccacactgtgaagaggtgccttttgccatgattctaagtttcctgaggcctccccagccatgcagaactgtgagtcaattcaacgtctttcctgtataaattacccagtcttgggtatttcttcatagcggtgagaaactaaacctattttagttaataagatcgaactaaagtaggtttcaataaatatgtttctttaaaatgagtcatgactagctgtaaacaatgacttttttggcatggcattctttttgtgaaatattatataatttggtaagatttctattgatttttaatttgttgcctttcttttagtacttgtcttcacctttaatttttcttaataaatgcggaattgaaatgagctaaattattcagacactttgggatcaacatctatttcattgttcatctcagttagttgcatcaggactatcgcatatcttcattctcctatgacatgtcttaaaacaatttgatttctaactcattttgttaactgtaatgaattcctttttttggatatgctaataatttcccttaaagcagtaactgatacaacaaaatcttttgtcttctctctcatcccaattaaagtgtatatgtttccttttctgaggaagattgctaagtgttattgaatacttctttttcctcttcgtttttctaggaaagtagtgctatgctgtgattttactaaagtttaactgagcagaattgacttaattatatataatgggacttagttgtgtttttttctctgacgtattttcactttcttgaaatctggaagagatttttctctgattatatccagagtgtgaagagaaatgaatttaaaaattcattttggaaagtagaaatgaagactgaaggcttattctgcaagttttcctgaaataccaaaaatagaaatgtagttgccaattaactgggctaagaaattatatttttacatagttgctagtcatgatcaaaattataatattagttgttgtctaccattttagattgtctttagtaaggtaattttagataaatgtgaacttatttacaatgtccttcagaaatactagtaacttttatttaagaataaaagtttactttaatcacttggtttagatggtatcttccagttttatataatgtgaagctagtatttttccttttgtaatgaataaatgtttcatggggagatattttgagactatgaaaatatcttttttctcctagaatcactctctttagacactatcatttattcttgcctaattaacttacttctgtgatagtttccaaacggtgattttctactttcatcattaaatttatgtataacagttttattctgttttaaaaaaggatttttaattcctaattatgtattcatttttgtcacaggtacttatagactttaattgtattctgtaggtaataatctattattcttaccattgctgggcaaatatatattgtatgactccatgtatgttgtctgacaaagatataacatcactccagtaatattcctgccaaaaacataccacaaatttaatcatgagcaaacaccagacaaacaaaatctgagagatattctacaaaatgaatgatctcttcaaaaatatgataataaaagattaagaaaaaagaaaataattttgtgaggtgaggaatatgttaactaaacttgattgtgatcatcgtttaatgacgcacatgtataccaagccatcaagttggacaccttatgtatacaatttttgtcaattatacctgaatgcagctgaaataaaatgagaaatgcttccaatttaaattataagtaagatacatgataagaaaatgcaacacaccatcctggattgctttaaacatcagtgggaaaaatggacaaattgaataaggtctttagattctaggatataataattttaattcttaattttgataattgtacaggggttatgtaaggtattgcccttgttactaggaaatatgcatttgagttgagagtaaatgggcaatgtatctctgatttactcacaaatgttcaggaaattgtgcatttgtgtgcatcattgtgtgtaagaagacagaggagggaaaggaggaaattttatgaaatgttaacattagaagaaaaccaagcgaaggatctgtgaaaattacactactttttgcaaattttctgcaattcctaagttgttaaaataaaatttctaaaaactaactttatgtcagactgattctgaattacatagtaagttacatggtttcttttctttcttttcaagaaatagttaacaaagaaaaaaacattcaaacttatcttctgttaagcccttttccttttctagtattccatttcttaaaatccttcctaggcttttcttaggttccagatttctagcttccacagaaagcatgatctcactatccttggaacacaattgcctgctctttgctctgagttctaacattacagtctttataaaacaacctagcattcaataatgtaatgttttatgtttatcctacattatttcacttagatataatgtcttcatcaattaatcagagaaaatttctttcattttcttcctctctccaaaaattcctgcaatttcaattctacagtaagaggtttccttagtatgttttctgttgtttatagcaaaataccccaaactgagtaatttataaagaaaataaatttatttcatatagttctggaagctgagaagtccacggttgaggggctgcatctggcgagggccttcttgctggtggggattctgcagtgtccaaagtcagcatagggcatcacatggtgagaggactgagttcagggttctcttcttataaagccaccagtcccattcccataataacccattaactcactaattcatgaaaacattaatttattcataaggggagagatttcatgacccaatcacctctcaaaggccctccttctcaactaccacattggagattaaatttcaacatgagttttggggttgacaaacatccaaaccacagtatcagttatttaatctttatacatttgatgtaaaatagtttgcttggaagatagtcctaagcactaaggatgaaaaaatagataaaataatgactttcacctattaaattaatttaaaactatttcttaaaaagggataaaaataaaggaaaattaatgcagctaacttctgcaagtactgcttttcacgtgcttagaaattttctagttatgacctattctcttcaatggtgaggcagagttgttctcattaaagaactgccactttggaagacagtttggcagtttctcacaaaactaaatatgttcttaccatatcatatagcaattgtgttcctaggtatttactcaaatgcctttaaaacttatgttcccataaaagcctgtgtatgaatgtttatagcatatttattcattgttgctaaaacttggaaggaaccataatgtccttcagtaggtgaatgaacaaataaattgtgatatatccatataacgcaacattactcagcaataaaaaaggaatatcaagccatgaaaagacatgcaagaaacttaacacacactgctaagtgaaagaagccaatatgaaaatgtaacatactatgattccagttaaatgccattcttgaaaggaaaaactatggatacaataaaaagatcaagggtggtcagtgggctggggagggcatgagatgactacgtagagaacaggtaatttatagagcacagaaattattctatatgatgctgtaatggtggattaaggtcatacatttgtcaaaactgatagaatgtataatgcaaagagtgaactataatgtaaactatagagttaaggatgaatcaacaccgattcatcaatgtaacaaatgagtcaacatatttcataatatagtatgcaatattaccatcacattaatatttgattatatattaatatattaatgcaatatgttaataatatgagactggggggtgaggtgtatatgaaaagcttctatatttgctactcaatttttctgtgaacctaataatgttttaaaaataaagtaaatcaatataaaaaatgaaaataaattagtagttatcatgaactcaggttgaattggggaagaacaagaggtttgtttactgtggtgaaagtattttgagtga

SEQ ID NO: 890 - DNA, 18548 bp, Homo sapiens; identical to SEQ ID NO: 889

SEQ ID NO: 891 - DNA, 18548 bp, Homo sapiens; identical to SEQ ID NO: 889

SEQ ID NO: 892 - DNA, 18548 bp, Homo sapiens; identical to SEQ ID NO: 889

SEQ ID NO: 893 - DNA, 1053 bp, Homo sapiens
cttgtgtgaggcgacacggagcagggaggggagtgctctgggttatcagcccccgccagggccggctgctcgcaggccttttcctgtttgcggctctgtggagtacgggaaaacgcaggctcaacatacgtgttttatttccctaacatgctgatctgtcagtaacacaggatgtatctagaagcaactacaaagccaatgtgaccaggccaggcaatgtacccatatcctgagcacccaccctctcttcaccccactccttcccctgaccccctcttcacagctcttgaagaaaccagaacccactcgggagagaagcaagcaaaggcatgaggattagctgaggggaaaggaaaaagaaatggaagaaacatgtctagaaaggccggtgacagaacccaggatacaaaacctgggtgtgggcccatgccttagcactaggaaaagtcccacaccacagggttattgcaaggctaaaatgacataacgcatgctttcaaggcacctggtaaactgtagaatgctgtgcaactctgaggcactgcaattattactgcaggaagctaggaagctcagcatcctctgctcaggagaggggcaatggctaagaagtcatctacccaactgggaacctttccaagaacacaaacaggtaaacgcttcatgtcccatccacatacacaccagtgcacagtcacgctctccctaacacacacacgccctccctaacacacgcatgccctcccaggcttctagcctcaaagacaccccacgagcgcacacccacatggggagaggcctgggcagcatggccgagataagagcaagggaagtggcaggaggaagaagaggtagcctacggcagagggcgtctctcttactgacggtgaccaagggtctagcctctgcccatgcagagtttctggtcatgagtaagaggcttgtctgactttacctcaatcaggattcccagagcaacatcaactatctcagcctcattcatgcagtacacagtccttgtcgcagggagtctgaaaaaaagacatgcaaggc

SEQ ID NO: 894 - DNA, 1053 bp, Homo sapiens; identical to SEQ ID NO: 893

SEQ ID NO: 895 - DNA, 1053 bp, Homo sapiens; identical to SEQ ID NO: 893

SEQ ID NO: 896 - DNA, 1262 bp, Homo sapiens
cgccgccccagcccggctcagacccccactccctgagcacaggcctctgatgtcatttcctgacctgcctccccctccccgcccgacccgcgggtgcccgagatctgactcaccgtccccctccgggcttagccggcggaggtggggcgggtgccgccgaggtagccacgcagcccctgtgcgcctccggcccggcccagcgacctcctctcgggcctgccgttacccggtcccctcctgccaccacccgctacccggccaccccgagtccgcctggggtggccgaacgtatggagctgggctccagggtgcacggggatggggggtgaggagcggggcgttctccctcccagcaccccccagctgactctgtgcccggagggggtgtgtgagccggaacctccagcattcttggggatacgaacttccaacgctgggcagcctcttaaggcttctaggaattcgcatccccagcgccccagccagcagatcggttgcgagagggaccgttcgggtccgcggggccgggaatggaggtgggagggcggggccgaggcggcggccgcctgcggactggagacccgggaggacggacgcggacgcgggctgctcgtcttttacggcccttcaacgcccaccacgacccactcctcttggagaccccgggcgacggtggggctcttgggcattctgagactgcgcttggtggagaccccgggcgacggtggagctcttgggcattctgagactgcgcttggtggagccccctactggccagactggatttctcagcctgcgactcagccccaggctacacgaaagaagccagacctggcttttactgcctcctgaggccttcgtcttgttcacactgagtgtccagtccctccaaatccggctacactctactggcaaggagcacctgggccatgttttagagatcatccgaggactaaccccaaaagtttatgaagagaaagcagaggccgagctgaagagatggacccgggtcacacccaggtaaaggcaggatctaaactgaaactggtgtcagatctggttgccttgcacccctgatatcaggtgaagcaacactgggcaggatagagcagagtgaggtcagagtgtgaagatccagcctgatgcccaaactgacgcctcttcattctcccctgctccatctgtaaacgtcacggttaatccatctactttattgcattatatagagaaataaatgaaatgtcatagctgtatgcgctata

SEQ ID NO: 897 - DNA, 1262 bp, Homo sapiens; identical to SEQ ID NO: 896

SEQ ID NO: 898 - DNA, 2160 bp, Homo sapiens
ctctgaccgccagggaacaaccctccctttgactgtaattttcctttacctacccaaatcctgtaaaacggccccacccctttctcccttcactgactctcttttcggactcagcctgcctgcacccaggtgattaaaagcttttattgctcacacaaagcctgtttggtggtctcttcacacggaggcgcatgaaatttggtgccgtgactcggatcaggggacttcccttgggagatcaatcccctgtcctcctgttctttgctcgtgagaaagatccacgtacgacctcaggtcctcagaccgaccagcccagtaaacatctcaccaatttaaaatccgacgctgattgttctccactcatatctcccaccttgatcacctcatcaaccactgcctaacttccaagagaaagccaacccctggcttcttggcttcttttcctgagggtgctctcctgtccctgaagactcatttgccaccttcatgacagcctgcaagagccaggaaatgaaccatcatggagcagtcctcatcaaaaacatctaatgaccaatggcattgacatatggacactcatctacattcccttcccgtggcagctagcttagaggcacctgttttgactttagcaactggcctcccttccctgtctcatttccccataaccccatgtatttctttcaattcacaaataaaccacttgtatgaatcttcatctaagaatctgctttaagaagaactcaacctaaggcaggcattacccaaatgggaaggtaaaatattatttatcaaagcaaatgcgatatcagccgacggcagagaacagctcacacaaacccctctggccttccttgtctgaattcaataagttcaacaaatatttataaagtgaggcctagatataacacatttcccccagttatttaacaagagtagaaatgtgtaataaggtacttcattccatacaggaagtttaacaaattttacaaagttctttccaaaggcaagtaaaaaaatatatatatattattcatataagataatatagatataaaaatatatatggtttttcataaggcgaaccctctttcttggaatggcatttctgatcaattccataaaatggcaattttgtcagaatcacttatctagtgatgaggttcaatcacataacgatttttagcttatgatggtttcgaatttccttgagctaaccctgataaggtggatgggttaattatatttttgaaggaatttgaagacagtaagatgtgtatgcagttcaatatatccttcttataagaaatgatgtttacctttagtagatttatgattgtacatttgttaagatagtaactttaaggaaaggacattttttaacgcaagtattattttgtatgagtagcttccaaatcagttggccattggattatttgagagttatgtattagtttcacatcagtttcctcttactgtcaaaattttaaaatgtagttcaggtttacaaaccagaagattttatgcatttatagctaaaaatttcctttccatgtacgtaatatttatgtatctgtgacatgagtcatttgatttgatgtctgcttaactgaaatgtgatgagttgacattatcaaacggagcagattttctgaaactttaagccaaatgttccagggtatgttcggaaggattggcaaagcagggggccgagggaggtaaggggacagtgcataaaagcagcagatgctgtcacatagggttagtccaatattatcattaaaatccatttgagtaaagcagataagtcaattatcttatatgaatatttaattatattatttctactaatgttatttttctggggttattgttgcaatgcaatatagcctgtttcttaaaggaataactctgaactttacaacaatccaaggaaattaaagcctttttgaaaaataaaccattatagattgaagattatgaaagctgagcaatacatttaatgactcattgtaaaatttaggatcaacagaatcttttaaataacagtgttgatcctcagtgtattttatttcacaatttgaatattattctgtactgctaagtcatatttcatattcattaataaaataaatatttattgagtgtcttcagtgtgcc

SEQ ID NO: 899 - DNA, 1879 bp, Homo sapiens
tttgtatgtgaagatcatgtaacttacggattgatcagaaaaactgaagacgcaatgcaaaacgctgattgttctccactcatatctcccaccttgatcacctcatcaaccactgcctaacttccaagagaaagccaacccctggcttcttggcttcttttcctgagggtgctctcctgtccctgaagactcatttgccaccttcatgacagcctgcaagagccaggaaatgaaccatcatggagcagtcctcatcaaaaacatctaatgaccaatggcattgacatatggacactcatctacattcccttcccgtggcagctagcttagaggcacctgttttgactttagcaactggcctcccttccctgtctcatttccccataaccccatgtatttctttcaattcacaaataaaccacttgtatgaatcttcatctaagaatctgctttaagaagaactcaacctaaggcaggcattacccaaatgggaaggtaaaatattatttatcaaagcaaatgcgatatcagccgacggcagagaacagctcacacaaacccctctggccttccttgtctgaattcaataagttcaacaaatatttataaagtgaggcctagatataacacatttcccccagttatttaacaagagtagaaatgtgtaataaggtacttcattccatacaggaagtttaacaaattttacaaagttctttccaaaggcaagtaaaaaaatatatatatattattcatataagataatatagatataaaaatatatatggtttttcataaggcgaaccctctttcttggaatggcatttctgatcaattccataaaatggcaattttgtcagaatcacttatctagtgatgaggttcaatcacataacgatttttagcttatgatggtttcgaatttccttgagctaaccctgataaggtggatgggttaattatatttttgaaggaatttgaagacagtaagatgtgtatgcagttcaatatatccttcttataagaaatgatgtttacctttagtagatttatgattgtacatttgttaagatagtaactttaaggaaaggacattttttaacgcaagtattattttgtatgagtagcttccaaatcagttggccattggattatttgagagttatgtattagtttcacatcagtttcctcttactgtcaaaattttaaaatgtagttcaggtttacaaaccagaagattttatgcatttatagctaaaaatttcctttccatgtacgtaatatttatgtatctgtgacatgagtcatttgatttgatgtctgcttaactgaaatgtgatgagttgacattatcaaacggagcagattttctgaaactttaagccaaatgttccagggtatgttcggaaggattggcaaagcagggggccgagggaggtaaggggacagtgcataaaagcagcagatgctgtcacatagggttagtccaatattatcattaaaatccatttgagtaaagcagataagtcaattatcttatatgaatatttaattatattatttctactaatgttatttttctggggttattgttgcaatgcaatatagcctgtttcttaaaggaataactctgaactttacaacaatccaaggaaattaaagcctttttgaaaaataaaccattatagattgaagattatgaaagctgagcaatacatttaatgactcattgtaaaatttaggatcaacagaatcttttaaataacagtgttgatcctcagtgtattttatttcacaatttgaatattattctgtactgctaagtcatatttcatattcattaataaaataaatatttattgagtgtcttcagtgtgcc

SEQ ID NO: 900 - DNA, 3150 bp, Homo sapiens
ctctgaccgccagggaacaaccctccctttgactgtaattttcctttacctacccaaatcctgtaaaacggccccacccctttctcccttcactgactctcttttcggactcagcctgcctgcacccaggtgattaaaagcttttattgctcacacaaagcctgtttggtggtctcttcacacggaggcgcatgaaatttggtgccgtgactcggatcaggggacttcccttgggagatcaatcccctgtcctcctgttctttgctcgtgagaaagatccacgtacgacctcaggtcctcagaccgaccagcccagtaaacatctcaccaatttaaaatccgtttgtatgtgaagatcatgtaacttacggattgatcagaaaaactgaagacgcaatgcaaagtatgtcagatctcattattttttctaaatcaaagtaattgtttcaagctacccattcaatgaaattagcaagaaactcagtattcatcactttgtatggctacctttgcctccatgtgtgaatttggacagaacactggccagtggtcttctactgaggtgctatttattcatttaaagtggtggctactttgagaacattcccttttgtatcaactctgcctacagaaatctttgccgggttcccagggttaaagtcacacaaggccacagaacttccctgccaaggtcctgcttctggtacagctatgtggatggctgctatgttggaacaaacctgttgtcatcaccccatcctaagggcatcaaattgtctttctctgtcttgttttagctccccccgtgtttttctctaaatatcaacgttagtactttccctttatagaagttagcttaatagtctaaaatacagaaacgaagcccctcaaatgctatcttgagctcttgcctacacctcattgttcaaccctgaaacatgaaaaatctaaccctctgaagaagcaaggtaactcagaactccctcctgtgaggtaaaaacagaaaatcacacagtagaatttccaggagactaattaattaattaataacttacaatcttattgataaagccatctctcttgggggtcattagtatggaatttgatatatagatataatcatatcaagggatcagaagcttccccagttccctggagaagaaaatgttcgatttgtttgattaatttgctgctctcatcggttaagtatgaaattgttattaagtctatattaaaaagaaaacctttacatcagaagtcaaacatacatttctcaggtttttattagtatgcagcacaacctagcctcagatgatgtcatgttgatactttttctaaaagaataaacaaagccattaaaatatgactgtgtagcattcctctttcaggctggtaaaacaaaggcttagaaaatcaactcatataagacaattttcccataaattagaactcttatttatttaattatttatttacttctaaagtacaagaaaagcattccatatgaaagctgttcccactcacattttccactgttaacatgaataaatattacatcattcagtgcatcaactcataattgatatgaataaagaaatcttaattatttttttaatagtacacagcggtattagagaaaatatcctggtcattttgactcttacttctatttaattcttggtgaaatagttgaaccatcattgaataacaaaaaatgagaatataatttaaaagcagtgggtggtgttaggcacccatcatatggcagtattaattttgtcacagatgtacagtaaaaagtaacagtacaaggactgaattttaagcttaggctaatatagaataccagggataatggcattttacaaatacgcgcgcacacacacacacacacacacacacacatttccatatgtactatggatcagagaatattgatgggtaattaatataagtccataattggttataagacaagtctatgtatcaatgtctttgctaatttggtttttataagaaggcaaaaaggcagacgggagaacagctcccttcaacttgggccacttacagcagaactgtcatgctctatccatctctgcccccatagcccttttcactgtggtgcactcctgacttccaacgggctgagagttttctcacgcagccacggcctgtgcacctgaaaacaccacaggctggaagtacaagagagatcatgaccacttggggaaaaggggtataagaaccccagatcccttatgccccagagaagatgatgctgatggcaaacttttctaagggttctcagtttcccagtgggattaagctacagctacctgtactggtaactgacttgataatgtgttattagttgccttttcttttctatctacatctccacttccctgccaaataaagaacttggcctggattccttgtctcacagccagcttccaggagagccaaatgaaggctgcactctgaataaacagccaccgtgagagtcagtggagacattctctgtcttgcatctattttcaggcactcaagcagaaaataaaggacctcagaaaaggaactccaccctcccccaaaacccaccaatctaagattcccaattaaaaaaaaaaaaggatgtagaaaggaaaaataagtgaaactatctaatttttacattttgttcttcctgccccttttatagcttttatctctgatatcttaagatgtattttctatgtacagccatttcattgtgtctcagtaaaataacatgcctttgcctcttccttctcaactctctgttcatactttcctaggcctataaacagactatgctgacagaggtccatactttgtcccaggtgtttgcaaatgcttattgtgtacggatccacctctccaaggaataaataaaatcattaagcaatttcaatattatcacagacatgccaaataggaaatcaagcaggacaattgacttcccaactcatatgctaaaatgctcagtttcttatgtaaaaactgaatgtggcagtgctacctggtaaagtttccaatataggtatacatttgatatttcagaatactctgtgcaaattaagatgtgaattttcagttcaaagataatggggaaaggattccctatttaat

SEQ ID NO: 901 - DNA, 3206 bp, Homo sapiens
aaatcctgtaaaacggccccacccctttctcccttcactgactctcttttcggactcagcctgcctgcacccaggtgattaaaagcttttattgctcacacaaagcctgtttggtggtctcttcacacggaggcgcatgaaatttggtgccgtgactcggatcaggggacttcccttgggagatcaatcccctgtcctcctgttctttgctcgtgagaaagatccacgtacgacctcaggtcctcagaccgaccagcccagtaaacatctcaccaatttaaaatccgttcctcctgcattcacttcttcctgccgccttgtgaagaaggtgccttgcctcccctttgccttccgccatgattgcaagtttcctgaggcctccccagccatgctcaacttttgtatgtgaagatcatgtaacttacggattgatcagaaaaactgaagacgcaatgcaaagtatgtcagatctcattattttttctaaatcaaagtaattgtttcaagctacccattcaatgaaattagcaagaaactcagtattcatcactttgtatggctacctttgcctccatgtgtgaatttggacagaacactggccagtggtcttctactgaggtgctatttattcatttaaagtggtggctactttgagaacattcccttttgtatcaactctgcctacagaaatctttgccgggttcccagggttaaagtcacacaaggccacagaacttccctgccaaggtcctgcttctggtacagctatgtggatggctgctatgttggaacaaacctgttgtcatcaccccatcctaagggcatcaaattgtctttctctgtcttgttttagctccccccgtgtttttctctaaatatcaacgttagtactttccctttatagaagttagcttaatagtctaaaatacagaaacgaagcccctcaaatgctatcttgagctcttgcctacacctcattgttcaaccctgaaacatgaaaaatctaaccctctgaagaagcaaggtaactcagaactccctcctgtgaggtaaaaacagaaaatcacacagtagaatttccaggagactaattaattaattaataacttacaatcttattgataaagccatctctcttgggggtcattagtatggaatttgatatatagatataatcatatcaagggatcagaagcttccccagttccctggagaagaaaatgttcgatttgtttgattaatttgctgctctcatcggttaagtatgaaattgttattaagtctatattaaaaagaaaacctttacatcagaagtcaaacatacatttctcaggtttttattagtatgcagcacaacctagcctcagatgatgtcatgttgatactttttctaaaagaataaacaaagccattaaaatatgactgtgtagcattcctctttcaggctggtaaaacaaaggcttagaaaatcaactcatataagacaattttcccataaattagaactcttatttatttaattatttatttacttctaaagtacaagaaaagcattccatatgaaagctgttcccactcacattttccactgttaacatgaataaatattacatcattcagtgcatcaactcataattgatatgaataaagaaatcttaattatttttttaatagtacacagcggtattagagaaaatatcctggtcattttgactcttacttctatttaattcttggtgaaatagttgaaccatcattgaataacaaaaaatgagaatataatttaaaagcagtgggtggtgttaggcacccatcatatggcagtattaattttgtcacagatgtacagtaaaaagtaacagtacaaggactgaattttaagcttaggctaatatagaataccagggataatggcattttacaaatacgcgcgcacacacacacacacacacacacacacatttccatatgtactatggatcagagaatattgatgggtaattaatataagtccataattggttataagacaagtctatgtatcaatgtctttgctaatttggtttttataagaaggcaaaaaggcagacgggagaacagctcccttcaacttgggccacttacagcagaactgtcatgctctatccatctctgcccccatagcccttttcactgtggtgcactcctgacttccaacgggctgagagttttctcacgcagccacggcctgtgcacctgaaaacaccacaggctggaagtacaagagagatcatgaccacttggggaaaaggggtataagaaccccagatcccttatgccccagagaagatgatgctgatggcaaacttttctaagggttctcagtttcccagtgggattaagctacagctacctgtactggtaactgacttgataatgtgttattagttgccttttcttttctatctacatctccacttccctgccaaataaagaacttggcctggattccttgtctcacagccagcttccaggagagccaaatgaaggctgcactctgaataaacagccaccgtgagagtcagtggagacattctctgtcttgcatctattttcaggcactcaagcagaaaataaaggacctcagaaaaggaactccaccctcccccaaaacccaccaatctaagattcccaattaaaaaaaaaaaaggatgtagaaaggaaaaataagtgaaactatctaatttttacattttgttcttcctgccccttttatagcttttatctctgatatcttaagatgtattttctatgtacagccatttcattgtgtctcagtaaaataacatgcctttgcctcttccttctcaactctctgttcatactttcctaggcctataaacagactatgctgacagaggtccatactttgtcccaggtgtttgcaaatgcttattgtgtacggatccacctctccaaggaataaataaaatcattaagcaatttcaatattatcacagacatgccaaataggaaatcaagcaggacaattgacttcccaactcatatgctaaaatgctcagtttcttatgtaaaaactgaatgtggcagtgctacctggtaaagtttccaatataggtatacatttgatatttcagaatactctgtgcaaattaagatgtgaattttcagttcaaagataatggggaaaggattccctatttaat

SEQ ID NO: 902 - DNA, 4788 bp, Homo sapiens
ttggcttgttgattccttttattctttgtattctatttcattaatttctactctattatttctttcccttcctgctactgcctctgagtttaatttacacttatgttatgggtgagtaatgcagacctctgagtcattgattgtgataccattcttcttttaatccttaggaattttacagagatatacttcatatatcacatatatatcatataattcttccgtttaaatatatttatagacgtgtgtaaccatcaataaaatcaatttttgaacattttcatcatcaccccaaaaaagactccacacccattggcagtcgctgctccttgttttgtaattcccaactcttttaacagaagccttgaaagctgtgcatttcactctaagaactggtgtagtggcatcccacacatttctacattttatataatcatcataatttattttgaaatattttgaattctcttttgatttcatccatgaactatgaattttttataagtatgttgcttaatattcacatattgggagtttttctagatatagttattaatttaatttcattgagatcagagaacatattttatataatttccttcatttcaaatgtttttagatttgttttatagttcacaatgtggtctatcttggtggaagtaccatgttcatagaaaagaaggaatctctggtacatgttgcatgtgtgtgctataaatgtcgattaacccatttatgcctgaggttgcaattttttgaaattttacaattagaccttggtgatgaccttgagcagtaggatataaatcattccacatgtttagtgttccaataatggaacactaggcataagtatttgtcaagatggttgacagtgttcagatctgttgttattttactgttttcatcagatcattctatcaattggtaagaagggggtgagatgatctccctttaatccttttgagtgttgcttcatgccttttaaagttctattattaggcatatacacatttatgattattatgccttctgataaattcacccttttaacactacaaatagtgcctttaaaaaaaatctctgcgaatagcaagtgaaaacctgacaacaagctcttggtgactctggacctgggcagtcctcagccttctgttcagctgctcttcccacctctcacatgaaacatgtctatgaaaggctgaggacatcacatctgcattcatgcgggcttcctagaacccacagtactcattcatccaaggagagcatgtcagtgcctggtggccacactatacaaggaatcgtggagtatcaggaataaggcacgaccctccctttccttaggacagttccagttcacagggagatgaggcacatacatcaataaccccaaagtccatgaaggtgcaaagagtcatgtggggctgcccaggcagaggtgacaaatgccactggtgacaggacactggtggacatagagggaaaagtccacacagacaggttcccaggcagacaggaagtcaaggcagttggggacgggagtcaaaacaagtgatgctgggacacagctctgaggtttgtgggcatctctgattgagggagatggaaggtgaggtcagagaatgaggttctcaattcatagatttgggctcataggggtgtgagagtgtgtgtgtgtgtgtgtgtgtgtgtgtgtgtgtgtaagagagcaagagagagaggtcttgttccaggtcttctcctccatagactctcctgaccctgccctgcctcttcctgagatgagtcattcaccagggggtttccttgccttgttcctcctggaccagtgttgtattaggctgttttagagggaagtttgccgttcacattgatttcctctctcaggcatacatgccctaaaaatgcctcgttgatcttaaaatgagcaactcagaattgttctgaggttgtgctgtggtgggaaatctgcttcttttgagtcttttgtggcttttttctttctttgttcttttggtataagaagaaccttggattaagaagcaagccatctgtcttgtagtcttgggccagcatcacggtccaggggaagccacttcttatctaaatatgtttcattcctgaaataagaggtgaccttaaatgacttctcagggacccccagctgtgacccagcgctaggtgaatgcaggcctcacgaacaagcaccaaatactcccctgggaaaggtcagcagaacccagtgacccaatcattgctgctgcccctgagggtcactcatctccgtgcccagcccctccactgaacgaatgttctgcgtctcacgctgcttgtctaagacaaggacaatgagggttcctgtacagtctggttgtatgaggattaagtgtgttcatatgtgtataaagtgctgagaacagagcttggcacgcgcaagtactgtatttcagcacatgctgttgttagtacaatcattcccctcaatgttgattttaatgaaatcacatcctccaggccaccaatatcttgacctggggccttgcaacggcacagcctccctctgccagagtcaagtagggagggatgacattcctggagccggcagtctctctggaggtgcagggagcggggaggtggcccccatgcttcctgatagctatttaggtccctggtgacacctcctccaccagactgtgggcttcagggagcaggactgacacagggctcatttgtcctcccaccaccaccaggcgcagacattctcagagtaaagggctcatcacctacttcctgggggagtgactttccctccaagcccatgaggtgagcccagtggtggcctcagctcaccgcctcaggtcacagattccaggctacagcacagggaggggaccccaaagagccctgtggactctgctgaggaacaccaggagctccgaggccgagtgcatggcagagatgtggagaagcagctgctcagaggaccttagccctgcagaggccaaaacatggctgctattatacagaaggggaggccacaaatgctacagacatggcttctgcagctcctttttgcctcaatcgaattgctgaaaccactgttaaggagaaagtcttaaaagcagccagagaacaaagatctccccacagacaagccaggtgagaggggcagtctaagccggagaaaccacagcaggaagaggcagcggcagaggccccactccagctggtgccgctcccccctcctcttcaccaggactattgcccctccctccacccagtgctgagacccaacagcagacatggggtgagggggtgatgcgcgtaacatgacctaagccatacaaatatattaccaacaaactccaatgacttaactttgaaattctttctttctttctttttttggttgttttgtgtgtgtgtgtgttgtttgagatggagtctcgctctgtcccccaggctggagtgcagtggcgcgatcgcggctcactgcaagctccgcctcccgggttcacgccattctcctgcctcagcctcccgagtagctgggactacaggcgtccgccaccgcgcccggctaattttttgtatttttagtagagacggggtttcaccgtgttagccaggatggtctcaatcttctgacctcgtgatccgcccatctccgcctcccaaagtgctgggattacaggcgtgagccaccgcgcccggccttgaaattcttctcatctaactttttaaagtggtcattcctagtttccctcattcctaccagtgctctggacagacttgcctgtggcctggtgcacacacttcccccactctgagctgcagtctcctcctctgtaaaatgtgatgattccttcaatttcctgcccagagacctggatgggctgtgagtctctgttactcagggtctccttgtgggcactgttctcacccacccaggccttggtgggcgatgtgagtgccggaaaaagaccacaggaaggcaaagaactgactcaggagtccacatccagggcttgcagcagggtccccagtacgcagctggacctgccgtccccacctcctcccaatgaggtcaacccaggcagcccaatctcagcacatccaggacccgctgctggggccaggcccccgatgctgtgctcaggcggacaccccatcctcaggttgcaggctgtggagtgagggtgtccagtgagggtcactcactgtggagtgaggctgtggagtgaagactacaggaaggacaggactgcagcaggacccgccggtctgtgtgatgctcaagatggccatgtgtcccccacagtcagcccagaaccccaagccacttcagagagtcagggcagccatgaggaaaagggattgtgtccgccagggctctgctgtgggtgggaggcagttcctcagcccatgaggcttccagtttctggagaaaccaagtcactctgtctacacgctcaggggccctttcaccacttggaagagaacgagtctccttagcaggtggggaggggcccatgcagcacctccctcccagaggacagtggggcacagggctgggctgggggctgggacactggacaaggagccctggggctggggacaggaatggggccttgcaattaggggacaccctgaggaagggggatgagaaggggaactagagtaaaaaccaacacacggaaaatctctgtgttctgctctgaccaaggctgaataaatcccgtgaccacttctcatcctcacccttgtcacccagttgaggagccg

SEQ ID NO: 903 - DNA, 4788 bp, Homo sapiens; identical to SEQ ID NO: 902

SEQ ID NO: 904 - DNA, 2519 bp, Homo sapiens
cggccagcccgcctgagatgatgtgggactgcgggttgtaggtccgctgcgtgttgtacatctgcaagcgctgcttcaccactgtggttggaaccgcggggcaggccagacggacagccagtgggcagtgggttggatgtggccccaccccaggtcggaatgaagccaagccataaagagaaacaagccagttagacaccggaaacaggcgagagccagcacacacagccctagtctgagcagccgcggagggccagctcccggcagtcctaggttaaaatccatttttatctccaggactcacgcctggaaggtggctatttccgtctctcctgcctgaatcttgctgaaggcagcccccgaaccaggcagccacttcagactagagtcgctgatctgtttcccagatcctggctacccctggtaggaaccctcaggacccaccacaaagctgaatcctgtcccctgtcccctctgccctcctccttccccaacacatctactggaagcgtgcccccttgtgtattctcaggggtttgtgcctctaatggtaattctagcttctgtgacacagtgcgtttggaacagacactagaattatgtctgcccaagttcaatgacattctaagtggagttcacaggacaagaggcaaatgagactaactgtggtaccttaggctcagggttttaatggcctcatgtattgccaaataaatacatacaatgtgctttacttttaaacaaataaagactgtaaaccaatagttatgacaaggagaaagagagagtttgagcctcacttttttctactttaaaaaagataaacaaaacccttgcttggttacacgaagttaactacctgtttactgactgggtccctgaatgaactgtcataaaaagaagcccaagatatataatatgtaagcgaatgtttatttgggcatttttaggtttttcattgaactacttcctagaagggtttcctctccaccccaccccaccccccaccaccgcttacctaagaatgcctctttcctgtccccaaaacactgtcttgaacgcattcattacaggacaagccatgaaggcaggtcagtttacttaaggacatcacatctcttgagaaagataatgtgtacaaaacaaaacagaacatgagctgtctttctcagctctctactttgtaaataaaaagggggaaaggtgtgtgtcccttcagcatgcctcgtgcggcacacgataaagaaatcaaggggaatggagaaggtgattttcttcacctgcccatcgggtcaacctcagcacccagaccacagagactccccgcccacctcccaacctgccccatcacaaccctgaaggtcagaccaagtcctctatctgctaggacatggagggtagctgagaacaaatttaatagcttcaccttgaaagacaaaagacaggcaaacttatagcatgagacttaaaatgttgaaacttttctcaccaattctcccttctggccaggaactattttcagatgaggcaaaaaggtgaaaagagctccacaactcacctaaagccatcgccaggtagagaatgacccagctgaaggcctgcccagtgccaggcccaaaaggtactcactattcagacacgagtacccggctaagacgccgggatatataaaaagggaacagactctggtctgcccagctgaggcttgcttcatattacccccgaaatttaaaagaacaaaaagaagataatgtggaaagagatggctaaaacaaaatgacccaatgtgaatttctgaagaacagtgatggacacactgcggtacatcgtattattctctccacgttcacatctgtttgaaatgtgatccataatctttcatattaaaaacagtcaaattgaacactagccctaaagaatagcctctgatgggttccccatacatttgtctaggatcgataagggttaacaagggctaagagagtgagtgtgtgtgtgtgtgtgtgtgtgtgtatgcacacataggttttagaatagtgcaaaagcatgcaacagaatcaccaataaacagattctggtccctagctccagggattctgatccagtaggttcggtgtaaagcctgagaattagcctttgttttcttttctgttttgaggcagtcttgctctgtcgccctggctgagtgcagtggtgcaatcacgactcactgcagcctcaacctcccaaactcaagcaattcttccacctcagccttccgaacagctgggactacaggcatgcaccaccacacctggctaatttttgtatttttcatagagacggggtctcattatgctgcccacgctggtcttgaactcctgggttcaagagatctgcctgccttggcctcccaaagtgctgggattacagttttaaaccaccatgccggccagaattagcatttcccttttttttttttttttttccttttgagatggagtctggctctgtggcccaggctggagtacagtggcgta

SEQ ID NO: 905 - DNA, 2519 bp, Homo sapiens; identical to SEQ ID NO: 904

SEQ ID NO: 906 - DNA, 2519 bp, Homo sapiens; identical to SEQ ID NO: 904

SEQ ID NO: 907 - DNA, 4917 bp, Homo sapiens
taaagaactacctgagactgggtacttatgaaacaaagagatttaattgactcacagttcagcaggctgtacagaaagcatggctagggagtcctcaggaaatgtacagtcacggtggaaggcaaaggggaagtaggcacatcttcccatggcagagcaggagagagagaaagagagagagacagagagagagagagaagaggggaggtgctatacactttcaaacaatcatatctcatgagaattctatcacaagacagcactagggggatggtgctaaaccattagaaaccacccccatgatccaatcacctcccaccaggccccacctccatcactgcgaattataattcgacatgagatttgggagatgacacaaaaccaaaccatatcagtctttaaagagttaagttaaaataagctctttaaagtgggccctaatccagtatgactggtgttcttataagaagaggagatttggtcacagacatggttgcatgcagaataaagacttttcgaggacacactgagaaggcagccatctgcaaaacaaggaaagagtcctcagcagaaaccagtcctgcagactccttgatcttggacttccagccactgcaatttaatggtgccaagaccatcaatggggaatggacagcatcttcaatgaatggtgctgagaaaactggatatctacctgctaaagaaccaactgggtccttaccttatcttaccttaccttatactatatgtacaaatcaattcaaatggaataaagacataaaactataaagctcctagaagaaaacatagggcaagagctttataacattgcatttgtcaatgatttcttggatatgacaccaaaagcacaagcaacaaaagaaaaaatagataaactgaacttcactgaaattgaagactttgtgccctaaaggacccttgcaagagagtgaaaaggcaacccaaagaatgggagaaagtatttgcaaataactttatctggtaaggaattaatatctagaatatataaagaggtcctataattaaaacaaatgagcagcccagttcaaacctggtcaaaggctctgaatagatattcctccaaagaagatatacaaatggctaataagtaccaaaagatgtgcaatgtcactagccactagggacatgcaaatcaaaaccacaacaagatacgatttcacacttataggattgccattaccaaaaaacaaaaaatttaaaaaaaaaacatattggtaaggatgtaaagacattggaagctttgtacatttctgatgggaaggtaaaatggtgcagtcactgtgaaaacactttggtagttccccaaaaaattaaacagaattactatatgatccagcagtttcactcgtaggtatatatccaaaagaaatgaagagagagaatcaaacagacgccaatattcacagcagtattattcaccatagccaaaatgtggaaacaactcagatgtccaccaacagatgactgaataaacagaatatggtatatacatagaatggaatattattcaagcctaaaaaggaataaagttctgacacatgctactacatgaatgaaccacaaacattatgctaagtgaaataagccagatataaaaggacaaatattatatgaatctacttacatgaggtacctagaacgggcgaatccatatagacagagggtcgaatagagattaccaggggctggagggaggaaggaatgggggttaatgttcaataggtgcagagtttctgtttgggatgattaaaagttctggagatagatgactatgacgtttgcacaaaaatgtaaatgtactcaatgtcattgaattgtacacttaaaagtgtttaaaatggtaaatgttatgtatattttaccacaagaaataaaatatagactggaggtcctcatgtcatggaaaattgtttttctgtcacttagtatgtaaagtggatgtgttctatttactgaagagtcttcgagatcagggaggaaagacagaattcatagaaaagagacagcacctgaattttccagtgccccctgcagcccttactcatgctcatcaatctaaggttttctgcaatcaattttcttctttccccctttcaaatgcttttcatgatggcaaataaggatgtcaagcttcagcacccttgcatctctggataaatgaaatgtcaccccagctgccgtccttgttcagatctgtgcaataaagagcaaagcataaaaccaagtcaaggctttgagggagtgacctacaaaatgcataatgtgaaacaatgcaaaagcgaaaggtgcaaaatccccatcaaagagctggaggctgacagatgcgccagtgataattcccatcttccaacacaggagcacagcttccattttccataacagaacaacagccagagcagctggaaggcagggccgcatcccagacttccaccaacaatgggatgagacttgacatctggaatcacaaccacaacagacctgagagacccaccagcttgatgacaagcttcttctttcaaagaaaggtatcagtctgggggacctagtgctgcaaaccatgacaaattaagtgtggcatccctcacttgcataatggaactcagtgatattttttaattaacaagagttatttttatgtaagcttctctcattcctccactgtgcgtgctcgggggctggtggtgaggaaaaagaaaacagctgtgcgggaagcatcaagaaaaggcaagtcatgaagtcttagagatcagtgacatgtaagaaaaagagtgaggagaaaaatattcctactaaagttttccatttgtttaccttccttgtcacatagacttccaagagttagaagtctaggatttgatctccaaatcttcctggcagattactcatcttcatttcattcatatagtccaggggtttgtacaaaggaagatgccagttcttccccaatcataactaagatatcaagagatattcttttgaaatgtaacaaaggagatctgaagttcatctgaaaaaaataaatggttttaggcggtcatgaccatgggatgctggaccaggatggtaagcttcaggaaacagaatctggagaatgcccagctgctcccacaggaagcatcagggaagaagaagaagaggtgtgaagtctgccttctgctctgctgggatccctttcacatctcctttgcctccaggcagttttggttcctggccatttccaggtgtgactcactcaggatggtaagcatcttctctcctacccagagtagaggatgaagacctcatctcagaggttgaagggagctccagagagaggtctcaaacttccagcattaactgctaaagaagcttcatgagctgctggagaacctgggaaatgaccaattatagggacagagctcaaatactctgggacactctagtagctgagaaagttccaactccagggtgatagaggactgcctggcaaaccatcatcaaagcagaagacctgatactaacatcacaggctatggtttattactgaagatcagtgcttacaccctgccagaggttcagaagcaaacttatcattgttctccctggagatgttggcccacattctgaaaagtgtggtcagtagtagcaacagaaagcaattgtgcttgccaagcacaatgtcactgtccccagcccttcccccaacacaacccagtaggtgcttcctggctgcaaacttgggaaagtcacttgacctgtctgaggttccacttcctaatctggcctggcgaagataagaaaaacagtttatttaaagtgtctagcaaagtgcttggaccaaaataggacctctgaaatggttatggtagtgctgttaaggtgatgttttaagtgctgatgagcacaaagatgggtaagatattccttctgttaaaatctacagtctaatgagagagaacaagatgaatgcacaataactgtcattcagaacaggattatgagaaggtgtgaatttctgtgaaaaatcagaacagggagtaatatgatcccaggtgattggcagggggtgggggtctggattcaactggagagggagctggcagggaaggcttcctggaggatgagagttcaacaaggggcaggtgtaggatgtgggtggccaagtgactgggcagaaggagctgcagaagtaagaccccaaatcaggaagacaagggcctgctgagaaacacgagctacaaagtgcaagtgcaggaagagttgggatgagattagaagggggtctggggccagactgtggaaggcccaaatgccgggctaaggagtttgtacttaattcagtggtcaacggggagtcattggaggctgttgagcaggagagttgctttctttacagctgtgccagactaaattaaacctaaacagtactttatagctggaaagggaaggcccaggaatagctcttgactcagaaacaggcattggggaaggtaatgagaaacagccgtgactgatcaaagcagagaggttaattaaatttgtaattattgtgaaaggccattaaaaaccctagttcactagagataactgctctagtggggcttcaaagacaaacgcttcttttaaccttgaatagggggatgtttgcttctctgtggaggagatatgattaagatacttaataaatggtagataaacatgcacacgtgtgtgttctctgtaaacccactcttcgtccctgcatatatctgtgtagctatgtagggtgctccacaagaggggtccccagcccccaggccatagagcgttatgggtccatgacctattaggaaccaggccacacagcaggagttgagcagagggcaagcaagcaaagcttcatctgtatttacagtc

SEQ ID NO: 908 - DNA, 2380 bp, Homo sapiens
aaagggtagggaacttccttcctgccccctccgagttttgcctctctcactggcagcaacccagcgcttccattgctgacctctaccgacctctacctgtggtccttcctctactgcagcagagacactgttttcttcctttgttcttccaaccccatggcacagaaacactctccactgcggccaaggattgcaggagaggtggcatcagtgattcaagacttcttttcctacctcttcagtgtttctttcagtgatctgaagttaaagccagggggaatatcacagaagtgaagtgcaattctcatcatgtcatatcaagagcacacactaacaaacaacatgacttattgctgaatattgaacttgatcacctggctgaggtagtgtttgccagatttctctgtaaaggtgaataaactgacactggaacattcaggaacttcttcatggtcatggtcacccagctagagtgtggaagccaggctgtctgattccaggatctgtgttcttaatcctatacataaggaagccataatgagtcaaccactatttttaagattcacagatgttcgggtccaattcaccagaatgccaagttatacagggttgtggaatcaaaaactgcaattagtaataaaatgtgatgctatctagaatgtttttcatacatatatatgcttcttgggactctccctgcaggttaagagaaattgagaaacgatggagaatttaagtgttttagatcctacatacattagacttaaaaatagtaactatgtacatgagtatttgtaaacttaagaatgaacataacatgaaccatgtggcacctataaaatgaaaataaaatacctacaaaccaaatgagagcaataaaagaagctttaaggactttcacttcagggagtctgaattagatgcgcttcttcccattcctccctctaattacaacaagcttggacgttacatacagaacaaacagaaggagtctctgaaagatgaagagaaggcaagtaagctacagacttcacaatgtaaggaataatatggtggtctagtggtggtaaactccctccattttccttttctgggaaagtcttcatctctccttaatttctgaagaacagctttgtcaggtaaagtattctgggtttacattttttttctttcagcactttaaatgaatattattccattctctcttggcctgcaaagtttctgctgagaaattcactgataggcttgagaagttcccctgtatgtgaggatccttttttatcttgctgctttaaaaaattatctttcgacaatttgcttatgatatgtcttcttttggttgaatctagctagagatctgagattcctgtgcctgggtgtttatatctgagattggggaagttttcagacattaattctttaaataaattttgtctctattctccttgaattctacaatgtacatgttagctcttttgaagatatcccataaatcttgtaggcttttcgctcctttttattttctcctctgatcaaatattttcaaatatccagcgtttgagtttaccaatttgtttttctgcttgatcagttctgttaatagtctctattgtgctttttcattttattcattgtattatttagctccaggttgtttggttcttttgaattattcccacccctctgttaaacttctagttttatttgtattgactttctgatttcattgagttgtctctgttctcctgtagttcactgagcttccttaaaataattattttgatttttctttctttttttttttttaagacaacagaaatatattttctcacacttctggaggctggaaatacaaaatcaagatgttggcaggacaacactccctccaagacttcgagaagaagatccttgcctttgagcttctaatggcgccaggcttccctggcatgtggttgcacaactccaatctcaatctcatcttcctgtgctgtcttgcctgtgtctatatgtctccgtcttcatatggcattctcctccctgtgcctccattttctcttttttttttattattatactttaagttttagggtacatgcacacaacgtgcaggtttgttacatatgtatacatatgccatgttggtgtgctgcctccattaactcgtcatttagcattaggtatatctcctaatgctatccctcccccctccccccaccccacaaaagtctccagtgtgtgatgttgcccttcctgtgtccatgtgttctcattgttcaattcccacctatgagtgagaacatgcggtgtttggttctttgtccttgtgatagtttgctgagaatgatggtttccagtttcatccatgtcactacaaaggaca

SEQ ID NO: 909 - DNA, 2380 bp, Homo sapiens; identical to SEQ ID NO: 908

SEQ ID NO: 910 - DNA, 2380 bp, Homo sapiens; identical to SEQ ID NO: 908

SEQ ID NO: 911 - DNA, 2970 bp, Homo sapiens
agaaaacattattgttttattcatttaaaaataattttaaaaatgtaaatgatgcacacgcttacaacaactcaaacaacattgcagacgggcttgtaatataaacagagttgtcagaagtttccatctctccccagccccagtgccacaggtcagaatcaattccttttttcttccccctactgggcattacctacattaataattctgcttgtctagtggttaattaattaatgtacctgcatggctaattttaggcttatgagttttagacatttactttctgctacgacagctaagaatttcctgcccgctcttcctcggaatatagttacatccttatttccacttctgttaattgtcttttaaagtccaggactacatacccttttctagttccatcgcgaaggcgggaagtctcgattcctcactgggaaaggtaaaagatcttaggtctgatgggggagtgcggcgaggagagctcggaccgcgacgtcgcgcgcccgcttcgaggagttttgagctcttagcttggtgccggggcccgcccggcgctagatgaagtgctcgtttactcggcctaagccacggtgactcgaaggtgagaatgcaacttcgcggtgcaccggctcaggggcctgcctgccgcgccaaggcttcggaagttctcagcgggaccgctgggacaggctttcctctgagggaagaggaggggatttgtgcctctgcacgttctttcctgtggaggggaaaatcaaaccctgtagccgtccgctgccgggtagggatcgggcgatgctcggcgcccgagttctccgccgttgaggtggagcccggcggcgggagcttagattctctgtgggccacatggtctcagaagaggccccgcggcccgggggcgcccgcagtgtcgctggaccggcggcagcgctggccacgccgtgggctgggactggcccggaacgcgggtggcggttcggcctcggagacccgcgcagccgtcggagcatctccgtgcctcgctcaccaccttcttttcctccgcgtccggcggagggtttcggcgcgcggggcaggcctggagcgccgtgagcaggccggatgcgggatacgccagtgactaccagagccagacccggagcgcgctgccggcggtgacggctaggctgggcccctgtccttgggccgagttgccgagctccctcggggacttgaaggtgaagggcgaggcgccggccggggccgcgggccgagccaagggcgagtctcgcatccggcgccttccaggtggggcgaaggtcgagcgccagaggctggcgagggacccccgcccagcttgacgcccagctgcgcccgacgccgggggaggcggagcgcggggaacccgggcgccgggaaccccggacgtgggagggctgggcttctgcgcggggagacgccgggcttggcgaacatcctcaagaaccggtcggtggctctacctccgaaaactctttcgtgtttagcgattctcatatttagtgtttccctttagggagacttgaccggcaattgcagactcgtcttgggagctggagatgacattaaataaaaagttcaaaaccaaattgttaattatctccaggggtgctggcagagagaggtgcatagaaaactctgggtgggttatttcctcctggagcattgcccctccgttgcctgcttacctgggcaagtgctggtctgcgtggatggcttattggcacttccgggaccctcatgtcgtaaggctgagacctaagaagctgattctgtccaggaggtgagatctgccccgataatcgtaggctgatggggtcgctgctctggcgtcatagttaatgttaacttccactcacactgtgttcgtctgggtgataaaagtgtgtggggcgcctctttgcaggcttcctgtcctcttgggagatgtctgcgctttgtgagtttgggaaacaactgggtacccagcgaggtgggcgcaggaggaggagctgccttcctccgggaggcggcgcagcgcggggatcttgcgggaccaggccagagaccaggaccgtcccccaaccgttcgcggccgcgtagccctgggcggcctgggcctgcccttccccgcgcagggctttccctcctgccggtcgctgccccgcacatggctctggtcgtactcccgctccactgccaccactgcccacgccctgcgtccccgtttgaccgcgtggagccggaccccgccttcctcgccccgcgctgccccaggcctgccccgcaccagcagctaagcgcaggtctctactgcaagcccgcagccccctcatcgctgggcctactggcgacccccggcgccatgcgcgtgaactgtgggcgacgggctcgcccttggcgggcggcgcgcgcggtttccagatgcagccgccgcgccggggcagctgacgccgcctccaaagacgcgccctgctggacggcgctgaccccacgcagccagcggagtctcctgggaacagcccaggcgccggtgccgacttcaacctctctgctcaggcctcttgagttgcgttaccagcttaccatgtattactaagactgacagaatataggaaatattcctgtctttctcagaaggaactttccagtaaagacagcgtttaatactgttaacgtctcaaaggaggcagtgaaaaatgtgctcagcttaagcatatgcaaagtcagtctatttccattttctacttatgcacattatattttgcattaaagtttgatcattttaaaagtggaaaattaatgggcagtggcagaaacagcttttttcccccaaaagtaatcttcttccaactagttttaaacattttactaacaattattgagtatcttctacattttaagtcattattttaaagttcttggttattgacatgttgtaaatttgaaaaataaagtttttcttaaaaaatt

SEQ ID NO: 912 - DNA, 3416 bp, Homo sapiens
agaaaacattattgttttattcatttaaaaataattttaaaaatgtaaatgatgcacacgcttacaacaactcaaacaacattgcagacgggcttgtaatataaacagagttgtcagaagtttccatctctccccagccccagtgccacaggtcagaatcaattccttttttcttccccctactgggcattacctacattaataattctgcttgtctagtggttaattaattaatgtacctgcatggctaattttaggcttatgagttttagacatttactttctgctacgacagctaagaatttcctgcccgctcttcctcggaatatagttacatccttatttccacttctgttaattgtcttttaaagtccaggactacatacccttttctagttccatcgcgaaggcgggaagtctcgattcctcactgggaaaggtgaggacatggatgcctccacccttccctgaagcactcctctcctcttctgcggaggtggatttttaaaaacagattggggttggggtgggggagggacagcacgcagaatattgatgcaaacgtcatatgaaaaaaaatacatataatatatatgtatgtatacctgcaaagtgctgttacatatacgtgtgtatattaacagcattatgaatcccagacaattggggccgcttaccgccgtggctgtgactttaaattcactcacttcttacatccactaggaaaagaggatttgtttccctaaagcctataaaaggggaaaggcttaggcgcagtggcagccccgttccccgcaccctcctgccctcgggtcccgggcgggctgcgggagttcctcctgcgcgggcgtctgaggcgctagaggtcaccggagcgcgctcccctcgccagggacctacactcttcccgctgctacattaggccgcattaacaaggatctggattcactttaatttaaaaggtaaaagatcttaggtctgatgggggagtgcggcgaggagagctcggaccgcgacgtcgcgcgcccgcttcgaggagttttgagctcttagcttggtgccggggcccgcccggcgctagatgaagtgctcgtttactcggcctaagccacggtgactcgaaggtgagaatgcaacttcgcggtgcaccggctcaggggcctgcctgccgcgccaaggcttcggaagttctcagcgggaccgctgggacaggctttcctctgagggaagaggaggggatttgtgcctctgcacgttctttcctgtggaggggaaaatcaaaccctgtagccgtccgctgccgggtagggatcgggcgatgctcggcgcccgagttctccgccgttgaggtggagcccggcggcgggagcttagattctctgtgggccacatggtctcagaagaggccccgcggcccgggggcgcccgcagtgtcgctggaccggcggcagcgctggccacgccgtgggctgggactggcccggaacgcgggtggcggttcggcctcggagacccgcgcagccgtcggagcatctccgtgcctcgctcaccaccttcttttcctccgcgtccggcggagggtttcggcgcgcggggcaggcctggagcgccgtgagcaggccggatgcgggatacgccagtgactaccagagccagacccggagcgcgctgccggcggtgacggctaggctgggcccctgtccttgggccgagttgccgagctccctcggggacttgaagtttagagtacacatttggcggtcttgtattcctagaagatggacttcgatttaccggttgatggtcttctccactcttccgtggggtcagccccacttgtcccgtctccagtccaatgtcagtttgtgacttaatcttttacatcgtgtacagtctgagccctcagaccccctcacacatgcacaaattgagtttatgcacagaacagatagtacctgtacttaaatgtagactcactggggagcacgtttcactccataagaaaaggggtaaaaattgtgcacaccataattgcaatattttacaagaccggtgctttctttatctcaggggtgctggcagagagaggtgcatagaaaactctgggtgggttatttcctcctggagcattgcccctccgttgcctgcttacctgggcaagtgctggtctgcgtggatggcttattggcacttccgggaccctcatgtcgtaaggctgagacctaagaagctgattctgtccaggaggtgagatctgccccgataatcgtaggctgatggggtcgctgctctggcgtcatagttaatgttaacttccactcacactgtgttcgtctgggtgataaaagtgtgtggggcgcctctttgcaggcttcctgtcctcttgggagatgtctgcgctttgtgagtttgggaaacaactgggtacccagcgaggtgggcgcaggaggaggagctgccttcctccgggaggcggcgcagcgcggggatcttgcgggaccaggccagagaccaggaccgtcccccaaccgttcgcggccgcgtagccctgggcggcctgggcctgcccttccccgcgcagggctttccctcctgccggtcgctgccccgcacatggctctggtcgtactcccgctccactgccaccactgcccacgccctgcgtccccgtttgaccgcgtggagccggaccccgccttcctcgccccgcgctgccccaggcctgccccgcaccagcagctaagcgcaggtctctactgcaagcccgcagccccctcatcgctgggcctactggcgacccccggcgccatgcgcgtgaactgtgggcgacgggctcgcccttggcgggcggcgcgcgcggtttccagatgcagccgccgcgccggggcagctgacgccgcctccaaagacgcgccctgctggacggcgctgaccccacgcagccagcggagtctcctgggaacagcccaggcgccggtgccgacttcaacctctctgctcaggcctcttgagttgcgttaccagcttaccatgtattactaagactgacagaatataggaaatattcctgtctttctcagaaggaactttccagtaaagacagcgtttaatactgttaacgtctcaaaggaggcagtgaaaaatgtgctcagcttaagcatatgcaaagtcagtctatttccattttctacttatgcacattatattttgcattaaagtttgatcattttaaaagtggaaaattaatgggcagtggcagaaacagcttttttcccccaaaagtaatcttcttccaactagttttaaacattttactaacaattattgagtatcttctacattttaagtcattattttaaagttcttggttattgacatgttgtaaatttgaaaaataaagtttttcttaaaaaatt

SEQ ID NO: 913 - DNA, 1582 bp, Homo sapiens
agaaaacattattgttttattcatttaaaaataattttaaaaatgtaaatgatgcacacgcttacaacaactcaaacaacattgcagacgggcttgtaatataaacagagttgtcagaagtttccatctctccccagccccagtgccacaggtcagaatcaattccttttttcttccccctactgggcattacctacattaataattctgcttgtctagtggttaattaattaatgtacctgcatggctaattttaggcttatgagttttagacatttactttctgctacgacagctaagaatttcctgcccgctcttcctcggaatatagttacatccttatttccacttctgttaattgtcttttaaagtccaggactacatacccttttctagttccatcgcgaaggcgggaagtctcgattcctcactgggaaaggtgaggacatggatgcctccacccttccctgaagcactcctctcctcttctgcggaggtggatttttaaaaacagattggggttggggtgggggagggacagcacgcagaatattgatgcaaacgtcatatgaaaaaaaatacatataatatatatgtatgtatacctgcaaagtgctgttacatatacgtgtgtatattaacagcattatgaatcccagacaattggggccgcttaccgccgtggctgtgactttaaattcactcacttcttacatccactaggaaaagaggatttgtttccctaaagcctataaaaggggaaaggcttaggcgcagtggcagccccgttccccgcaccctcctgccctcgggtcccgggcgggctgcgggagttcctcctgcgcgggcgtctgaggcgctagaggtcaccggagcgcgctcccctcgccagggacctacactcttcccgctgctacattaggccgcattaacaaggatctggattcactttaatttaaaaggtaaaagatcttaggtctgatgggggagtgcggcgaggagagctcggaccgcgacgtcgcgcgcccgcttcgaggagttttgagctcttagcttggtgccggggcccgcccggcgctagatgaagtgctcgtttactcggcctaagccacggtgactcgaaggcctggagcgccgtgagcaggccggatgcgggatacgccagtgactaccagagccagacccggagcgcgctgccggcggtgacggctaggctgggcccctgtccttgggccgagttgccgagctccctcggggacttgaaggtgaagggcgaggcgccggccggggccgcgggccgagccaagggcgagtctcgcatccggcgccttccaggtggggcgaaggtcgagcgccagaggctggcgagggacccccgcccagcttgacgcccagctgcgcccgacgccgggggaggcggagcgcggggaacccgggcgccgggaaccccggacgtgggagggctgggcttctgcgcggggagacgccgggcttggcgaacatcctcaagaaccggtcggtggctctacctccgaaaactctttcgtgtttagcgattctcatatttagtgtttccctttag

SEQ ID NO: 914 - DNA, 1246 bp, Homo sapiens
agaaaacattattgttttattcatttaaaaataattttaaaaatgtaaatgatgcacacgcttacaacaactcaaacaacattgcagacgggcttgtaatataaacagagttgtcagaagtttccatctctccccagccccagtgccacaggtaaaagatcttaggtctgatgggggagtgcggcgaggagagctcggaccgcgacgtcgcgcgcccgcttcgaggagttttgagctcttagcttggtgccggggcccgcccggcgctagatgaagtgctcgtttactcggcctaagccacggtgactcgaaggtgagaatgcaacttcgcggtgcaccggctcaggggcctgcctgccgcgccaaggcttcggaagttctcagcgggaccgctgggacaggctttcctctgagggaagaggaggggatttgtgcctctgcacgttctttcctgtggaggggaaaatcaaaccctgtagccgtccgctgccgggtagggatcgggcgatgctcggcgcccgagttctccgccgttgaggtggagcccggcggcgggagcttagattctctgtgggccacatggtctcagaagaggccccgcggcccgggggcgcccgcagtgtcgctggaccggcggcagcgctggccacgccgtgggctgggactggcccggaacgcgggtggcggttcggcctcggagacccgcgcagccgtcggagcatctccgtgcctcgctcaccaccttcttttcctccgcgtccggcggagggtttcggcgcgcggggcaggcctggagcgccgtgagcaggccggatgcgggatacgccagtgactaccagagccagacccggagcgcgctgccggcggtgacggctaggctgggcccctgtccttgggccgagttgccgagctccctcggggacttgaaggtgaagggcgaggcgccggccggggccgcgggccgagccaagggcgagtctcgcatccggcgccttccaggtggggcgaaggtcgagcgccagaggctggcgagggacccccgcccagcttgacgcccagctgcgcccgacgccgggggaggcggagcgcggggaacccgggcgccgggaaccccggacgtgggagggctgggcttctgcgcggggagacgccgggcttggcgaacatcctcaagaaccggtcggtggctctacctccgaaaactctttcgtgtttagcgattctcatatttagtgtttccctttag

SEQ ID NO: 915 - DNA, 7795 bp, Homo sapiens
tctcttcatatggatgcctgtgaaatttggtgccgtgactcggatctggggacctcccttgggagatcaatcccctgtcctcctgctctttgttctgtgagaaaggtccacttatgaccttgggtcctcagaccaaccagcccaagaaatatctcaccgattttaaatcggctcgcatgccctgcagctggcctgttgtgtgaacagtgagcacattacaggagtgaatttttcaacaggttattttccttgaccacctgcttgctgtaaaagaactctaaatggacaatgtatttccatatcccaaaaaatgatgtttttttggacataaggtgaagtatgaagttatgaggagaaaggaacagaggacaaccacacagagaaagtgtagctttatctactagagctgaagacattcaaatttatgatccaacaattctactctgaagtgcagtggtgtatatactgcaacaatgtgtactcatgtgccctgagaactagatatgaaaaaaccttacagcaatatgcataatagtaaaaaaaaaaaaaaaaaactggaaacaacaaaaatgttcattgaccatatacaatgataaatgtggtatactcgtagcatggaaaactacacaacattgaaaatgaacaaactaaaactgtacacagcaacatgaacgaattccacagataatattgagtgaaagataccagacaccaaataatatcccatatgatttcatttacattaaatgttttttttttgagatggagtctcgctctgttgcccaggctggagtgcagtggcacaatcttggctcactgcaacctctgcttttcaggttcaagctattctcccacttcagcctccccagtagctgggactacaggtacctgccaccacgcccaactaagttttgtgttttcagtagatatgggggtttcaccatgttggccaggctggtcttgaactcctggcctcaagtgatctgcccaccacggccttccaaagtgctgggattacaggtgtgagccaccgtgcccggcctcatttatattaaatttaacacaggcagactaatccattatgctagaagtcaggagagtggttactttgaggaagagaggactgactgatcaggcttgaggggattctaaagtggtggcagggtttggtttcttgaccaatattactgatattcattatggagctccttaaacactttaaattttacttgtgtaatgggattatgtctacttcaagcggttattgtaaggattaaataacaatgtatgtaaagtgctgtgcagtgtaccatgtctaataaatactccaacagctgtaattgtcattgctatcaatatcactgttaagctgtatatataataagttttgaaaacttacatagttaaccatattcaatctccattttgtgttagacagttctcaaaccctgaggtgctttcctggaaacagtcctattgaaagcagctgctccattattgtaaggatgttgttgagggtattggtgttatagcacatttgttctcttgggaaggacctaccgaagaaatatctttctgatctcaatttgaaattaattgtactctcctgagcaacagattttgattattgtccaagtttaatattacacacattgtgaatcctgtagggaaatgtatctttcttcttggctttctatttggatactgaaaatcttagaatcaaatctgtgctctagctttatcaaatgtatatagacttacaccatgcattttctggataaactgcgttttccttatttacttgtttttgtttgtttttgtctcatgtttatgtaagctaccttaaattcttttgggagcaagcagaaggcttaagcacataaacgaaaaacaaataaatgacatcatgttggatttagttatggaaatatctgccaagacagtagtattcaccaagttgaaactcttaaaaaatgtgctgaataaatgaatacatgagcgatttggcatttggggatggctccattaaaaacaaaatagaacttgagcaaaactttggaaaaattgaagcctgtgtaatgaataagggactggggcatattgaaaatgatagtataaaatggagtgaaatcagcatggcactgtgatccacagaacatcctattcagagtacagaagtgttggcgatagacgtcaattgatgactgtgatgggggacactttcttcttcacaataaaatgaagaagggacaaatccaagtagaaaaattaatagccttagtaacaaattacacagaaagtgcagaaaaggagaaatcaggagtcttttcaagattgtttttggcttaacatagaaatgaaaatttgagggacagccaactaaagaagccatactcaaacagctcatgagacacagttacaagtccaggcaattaatttcttcattgtaaatcacaaatttagaatttgtgaattctgatgatgtagttttgtatttcgtacattaataaatcagtggaatgtaatatttctcctttgggattgattgcaagcaaaggtcagttaggacttgaacaatggatggagcagaagggataaaaaattgcatcattttatcatggttttagtacttttataacaaaacataaatgcatggtttgtatcaacaaatgaataaaagaattgtaaaaaggtctacatttagcattttaacttatttattcaaaactattagtataaagtatatgcaaggcacagtggtagacaagatggacataatctttggcctattaaagcttatatttttgagaaacacaccaaaataaatgcctgtatctgaaaattcatgcaaaatttcaaataaggcattagaagatactgataaaatggcttcccttctctcttatgctatgggaaattattgctcacaaaatacaagttgctatcttttcatgacttttgtgtagatttaaaaatcaaattattatttacaaagcagcattactggagtaatgaatacttcctccttattgatttttctgaaaactgccttccttatttcattcacacttcatctataattgggaaagggaaactactaaattgataaattcaacaaagggggaatatatcttgaatacgaactgttattactgttgacagtccaataacagagacaccatagaaaaaattatgggagttcttgaaattggctgaagcaattttcagcacactatatttcattcttagacaaaaccaaagccttatttcttacacattttttagaagtcaacatctaacaggcagtggaaacttctccaaaattacttggcattacccaattctatcaactgtttaaaactcaggtatttcagtattgggacctctaattgggatgtctatccatttaacaattctaatgagtttattttactggatatgtgcctgacaataacattccatagttgctaaaatgtcttatcattcaaactccttgttggggtgcctggtagctacacactatttgggaactgcagatttgctgggcagatagggagaccttaattagggaagcttgggtatactctggttttcagctttcccacctttcatttgattttttcatcatcttagtttttcctttgtgaggcaatttcctgaggaaaaactggggttactgcctttagtgtctgctcacccccaacaagcttttcctttcctgttactgttttttcttcctttgattttttttttttctctgaaacatacgtatcaatgagttctttcacttgataatcctgagagtcctggatccgaactgcaacttgaggcagagatttgggggatctatttttacgtacattatcttcattttgaaggtgaagaagccaactgtaggtgaattttccaggactgagcagagtttagagttcagaaatcatacacaaatagccatcaacagtgaatcctgtcctcttgattcctattctgacttctgcaagttttccaactatggcctttacctctacttccctctacacatcaccattgtaacccatgtgtatttgaggtcaaatctggccaagagtaccctataagttgagaaagtaatcctaatgttctgagcacaaaatagtgttctttgtagcataaaaaaggaccttgacacactattaaattttaaattattttagtacatgtttttatattttatttcatttttgaaaatagaatatttgttcaaagatatttgtcaagataaaacttttcttatgataattaaattacaaaaaggattgcattatgtggaaaattattgttttcttttttttttgaatgtatggtaccttccagcctgttactcgtgcaaatactccaaaacaaccccaaagcatgcacatcatccagtatattattgacacagtgtatgttccacaagtgcttgcttagtcttgaagaggtaaaggaaataccctattggccagcttaaagagagaggttgcctttcaatggttgggaatgatttttgttcatgtcactatcacacttgaacagacctttgatggggctatacagatcacagaataaagttcaaatctgactcttacttagctctccaatgtaactctttgccccatctgcctccatctatccccactctgcaccacaagtggcaaatttgcaggctggtgggcttgccaggtaacacccatgggtgaactggtccagggaaatgaacatatgcttgttgtttgggtgatggctgtggagaactgggaaggtccacactgtctaaggggtgctgctactcagctccacctagcgttgctctgctggaaggagggggtctgatgttgccaactcccctgctttacattaagaaaaggcagaaagaggctgggcgcagtggctcaggcctgtaatctcagcactttgggaggccgaggagggcagatcacgacgtcaggagttcaagaccatcctggccaacatgacaaaacctcatctctactaaaaatacaaaaattagctgggcatggtggtgtgtgcctgtagtcccagctacttgggaggctaaggcaggagaatagcttgaacccgggaggtggaggttgcagtgagccgagatcatgccactgcactccagcctgggcaacagaacgagactctcaaaaaaataaaaaaagaaaaaaaggcagaaagatggctactgaatcttgaaatgtcctgattttctaatattttgtagggtatacttttattcactccactggtcatattgatgagccttttcccgtccattggctcgtaactgttgtcctccccaaatccgtactctaagcaaccctgaatatttgcagttttctcagaatctggcatattttcagccccctcagctttctaccccactttggcttacgctgctctctgtctgaatgtcctctccactcatcctcttagcaaagttctatccacccatttttaaacactgaccaaagacagtcactaaaaggcctttttcaacctcccttccacctgatgtccaacagcccagcgaagctatcctttttctcgtttcacttaacattgctcatacagtgtaggaggtacaatattgaaatgtatttagctgtgactgatagccatttcccccactagcatgtaagccacattcttattcctcttcatatccttgatgttctacacagggagcagcaccaagaatggccagtgcttgttgaaacggcacatagaatagagttcttgcaaacttttttacctgcaccttcaccaagaatcatttttaacttgtaccagaacaagaaaacccagaaatgtttcatgatgacatagaacccaaagttcagatttcagaattatgcatgctcagagactgtatctttggaaccagtgtggccacctgctgctgtctcctgcagaagtgaaggcacaagtggtcttgctctcaggggcctcacattctagaggcaagctggagcagttcatttcaatactgactatcactcaagtgcctgctcagctagttctgaaagtagatcagccaacattctccttttccatcattctagcttttagatgcagaaccttagaaacagaaggtggtgagatgttaagcagtttatccaaagacacacagcaaggtagtgtcagacgtgcctgtagagatcatttcttagcactgaatgcagtaaaagttactccaaacatcttggtttcctttctcttgaacttggttgatgacttcctattagtacacaccctttacacaaaactggcacacacaaaacacgccacatgcatgagtgtttttaagaattaggggtcagccactcttaccagattcaaatttgttgtatcttttaatcatttggcttggtgccttaaggtttcaaggtgagcttggctttcaagctacagcagaaggtgtggagccagaaagcccctgcctggagccctgcagtgtgtccttcctggccgctcttccttccggctctcaactccttcctgacaaccctccacggatctgctttccttctggagtttccacattctagcactttcctaacctggacaaaccccatacactgcttcctgtccacatcaccatacccttaatctcatgtcccaggcctttagtttccttcagcagaccacagggttgcaggtgaaaatgggagggcgtggctcctccccacaagtttttgtacttaccagggcctcctgctggctatgtctaagggtaaagtagtgagtaatgcacacctattgggggattttcatcacacaggcaaaggggcatttgaggcctctgatgcacattctgtatccagccactcccatgccatgccatcctttgaaataaattagacggtatatcaggcagccaggactgtcataacaaagtaccacagactgggtgccttaaccagaaatcaacttctcacagttctggaggctagaagtgaaagactgaggtgttggcagggttgctttcttctgaggcatctctccttggcttgcagatgactgtcttctctctgtgtcttcattttgtacctgccagtgtcctaatcctgtcttattataagaacaccagtcttcttgggttagagcccaccctaatgacctcattttaacttaattatctcctttaaaaccctatctccaaatataatcgtattctgtggtactgggagttagggcttcaacagataaatatgtggcagcaggcagggatggcagggatgttgtaatttagctgatagcagatgggaagccccaactccgaaattcacctaccccttctattccacttcatattatggtaacatagggttgaccaagaaggacgttgggtcactaggtgacaagatgggtttcatgcgcctttgcagtcccagacatatgcacacgtatgcctcagaaaccaccctgctccttccacaccatgttctatgggactaaaaccacagggctggcctacacagcaagtggcgatgaaacttgacttacacttgttttacatcatggcacctctctaagaaattttttttctagaataaaaagtgatacaaatcagttaattgaagtttgtgttaacacaattctttttgaaataattctatgggcatctgtgttctagaatctgcattagtgttagttctattgaataatcctcctattgggatctgttgtaaaaattttcttctaaagtaagttatctgcaataaatgttcatgcaccttcccttaaaaatataattaatatcctcttt

SEQ ID NO: 916 - DNA, 14742 bp, Homo sapiens
ttttctttgctttcctttttctttccttttaaaaactttttctaaataatgaggaattttaaaagcacagaaaagagaaatacaacatccttgcatctgctaatcaaaacaaataatcactaatttttaaaattatttttcctaaagaaattacagagcttaagtccttttcgtgtctcatatgcaaccttcatgttccttctacccaaagacaaacactgtgctgagtttgggatgtattccttacatcattttttttcaccattttatgttaatgcacataccccaaaacaatgtacattattgtctttgtattatgttcatatcaattatatcatgatttctgcaacttactttttttactcaatatggtatatttttgacatggatccatggtgatacatattgtcaggcctctgagcccaagccaagccatcgcatcccctgtgacttgcacgtatacgcccagatggcctgaagtaactgaagaatcacaaaagaagtgaatatgccctgccccaccttaactgatgacattccactacaaaagaagtgtaaatggctggtccttgccttaagtgatgacattaccttgtgaaagtccttttcctagctcatcctggctcaaaaagcacccccactgagcaccttgcgacccccactcctgcccgccagagaacaaaccccctttgactgtaattttcctttacctacccaaatcctataaaacagctccacccctatctcccttcactgactctcttttcggactcagcccccctgcacccaggtgaaataaacagccatgttgctcacacaaagcctgtttggtgatctcttcacatggatgcacatgaaatttggtgctgtgactcagatcgggggacctcccttgggagatcaatcccctgtactcctgttctttgctccatgacaaagatccacctatgacctcaggtcctcagaccgaccagcccaaggaacatctcaccaattgtaaatcaggttattttccttgaccacctgcttgctgtaaaagaactctaaatggacaatgtatttccatatcccaaaaaatgatgtttttttggacataaggtatatgtttcaatattacttcactgattggaaaatggtaatatcaaataagacctaaacaaaataaatgtgaatgatccctaatttataataagtatcctgcatgttattatgaagatcaactgacagacaagtatttatttaaaatttttattgactgtgttttatccacttttgaagggtccaaggtgctcagaatatctgctgttaagtctgggtgtctcttttaaacagaaattgcatagtacagacctcatccaaagtagctgtatggatgagataaattgagtacagaagagtttatatttctaagctattctgttctgttgtatacactaaacatgacaagtttaagtagatccaaagtggataatacttttaatcttctggcaatttaagtagaaactttatagcctgtgttttgatttcaagcagaaaataacatacaatatagatttaatttacatttattaccataaaagcacatatactttatcatcccattttctttattatatggaataaaaatttagaaaacacttttttgagtactgttgtatcagggaacctgcccccgatagtcatgtagtttcttttctattttcccttagcgtcggccgggttgagaaataaggggacagagtacaaaagagagaaattttaaagctgggcatctgggggagacatcacatgtcagtaggttctgtgatgccccacaagccgtaaaaccagaaagtttttattagggattttcaaaaggggagggagtgtacgaatagggtgtgggtcacagagatcacgtacatcacaaggtaatagactatcacaaggcaaatggaggcagggcgagatcacaggaccacaggaccagggcgaaattaaaattgctaatgaagtttcaggcaccattgtcattgataacatcttatcaggaggcagggtttgagagtaaccggtctgaccaaaatttattaggtgggaatttcctcgtcctaataagcctgggagccctacaggagactggggcttatttcatccctacagtttcaaccacagaagatggccacacccaaaggggccattttagaggcctaccctcaggggcacattctctttctcagggatgttccttgctgagaaaaagaattcagtgatatttccatttgcttttgaaagaagagaaatatggctctgttctgccaggctcattggcggccagagtttaaggttatctctcttgttccctgaacattgctgttaccctgttcttttttcaaggtgcccagatttcatattgttcaaacacacatgctctacaatttgtgcagttaacgcaatcatcatggggtcctgaggcaacatacatcctcctcagtttatgagatgacaggattaagagattaaagtaaagacagacataggaaatcacaagggtattgattggggaagtgataagtgtccatgaaatcttcacaatttatgttcagagattgcagtaaagacaggcataagaaattataaaagtattaatttggggaactaataaatgtccatgaaatcttcacaatccatgtttttctgctatggcttcagccggtccctccgtttggggtccctgacttcccgtgacactgttggtaagtattaatacatacatgccatagatgacttaatgtatattgtacaactatcttctttcaggtggctaattatatagataactaagttgtctatatccctaaaataaagttattcataggtatgtgataaacatttcatctgtctcctactcttatatatatgggcttaactgaattgaatttaaaagaagtcagcttaaaacatatgaaggaattgggagacgtgatgtgatttgctgatgtttaaatcttgtggaccaattacacaaagaatcagtcaacacagggttgtcgatattgacaatctgtctacagaccatgtgtagaaatgtagaaatgaacacaaaggcatgaacacaaatctctgacattgtataattttaaactgcaattaattactagcagctatgcaaaaaataatttacattaggatataataaatttattgaaaaattaagtatacatgcatttttttgcataaatgcaaaaagaaattgagtgaaaaaaacagtgcaaaaagtctaagtaagagtttaaggtgaggacagtcatggagaggaccatttcaatatatcactactgttattcttttgtcagttatatatgaaaaacacatacaaaagaatggaaaaggaaggtaataacaatattattagatgatagttgatgtttttatttaatatatgctattatctaacatatgctataatttaatgacataaagggtcaatatatactctggcccatatactgggtgacttggaggctcccatttttgagcggagcacaaaacataaggtgctgtagcagctctaggctgtggtataatcagcctcctgccttagaccatacaattttaaagtccctatggtgttggagaaaccagcagttggaaaagatgcagtatgaagctcttctaaatactttttttcttggcaaagaaaatggcaaagatatgtgcaaatctaaacaaacattaactgcatacacaataagaataatgttcaatatgggaggattaagaaaatatgtgagaacgaaaagatttatgtaataacatgtatgctgggatgtagatggtcagagttaacccatcctaaaatctttgcattatttggtgcgaggaaaaagattttgattaattttatattaaagtcagtgttcttgttagaattttaagaataaccactgaaaaaattgtactagaatatgaaacttgtatactaatgcagcaaaaaaatgaaatacaaaatgtaaaaactcaacctacatcagagaagaacttaaaagtaggatagatttaaaaactccagtagaaataaatcaaaatatgtcagtaatcataatatattattttgagatacatatatacacattataaaactatgaagtaaagcaaaggaatgataaaattgcatgataatattttcttggaagagacaaagttgaatgctatcaaggaagggtactgaaagagattcaaatattatgagaaatcttttctcttaaggtaggtagtatatacatagatttttttctttctttttttgtatatagatatatacagaaatttctttattctcgtgttttaaaatatttcatcattttacaatgtatgcatatatcataacatcacattatatctcataaatatataaaatgaatatttgccaactaataataaaataaaattttaaagatagatgaaatgcaaatggtctaagcacattaattaaaaaaactttgtcagaaaaaatattttataataaatattaaaagagaaaaactacagatacacttcagagaaaaataatcatgcaaagattattagagcatggacagctcattttataaggaaagcattcagaattacagttggggaaaaaagaatatttttagtcctgaatgaagttattaaacttgacaaggtttgtttgtttttggagttgctgttttagatctttcttagcttttcttccagtgtttatttatacttactgtcaggaacttattctataaatcttattgaatcatcatcttaaggcatcttataacattttattgtttgtaagaagagcaactgaaatatcactcattattctttcaaatcaaatcagtggcatttactctactctcttagctaaagctctcctggcctctgttgccgagtgaatcctgaggctgctgcagctgggagaattgaggcataaccataccaggcaattattgtttccaattaaatgccatctctttcttcacagagaggcaaaagtgtccacataaatatcccttgatttgtttctgtcttttttttctgctctgtccattgcctacgtggcttccaccttccctaagttaagcaaaattggaagtccttgctgtagtttgggcttctcatggtttgatgggataagtcttcttggccttctgtggtcaccaagtgtataactagtgtctgaagaaacagtgatggtgagaggcctcatcaaaagtagttctgctaataatcccagcactttgggaggccaagtttggaggatttttttgagcccaggagtttgaaaccagcttgggcaacacagcaaagccccatttcttaaaaaaaaaatagctgggtgtggtggtctgcacctgtagtcccagctacttgggaggctgaggtgagaggatctattgagctcaggattttgaggctgcaatgagctatgatggtgccactgcactccagcctgcatgacagagtaagactctgtctttaaaaagaaagaaacaaagttttcaatgcagctgattttgacagttaaaggaacagttctccaaggtgaaacccttgaggataaatgataccagtagcagataagtggcagaagtggaacctaaacctacatagatgaggcccaggtctaaatgatgcacagatgtaatgctgcccaggaaatcacctgagactttgtgaggttcacttatctctctgaatggttactgctctgaaagtacctccctttgtcttcctgtgctttgaggaaaaactttctcctcttggtgatgcattctaattcctcatacctcatgtgtaataattaagtgtgtgaatctcagggcagccccttctgaattgtgggcccaacttgtctaaacgtcagtttcctatcagtaacatgggccagagatagcacttatgatattgggtgctgggaagaatttaaaaagataatgcaggtagagttcacaataaacataggttagtctcatcactaacctgttagagcagtgttttcaaacttcttatataaaatatataaagatgaattttaaagaaaaacaattctgacagactccaagtttttatttatattatttttatacttctcaaataggtacaaaaataaaagtagatataaattctgtatttctatagctgttaaacatctataaataaaaatgtgtttatagattaaattcaaagccccaaaaacagtgcaattcaaatagatgatattaatttaatgttgtttgttcaaaatggtactgggtgccatagcaccaattcttttgacatgttttgagtttggcatgctttaattaccatatgctgcatgatacctcagttctttcatatttaaaatctgaattatttttaaactgcatgtctgaacaccgctttagcatacaacttttcttttttttctcattagcctgaagtttagttttaatacaatgggtactgatgctgttgtacaaatgaaggcaaacaggaacacagacactgagtactgcaaatgcccagtgaaaggtggtcctctaagtgatccagaaagttcttcattaactttctctataatcagctaagtcgatgaaaacacagaattaaaatattttcatggaaattttgcaaatgtcctagatgagctacatggatctcagttgagaagctttaatatttctttgttaaaactggataattatttctgaacatgccagagaatagtgttcagataacagttaagcaattttcctggtaaattcactaagatctaccaagtggaaagcatcattttctgttctatacctttttactgaaggcaagagatatttccttcccagggtaataatagcttttcttggcataaacattaatctgagaacttagaaactttgactgggaattctgaatactaatggtcgtgggtgtaaaatgaagtaatttatgtgtcatagctaattaagattacagtatttcaaggcacttaaaattcaagttcaaagaaattttaatgctttggtctgataggtggtgtcaaggagcccttgaaagggcttcctgcctacagcaataggcgtgcagcagctcatttaccacatcctataattaaagtagaataaaacttcactcatatttgttttggatcctaaatatttcaaagaaaatttagtcattacttgcaagtttatttagaaatggaaagcttttgtagggtttgttttataatcttttcattagtaaatggctttcattgatttgagctatttttctgatgtaggtgaagtatgaagttatgaggagaaaggaacagaggacaaccacacagagaaagtgtagctttatctactagagctgaagacattcaaatttatgatccaacaattctactctgaagtgcagtggtgtatatactgcaacaatgtgtactcatgtgccctgagaactagatatgaaaaaaccttacagcaatatgcataatagtaaaaaaaaaaaaaaaaaactggaaacaacaaaaatgttcattgaccatatacaatgataaatgtggtatactcgtagcatggaaaactacacaacattgaaaatgaacaaactaaaactgtacacagcaacatgaacgaattccacagataatattgagtgaaagataccagacaccaaataatatcccatatgatttcatttacattaaatgttttttttttgagatggagtctcgctctgttgcccaggctggagtgcagtggcacaatcttggctcactgcaacctctgcttttcaggttcaagctattctcccacttcagcctccccagtagctgggactacaggtacctgccaccacgcccaactaagttttgtgttttcagtagatatgggggtttcaccatgttggccaggctggtcttgaactcctggcctcaagtgatctgcccaccacggccttccaaagtgctgggattacaggtgtgagccaccgtgcccggcctcatttatattaaatttaacacaggcagactaatccattatgctagaagtcaggagagtggttactttgaggaagagaggactgactgatcaggcttgaggggattctaaagtggtggcagggtttggtttcttgaccaatattactgatattcattatggagctccttaaacactttaaattttacttgtgtaatgggattatgtctacttcaagcggttattgtaaggattaaataacaatgtatgtaaagtgctgtgcagtgtaccatgtctaataaatactccaacagctgtaattgtcattgctatcaatatcactgttaagctgtatatataataagttttgaaaacttacatagttaaccatattcaatctccattttgtgttagacagttctcaaaccctgaggtgctttcctggaaacagtcctattgaaagcagctgctccattattgtaaggatgttgttgagggtattggtgttatagcacatttgttctcttgggaaggacctaccgaagaaatatctttctgatctcaatttgaaattaattgtactctcctgagcaacagattttgattattgtccaagtttaatattacacacattgtgaatcctgtagggaaatgtatctttcttcttggctttctatttggatactgaaaatcttagaatcaaatctgtgctctagctttatcaaatgtatatagacttacaccatgcattttctggataaactgcgttttccttatttacttgtttttgtttgtttttgtctcatgtttatgtaagctaccttaaattcttttgggagcaagcagaaggcttaagcacataaacgaaaaacaaataaatgacatcatgttggatttagttatggaaatatctgccaagacagtagtattcaccaagttgaaactcttaaaaaatgtgctgaataaatgaatacatgagcgatttggcatttggggatggctccattaaaaacaaaatagaacttgagcaaaactttggaaaaattgaagcctgtgtaatgaataagggactggggcatattgaaaatgatagtataaaatggagtgaaatcagcatggcactgtgatccacagaacatcctattcagagtacagaagtgttggcgatagacgtcaattgatgactgtgatgggggacactttcttcttcacaataaaatgaagaagggacaaatccaagtagaaaaattaatagccttagtaacaaattacacagaaagtgcagaaaaggagaaatcaggagtcttttcaagattgtttttggcttaacatagaaatgaaaatttgagggacagccaactaaagaagccatactcaaacagctcatgagacacagttacaagtccaggcaattaatttcttcattgtaaatcacaaatttagaatttgtgaattctgatgatgtagttttgtatttcgtacattaataaatcagtggaatgtaatatttctcctttgggattgattgcaagcaaaggtcagttaggacttgaacaatggatggagcagaagggataaaaaattgcatcattttatcatggttttagtacttttataacaaaacataaatgcatggtttgtatcaacaaatgaataaaagaattgtaaaaaggtctacatttagcattttaacttatttattcaaaactattagtataaagtatatgcaaggcacagtggtagacaagatggacataatctttggcctattaaagcttatatttttgagaaacacaccaaaataaatgcctgtatctgaaaattcatgcaaaatttcaaataaggcattagaagatactgataaaatggcttcccttctctcttatgctatgggaaattattgctcacaaaatacaagttgctatcttttcatgacttttgtgtagatttaaaaatcaaattattatttacaaagcagcattactggagtaatgaatacttcctccttattgatttttctgaaaactgccttccttatttcattcacacttcatctataattgggaaagggaaactactaaattgataaattcaacaaagggggaatatatcttgaatacgaactgttattactgttgacagtccaataacagagacaccatagaaaaaattatgggagttcttgaaattggctgaagcaattttcagcacactatatttcattcttagacaaaaccaaagccttatttcttacacattttttagaagtcaacatctaacaggcagtggaaacttctccaaaattacttggcattacccaattctatcaactgtttaaaactcaggtatttcagtattgggacctctaattgggatgtctatccatttaacaattctaatgagtttattttactggatatgtgcctgacaataacattccatagttgctaaaatgtcttatcattcaaactccttgttggggtgcctggtagctacacactatttgggaactgcagatttgctgggcagatagggagaccttaattagggaagcttgggtatactctggttttcagctttcccacctttcatttgattttttcatcatcttagtttttcctttgtgaggcaatttcctgaggaaaaactggggttactgcctttagtgtctgctcacccccaacaagcttttcctttcctgttactgttttttcttcctttgattttttttttttctctgaaacatacgtatcaatgagttctttcacttgataatcctgagagtcctggatccgaactgcaacttgaggcagagatttgggggatctatttttacgtacattatcttcattttgaaggtgaagaagccaactgtaggtgaattttccaggactgagcagagtttagagttcagaaatcatacacaaatagccatcaacagtgaatcctgtcctcttgattcctattctgacttctgcaagttttccaactatggcctttacctctacttccctctacacatcaccattgtaacccatgtgtatttgaggtcaaatctggccaagagtaccctataagttgagaaagtaatcctaatgttctgagcacaaaatagtgttctttgtagcataaaaaaggaccttgacacactattaaattttaaattattttagtacatgtttttatattttatttcatttttgaaaatagaatatttgttcaaagatatttgtcaagataaaacttttcttatgataattaaattacaaaaaggattgcattatgtggaaaattattgttttcttttttttttgaatgtatggtaccttccagcctgttactcgtgcaaatactccaaaacaaccccaaagcatgcacatcatccagtatattattgacacagtgtatgttccacaagtgcttgcttagtcttgaagaggtaaaggaaataccctattggccagcttaaagagagaggttgcctttcaatggttgggaatgatttttgttcatgtcactatcacacttgaacagacctttgatggggctatacagatcacagaataaagttcaaatctgactcttacttagctctccaatgtaactctttgccccatctgcctccatctatccccactctgcaccacaagtggcaaatttgcaggctggtgggcttgccaggtaacacccatgggtgaactggtccagggaaatgaacatatgcttgttgtttgggtgatggctgtggagaactgggaaggtccacactgtctaaggggtgctgctactcagctccacctagcgttgctctgctggaaggagggggtctgatgttgccaactcccctgctttacattaagaaaaggcagaaagaggctgggcgcagtggctcaggcctgtaatctcagcactttgggaggccgaggagggcagatcacgacgtcaggagttcaagaccatcctggccaacatgacaaaacctcatctctactaaaaatacaaaaattagctgggcatggtggtgtgtgcctgtagtcccagctacttgggaggctaaggcaggagaatagcttgaacccgggaggtggaggttgcagtgagccgagatcatgccactgcactccagcctgggcaacagaacgagactctcaaaaaaataaaaaaagaaaaaaaggcagaaagatggctactgaatcttgaaatgtcctgattttctaatattttgtagggtatacttttattcactccactggtcatattgatgagccttttcccgtccattggctcgtaactgttgtcctccccaaatccgtactctaagcaaccctgaatatttgcagttttctcagaatctggcatattttcagccccctcagctttctaccccactttggcttacgctgctctctgtctgaatgtcctctccactcatcctcttagcaaagttctatccacccatttttaaacactgaccaaagacagtcactaaaaggcctttttcaacctcccttccacctgatgtccaacagcccagcgaagctatcctttttctcgtttcacttaacattgctcatacagtgtaggaggtacaatattgaaatgtatttagctgtgactgatagccatttcccccactagcatgtaagccacattcttattcctcttcatatccttgatgttctacacagggagcagcaccaagaatggccagtgcttgttgaaacggcacatagaatagagttcttgcaaacttttttacctgcaccttcaccaagaatcatttttaacttgtaccagaacaagaaaacccagaaatgtttcatgatgacatagaacccaaagttcagatttcagaattatgcatgctcagagactgtatctttggaaccagtgtggccacctgctgctgtctcctgcagaagtgaaggcacaagtggtcttgctctcaggggcctcacattctagaggcaagctggagcagttcatttcaatactgactatcactcaagtgcctgctcagctagttctgaaagtagatcagccaacattctccttttccatcattctagcttttagatgcagaaccttagaaacagaaggtggtgagatgttaagcagtttatccaaagacacacagcaaggtagtgtcagacgtgcctgtagagatcatttcttagcactgaatgcagtaaaagttactccaaacatcttggtttcctttctcttgaacttggttgatgacttcctattagtacacaccctttacacaaaactggcacacacaaaacacgccacatgcatgagtgtttttaagaattaggggtcagccactcttaccagattcaaatttgttgtatcttttaatcatttggcttggtgccttaaggtttcaaggtgagcttggctttcaagctacagcagaaggtgtggagccagaaagcccctgcctggagccctgcagtgtgtccttcctggccgctcttccttccggctctcaactccttcctgacaaccctccacggatctgctttccttctggagtttccacattctagcactttcctaacctggacaaaccccatacactgcttcctgtccacatcaccatacccttaatctcatgtcccaggcctttagtttccttcagcagaccacagggttgcaggtgaaaatgggagggcgtggctcctccccacaagtttttgtacttaccagggcctcctgctggctatgtctaagggtaaagtagtgagtaatgcacacctattgggggattttcatcacacaggcaaaggggcatttgaggcctctgatgcacattctgtatccagccactcccatgccatgccatcctttgaaataaattagacggtatatcaggcagccaggactgtcataacaaagtaccacagactgggtgccttaaccagaaatcaacttctcacagttctggaggctagaagtgaaagactgaggtgttggcagggttgctttcttctgaggcatctctccttggcttgcagatgactgtcttctctctgtgtcttcattttgtacctgccagtgtcctaatcctgtcttattataagaacaccagtcttcttgggttagagcccaccctaatgacctcattttaacttaattatctcctttaaaaccctatctccaaatataatcgtattctgtggtactgggagttagggcttcaacagataaatatgtggcagcaggcagggatggcagggatgttgtaatttagctgatagcagatgggaagccccaactccgaaattcacctaccccttctattccacttcatattatggtaacatagggttgaccaagaaggacgttgggtcactaggtgacaagatgggtttcatgcgcctttgcagtcccagacatatgcacacgtatgcctcagaaaccaccctgctccttccacaccatgttctatgggactaaaaccacagggctggcctacacagcaagtggcgatgaaacttgacttacacttgttttacatcatggcacctctctaagaaattttttttctagaataaaaagtgatacaaatcagttaattgaagtttgtgttaacacaattctttttgaaataattctatgggcatctgtgttctagaatctgcattagtgttagttctattgaataatcctcctattgggatctgttgtaaaaattttcttctaaagtaagttatctgcaataaatgttcatgcaccttcccttaaaaatataattaatatcctcttt

SEQ ID NO: 917 - DNA, 8468 bp, Homo sapiens
ttttctttgctttcctttttctttccttttaaaaactttttctaaataatgaggaattttaaaagcacagaaaagagaaatacaacatccttgcatctgctaatcaaaacaaataatcactaatttttaaaattatttttcctaaagaaattacagagcttaagtccttttcgtgtctcatatgcaaccttcatgttccttctacccaaagacaaacactgtgctgagtttgggatgtattccttacatcattttttttcaccattttatgttaatgcacataccccaaaacaatgtacattattgtctttgtattatgttcatatcaattatatcatgatttctgcaacttactttttttactcaatatggtatatttttgacatggatccatggtgatacatattgtcaggcctctgagcccaagccaagccatcgcatcccctgtgacttgcacgtatacgcccagatggcctgaagtaactgaagaatcacaaaagaagtgaatatgccctgccccaccttaactgatgacattccactacaaaagaagtgtaaatggctggtccttgccttaagtgatgacattaccttgtgaaagtccttttcctagctcatcctggctcaaaaagcacccccactgagcaccttgcgacccccactcctgcccgccagagaacaaaccccctttgactgtaattttcctttacctacccaaatcctataaaacagctccacccctatctcccttcactgactctcttttcggactcagcccccctgcacccaggtgaaataaacagccatgttgctcacacaaagcctgtttggtgatctcttcacatggatgcacatgaaatttggtgctgtgactcagatcgggggacctcccttgggagatcaatcccctgtactcctgttctttgctccatgacaaagatccacctatgacctcaggtcctcagaccgaccagcccaaggaacatctcaccaattgtaaatcaggtgaagtatgaagttatgaggagaaaggaacagaggacaaccacacagagaaagtgtagctttatctactagagctgaagacattcaaatttatgatccaacaattctactctgaagtgcagtggtgtatatactgcaacaatgtgtactcatgtgccctgagaactagatatgaaaaaaccttacagcaatatgcataatagtaaaaaaaaaaaaaaaaaactggaaacaacaaaaatgttcattgaccatatacaatgataaatgtggtatactcgtagcatggaaaactacacaacattgaaaatgaacaaactaaaactgtacacagcaacatgaacgaattccacagataatattgagtgaaagataccagacaccaaataatatcccatatgatttcatttacattaaatgttttttttttgagatggagtctcgctctgttgcccaggctggagtgcagtggcacaatcttggctcactgcaacctctgcttttcaggttcaagctattctcccacttcagcctccccagtagctgggactacaggtacctgccaccacgcccaactaagttttgtgttttcagtagatatgggggtttcaccatgttggccaggctggtcttgaactcctggcctcaagtgatctgcccaccacggccttccaaagtgctgggattacaggtgtgagccaccgtgcccggcctcatttatattaaatttaacacaggcagactaatccattatgctagaagtcaggagagtggttactttgaggaagagaggactgactgatcaggcttgaggggattctaaagtggtggcagggtttggtttcttgaccaatattactgatattcattatggagctccttaaacactttaaattttacttgtgtaatgggattatgtctacttcaagcggttattgtaaggattaaataacaatgtatgtaaagtgctgtgcagtgtaccatgtctaataaatactccaacagctgtaattgtcattgctatcaatatcactgttaagctgtatatataataagttttgaaaacttacatagttaaccatattcaatctccattttgtgttagacagttctcaaaccctgaggtgctttcctggaaacagtcctattgaaagcagctgctccattattgtaaggatgttgttgagggtattggtgttatagcacatttgttctcttgggaaggacctaccgaagaaatatctttctgatctcaatttgaaattaattgtactctcctgagcaacagattttgattattgtccaagtttaatattacacacattgtgaatcctgtagggaaatgtatctttcttcttggctttctatttggatactgaaaatcttagaatcaaatctgtgctctagctttatcaaatgtatatagacttacaccatgcattttctggataaactgcgttttccttatttacttgtttttgtttgtttttgtctcatgtttatgtaagctaccttaaattcttttgggagcaagcagaaggcttaagcacataaacgaaaaacaaataaatgacatcatgttggatttagttatggaaatatctgccaagacagtagtattcaccaagttgaaactcttaaaaaatgtgctgaataaatgaatacatgagcgatttggcatttggggatggctccattaaaaacaaaatagaacttgagcaaaactttggaaaaattgaagcctgtgtaatgaataagggactggggcatattgaaaatgatagtataaaatggagtgaaatcagcatggcactgtgatccacagaacatcctattcagagtacagaagtgttggcgatagacgtcaattgatgactgtgatgggggacactttcttcttcacaataaaatgaagaagggacaaatccaagtagaaaaattaatagccttagtaacaaattacacagaaagtgcagaaaaggagaaatcaggagtcttttcaagattgtttttggcttaacatagaaatgaaaatttgagggacagccaactaaagaagccatactcaaacagctcatgagacacagttacaagtccaggcaattaatttcttcattgtaaatcacaaatttagaatttgtgaattctgatgatgtagttttgtatttcgtacattaataaatcagtggaatgtaatatttctcctttgggattgattgcaagcaaaggtcagttaggacttgaacaatggatggagcagaagggataaaaaattgcatcattttatcatggttttagtacttttataacaaaacataaatgcatggtttgtatcaacaaatgaataaaagaattgtaaaaaggtctacatttagcattttaacttatttattcaaaactattagtataaagtatatgcaaggcacagtggtagacaagatggacataatctttggcctattaaagcttatatttttgagaaacacaccaaaataaatgcctgtatctgaaaattcatgcaaaatttcaaataaggcattagaagatactgataaaatggcttcccttctctcttatgctatgggaaattattgctcacaaaatacaagttgctatcttttcatgacttttgtgtagatttaaaaatcaaattattatttacaaagcagcattactggagtaatgaatacttcctccttattgatttttctgaaaactgccttccttatttcattcacacttcatctataattgggaaagggaaactactaaattgataaattcaacaaagggggaatatatcttgaatacgaactgttattactgttgacagtccaataacagagacaccatagaaaaaattatgggagttcttgaaattggctgaagcaattttcagcacactatatttcattcttagacaaaaccaaagccttatttcttacacattttttagaagtcaacatctaacaggcagtggaaacttctccaaaattacttggcattacccaattctatcaactgtttaaaactcaggtatttcagtattgggacctctaattgggatgtctatccatttaacaattctaatgagtttattttactggatatgtgcctgacaataacattccatagttgctaaaatgtcttatcattcaaactccttgttggggtgcctggtagctacacactatttgggaactgcagatttgctgggcagatagggagaccttaattagggaagcttgggtatactctggttttcagctttcccacctttcatttgattttttcatcatcttagtttttcctttgtgaggcaatttcctgaggaaaaactggggttactgcctttagtgtctgctcacccccaacaagcttttcctttcctgttactgttttttcttcctttgattttttttttttctctgaaacatacgtatcaatgagttctttcacttgataatcctgagagtcctggatccgaactgcaacttgaggcagagatttgggggatctatttttacgtacattatcttcattttgaaggtgaagaagccaactgtaggtgaattttccaggactgagcagagtttagagttcagaaatcatacacaaatagccatcaacagtgaatcctgtcctcttgattcctattctgacttctgcaagttttccaactatggcctttacctctacttccctctacacatcaccattgtaacccatgtgtatttgaggtcaaatctggccaagagtaccctataagttgagaaagtaatcctaatgttctgagcacaaaatagtgttctttgtagcataaaaaaggaccttgacacactattaaattttaaattattttagtacatgtttttatattttatttcatttttgaaaatagaatatttgttcaaagatatttgtcaagataaaacttttcttatgataattaaattacaaaaaggattgcattatgtggaaaattattgttttcttttttttttgaatgtatggtaccttccagcctgttactcgtgcaaatactccaaaacaaccccaaagcatgcacatcatccagtatattattgacacagtgtatgttccacaagtgcttgcttagtcttgaagaggtaaaggaaataccctattggccagcttaaagagagaggttgcctttcaatggttgggaatgatttttgttcatgtcactatcacacttgaacagacctttgatggggctatacagatcacagaataaagttcaaatctgactcttacttagctctccaatgtaactctttgccccatctgcctccatctatccccactctgcaccacaagtggcaaatttgcaggctggtgggcttgccaggtaacacccatgggtgaactggtccagggaaatgaacatatgcttgttgtttgggtgatggctgtggagaactgggaaggtccacactgtctaaggggtgctgctactcagctccacctagcgttgctctgctggaaggagggggtctgatgttgccaactcccctgctttacattaagaaaaggcagaaagaggctgggcgcagtggctcaggcctgtaatctcagcactttgggaggccgaggagggcagatcacgacgtcaggagttcaagaccatcctggccaacatgacaaaacctcatctctactaaaaatacaaaaattagctgggcatggtggtgtgtgcctgtagtcccagctacttgggaggctaaggcaggagaatagcttgaacccgggaggtggaggttgcagtgagccgagatcatgccactgcactccagcctgggcaacagaacgagactctcaaaaaaataaaaaaagaaaaaaaggcagaaagatggctactgaatcttgaaatgtcctgattttctaatattttgtagggtatacttttattcactccactggtcatattgatgagccttttcccgtccattggctcgtaactgttgtcctccccaaatccgtactctaagcaaccctgaatatttgcagttttctcagaatctggcatattttcagccccctcagctttctaccccactttggcttacgctgctctctgtctgaatgtcctctccactcatcctcttagcaaagttctatccacccatttttaaacactgaccaaagacagtcactaaaaggcctttttcaacctcccttccacctgatgtccaacagcccagcgaagctatcctttttctcgtttcacttaacattgctcatacagtgtaggaggtacaatattgaaatgtatttagctgtgactgatagccatttcccccactagcatgtaagccacattcttattcctcttcatatccttgatgttctacacagggagcagcaccaagaatggccagtgcttgttgaaacggcacatagaatagagttcttgcaaacttttttacctgcaccttcaccaagaatcatttttaacttgtaccagaacaagaaaacccagaaatgtttcatgatgacatagaacccaaagttcagatttcagaattatgcatgctcagagactgtatctttggaaccagtgtggccacctgctgctgtctcctgcagaagtgaaggcacaagtggtcttgctctcaggggcctcacattctagaggcaagctggagcagttcatttcaatactgactatcactcaagtgcctgctcagctagttctgaaagtagatcagccaacattctccttttccatcattctagcttttagatgcagaaccttagaaacagaaggtggtgagatgttaagcagtttatccaaagacacacagcaaggtagtgtcagacgtgcctgtagagatcatttcttagcactgaatgcagtaaaagttactccaaacatcttggtttcctttctcttgaacttggttgatgacttcctattagtacacaccctttacacaaaactggcacacacaaaacacgccacatgcatgagtgtttttaagaattaggggtcagccactcttaccagattcaaatttgttgtatcttttaatcatttggcttggtgccttaaggtttcaaggtgagcttggctttcaagctacagcagaaggtgtggagccagaaagcccctgcctggagccctgcagtgtgtccttcctggccgctcttccttccggctctcaactccttcctgacaaccctccacggatctgctttccttctggagtttccacattctagcactttcctaacctggacaaaccccatacactgcttcctgtccacatcaccatacccttaatctcatgtcccaggcctttagtttccttcagcagaccacagggttgcaggtgaaaatgggagggcgtggctcctccccacaagtttttgtacttaccagggcctcctgctggctatgtctaagggtaaagtagtgagtaatgcacacctattgggggattttcatcacacaggcaaaggggcatttgaggcctctgatgcacattctgtatccagccactcccatgccatgccatcctttgaaataaattagacggtatatcaggcagccaggactgtcataacaaagtaccacagactgggtgccttaaccagaaatcaacttctcacagttctggaggctagaagtgaaagactgaggtgttggcagggttgctttcttctgaggcatctctccttggcttgcagatgactgtcttctctctgtgtcttcattttgtacctgccagtgtcctaatcctgtcttattataagaacaccagtcttcttgggttagagcccaccctaatgacctcattttaacttaattatctcctttaaaaccctatctccaaatataatcgtattctgtggtactgggagttagggcttcaacagataaatatgtggcagcaggcagggatggcagggatgttgtaatttagctgatagcagatgggaagccccaactccgaaattcacctaccccttctattccacttcatattatggtaacatagggttgaccaagaaggacgttgggtcactaggtgacaagatgggtttcatgcgcctttgcagtcccagacatatgcacacgtatgcctcagaaaccaccctgctccttccacaccatgttctatgggactaaaaccacagggctggcctacacagcaagtggcgatgaaacttgacttacacttgttttacatcatggcacctctctaagaaattttttttctagaataaaaagtgatacaaatcagttaattgaagtttgtgttaacacaattctttttgaaataattctatgggcatctgtgttctagaatctgcattagtgttagttctattgaataatcctcctattgggatctgttgtaaaaattttcttctaaagtaagttatctgcaataaatgttcatgcaccttcccttaaaaatataattaatatcctcttt

SEQ ID NO: 918 - DNA, 460 bp, Homo sapiens
ctaatggtgcacttgtcctgtgaaatgctgctgcagaaagttgaggaagcttctgggtgttctgcacctgggccttgcagagcacacaggccctaaacagccatgtctgagatattagtaccagccacctgatgtccagctcctctgagatgtaggttctgcttcaaggggcccctccccagagtttcagaggtaccagcacccgctggacagcatctctccttagagactgtgggtcccagcacatggagacctgcctccaagcttctacagcctcatgagcaatcttttccctttgttccattagtcctacaggtgaaggctgcctgttgaaatcactgctctgtgttatctcagtgtattttttttttgtttgcctttgtactcctccagtacttgtttaaccaattttctatgttaaattttctctattaaaatatctggtgtaattacgcttttc

SEQ ID NO: 919 - DNA, 460 bp, Homo sapiens; identical to SEQ ID NO: 918

SEQ ID NO: 920 - DNA, 715 bp, Homo sapiens
gtgcaggatataatctcgtggtgggtggttttttaagccagtccgaaaagcgcaatattcgggtgggagtgacccgattttccaggtgccgtctgtcacccctttctttgactgggaaagggaactccctgaccctttgcgcttcccaagtgaggcaatgcctcgccctgcttcggctggcgcacagtgcacgcacccactgacccgcgcccactgtctggcactccctagtgagatgaacccggtacctcagatggaaatgcagaaatcacccgtcttctgcgtcgctcacgctgggagctgtagaccggagctgttcctattcggccatcttggctcctccggccctaaacagccatgtctgagatattagtaccagccacctgatgtccagctcctctgagatgtaggttctgcttcaaggggcccctccccagagtttcagaggtaccagcacccgctggacagcatctctccttagagactgtgggtcccagcacatggagacctgcctccaagcttctacagcctcatgagcaatcttttccctttgttccattagtcctacaggtgaaggctgcctgttgaaatcactgctctgtgttatctcagtgtattttttttttgtttgcctttgtactcctccagtacttgtttaaccaattttctatgttaaattttctctattaaaatatctggtgtaattacgcttttc

SEQ ID NO: 921 - DNA, 715 bp, Homo sapiens; identical to SEQ ID NO: 920

SEQ ID NO: 922 - DNA, 6268 bp, Homo sapiens
tcaggctgggagctgtagaccggagctgttcctattcggccatcttggctcctctccctctttaaagtgaatgtgattttgaagaaaggaggaaagatgtgaaaagtgattggtcagccacattcatggtgttgagaaaagaatttgcttttctggaacatagcctgtgatagcagaacaacacctggcaagaaacaggttatgtttggctggagagtcattggcactatcaagaaatattaaagtgtagatttgagagaggaggagaaagacccaagcaaaattgaaaaccaggtgggacccagacagcagcaaagcaatggaagcatgtattttggtcaatatagagttaatacacaattttgcccctcttcttctgatcatgggactcatattaccagtcttcacatttcctttaaattcaggaatcaggaagaatttccagagtttgcagatggacacatttgctgcttccattctaaacataagttagaagaacctttcaactggattccaactttaatatgtcacaaacataaaaaagaaagctatttcctggacttttcttcattagaaattaatagattgtcaattggcatagggaaaagataatcaacagatgccaaccccaagttaacagaaatgctaaaattataagacaaagacttcaaaatagctattttaattttgcctagtgaggtaaatgcaaacatgctcactatgaatgaaaacaggtaatctcagcagtcatgtaaactataaaaataagcaaatataaattttagaattaaaacacaatatctaaaaataaattcacctgatattctcaatagaaaaaatggtaatgcagagaaaaatgtatgaaaatatggcaatttgaagaagagagaagagatcaataaaataaataagtatatccttggagacctgtggatgttttttgaaaagtgaatcatgtaagtaattgaagtcccagaagaaaagaaaagaagaggatgagcagaaaaaaatttctgaaaaaatatctgaaagcttaaacactataatgaaagacacacatttacaaactcaagaagtttagtaaaccaaaaacaataaaatcaaagagaactgtgccaagcgacatcattttcaacctgctgaagatcttgacagcagtcagagaaaaaagacacacttattacacagagaggaacaatacattaaatactagcacacttctcatcagagatcattaagcccagaagacagtggaatgagatctttaaagtgctgaaataaaataaatgttgattaaaaaattctatagctaatggaagtgttcttctttaaaaattaattgaagccatgtgttttgatctatttctgaactctgtgtttggttccgatgatctgttgatgtatccttgcaccactatcatacagctgattgcggcagctttatagtaagtcatggaatcaggcaataagttcccccgatttgttcttttgtttccccgagtcataaaactgccattttttgatggtcttccttcatgtgctgcaacatggaaagttcttctagtcagaagtttgggtaaattatagggcttgctttggttgcttctttctatcagagatgttcttgtgctgctttgttgtttgtttaggtttgtttgtttgtttgtcttttggtactttgtctaagaacagttttattctgtattttttcaaatttgtacatatttatagctaattccagcatcaattacctcaccatagccagaaatggagtttgcatgctctcacattgcagtatttaccatacttaagatattcactctcatcttatgacccatacgattttgttgctcacttttcatttatgtttgtaatacacgtgcagaataatcatcccccaaatttttcatatttaatttccttagattgttctgaagtcaaaataacaataattactccaaaactgtgtttccatctgctatatttggccctgccaagtatgatgctgaagtttgatcccgaatgttggatgtaggatctgttggaaagagtctgggtcatgggggcatatctctcatgaatagctggatgctgtcctcatgataataagtaagctctcactctattagttcccaaaagagctactcgttaaagagcttggcacctctctctctctctctctctctctctctctctgcctgcgcgccccccaccccaccccgcaccgcccccccacccggccaaccctttctgctttcaccatgtggtggctcccatttaccttctgccatgagtggaagcagcttgaggccttcaccagatgcagatgctggtgccatgctttttatacagcctgcacaaccatgagccaaataaacctctttttataaactactcagcctcaggtcttcctttgcagcaacacaaatggactaagacagcacctttgtaagctttctttacaattataaagaaagaacactttttcaggtataattcataattgattataattttaatgaacaaactaatttcttaatatatttttaaccttatgagaatgtcaccattttgcattgtgtattactaggctaatgacaagaaagatgagcatattgagatgagcacaatatgtagattagaatttttggttaaattaaataaaaataattttatgcattatataaatagagtttttatgtttcagatagacaacaatggtgagagaactgagtcagtcatggtacaggcaaagaaaaagattatttttacagtgacagaagtattggacattggagtgtcataaaccatttcacattctctttgcccaaatctgaacatcacatttgtctttgataacgtaagtcaccgtatcgcaaggccctttggcaaggaagtgagagcggcctcctcataatagtcagcaagaaactaaggccctcagctcaacagcctgcaaggaagcaagcccagcccacaaccctgtgagcttcaaagtggattcttcttcagtcaggcttccagatgacagcctagcccttgatcgcagtctgtgacagacactgaagcaaagcatccaactaaactgtgtctggattcttgtcccactggagttaaaataataaatttgcattatttaaactgctacgtttgtggtcatttgttacacagcaataaataatacagcatgagggcaaatcaaagctcttcctagaaatgtatgaacagcaggatagcaaagcctgtttccccttgggtaaagaaaccttgcattctggcgtcacaatgtaggaacaatgtctatttacagtaggagacattaaatcctacatttaaaatgtagaagagacaaatggacagatgaagtggaaaaagaggaaggaaaaagagggagaaaaaatgttggtagctgaccctgacaccaggattcttccagtttgtttttatattattgttagttctctgacaaaattcctcagccattgtctcagtttcatgagtcaacaaatgtattgcattgcttaaactagtttgagttgagtttctaccacttaaaacctaaatttttctacaaagagaaagggatgttaatgaagaaaaacagaatggtattcctccaaattgtataactatcctcaaagttagtgtatttatgtgagttcagaaagtcatgcacattactattcccttaagaacaacttgctgtctaagtattaaaaacatcatcctaattctgccacttatggctatgtgacttggttaagtcatgtaacttctctatacttgtgttttctcttcaaagagtggaaataatattactgtaacttgacaatgttattgtgagatataaattagtacattatttttatgcaatattactgtgtcaacaccagagatgaaataaaaactaaagaaatgttagctgctatcattactatcccctccaagaatgcaaaaaagggattctcccactagaggtatgaagtttattgaagattacggaattactggtagaaactagtgactattgtaatgtctactgttcttacatcttttgtggtattttgggggcaaatgacaagaggtattttcattggacctcaggattcttcactggacccgaggattttcatttgtcagaggataggaaattcataaatagaaatttgcatgcttaataagcaccactttctacataaaacatttctgaatgatttgaggaccttaacataaagctcctttaggttggggggtggcatctaatacatcatgaatacataaaggtaagtattgaataccttaactccccttaagtaaggcattcctcaactaatgttttgttccatatgtgtttaagtgaaagaattagggaacttaaaatgggccacagacataaatacaaaagctaactgtaaaatgtgtggaagaaaatacaggtgagatttttggggactgtgggatagacaaaggtttcataggcacaaaaatcaagaatgtataaaaattatcaagtggactttgtcaaaattagaaacttttcctttttgaaagctattgttaggcaaataagaacacaagccactgactggaagaaaatatttgtaactcattggatacaggaagacttgtatctaatatataaagaactcttcaacactaaaactggaacaagaacaactcagaaaacattggcaaaaggtttgagcagacataagatacaaaaggcctatgaatggttgattatcatgtggaaagatgccaaaaatcattactaattaaggaaatgcaaattgaaatctcagtgagataccagtgcatgttcactagaaaggctaaaatcgaaaccaaccaacaaacaaaaataatgaatattgattgtttgtgaggatttggagccactggaactttcagacatgacaggtgaaatacaaaatcatactataatacttgtttggaaaactgccctgaagtttcttaaaatgtttatatatcttaccataagatcaaggcattccactcaaagagaaatgaggacagatgttgcacaatgtcttgaagacaaatgttcttaagagccttcttcacacaagccaaatactgtaaatgactaaaatgcccacaagcagatgaacagataaacagaacaagatctatcatacagtggaatgttattcagcaaaaaaataaaaaaaaatgaggggaaaaacagtgactagtgggatgtttgtaaagatgtattcatttgtcaagttcactgaattctgcatttcaatatcatgcacaccttaataaagttgatttgatgtttaaataaaaatagtttttctatgcagattgttaattgagttttaatatttctgcagaaatattgttaaatgaatggtctgctgcagcttgcagactctaggacagttaaaccactacataacccagccggcatgcatttgggatatatctgggtcaagtgattttcaaactgtgggagaacaactttcgtcattaaatttttactcaataaatcatgcctggtgttggttttgaatccttttacttcaccaatcttaaattccacttaagtaaccatttttgttctaaagcagacagcttggcatgtctaactttttcttccaatttgacatcaggaaactgtaacctcttattattagcaaaactaattcaaaaactctctaaagtgtggtataaaaataatctctttagtgatgcaacaaaaatccctcgagaatttaaaatgcgattcaagcgacattatagcaagacctataaacatttctatgcctgcaagatagaggatccactgcagtaataacttctactacttgcacaggacttcacaatttaaaaaagcacttctaccttttatctctcctgatcattgtaataacattttataagaatattattaaatattaaagtattaaatgtttttaccaagaactaaatattgattattggtgaagatttggagctccttctcatacatggctggtagaactgcaaaattgtacaattacttcttggaaaattgctctgcagtttcttttatttttctagatgaaatgatttttattgtagagataggtgtatacatacacctaatcaaattgtacactttacatatgtgcagtttttatatattaagtatgcctcattaaacttgttttcagattttgcattaaataaacaaattctgcagtttcttaaaatattcaatgtaccttaccataagaccaagtcattctgtttctag

SEQ ID NO: 923 - DNA, 6268 bp, Homo sapiens; identical to SEQ ID NO: 922

SEQ ID NO: 924 - DNA, 5793 bp, Homo sapiens
caggcaggcctccttgagctgtggtgggctccacccagttcgagcttccctgctgctttgtttacctaagcaagcctgggcaatggcgggcgcccctcccccagcctcgctgccgccttgcagtttgatctcagactgctgtgctagcaatcagcgagactccgtgggcgtaggaccctctgaaccaggtgcaggatataatctcgtggtgggtggttttttaagccagtccgaaaagcgcaatattcgggtgggagtgacccgattttccaggtgccgtctgtcacccctttctttgactgggaaagggaactccctgaccctttgcgcttcccaagtgaggcaatgcctcgccctgcttcggctggcgcacagtgcacgcacccactgacccgcgcccactgtctggcactccctagtgagatgaacccggtacctcagatggaaatgcagaaatcacccgtcttctgcgtcgctcacgctgggagctgtagaccggagctgttcctattcggccatcttggctcctccgaatgtgattttgaagaaaggaggaaagatgtgaaaagtgattggtcagccacattcatggtgttgagaaaagaatttgcttttctggaacatagcctgtgatagcagaacaacacctggcaagaaacaggttatgtttggctggagagtcattggcactatcaagaaatattaaagtgtagatttgagagaggaggagaaagacccaagcaaaattgaaaaccaggtgggacccagacagcagcaaagcaatggaagcatgtattttggtcaatatagagttaatacacaattttgcccctcttcttctgatcatgggactcatattaccagtcttcacatttcctttaaattcaggaatcaggaagaatttccagagtttgcagatggacacatttgctgcttccattctaaacataagttagaagaacctttcaactggattccaactttaatatgtcacaaacataaaaaagaaagctatttcctggacttttcttcattagaaattaatagattgtcaattggcatagggaaaagataatcaacagatgccaaccccaagttaacagaaatgctaaaattataagacaaagacttcaaaatagctattttaattttgcctagtgaggtaaatgcaaacatgctcactatgaatgaaaacaggtaatctcagcagtcatgtaaactataaaaataagcaaatataaattttagaattaaaacacaatatctaaaaataaattcacctgatattctcaatagaaaaaatggtaatgcagagaaaaatgtatgaaaatatggcaatttgaagaagagagaagagatcaataaaataaataagtatatccttggagacctgtggatgttttttgaaaagtgaatcatgtaagtaattgaagtcccagaagaaaagaaaagaagaggatgagcagaaaaaaatttctgaaaaaatatctgaaagcttaaacactataatgaaagacacacatttacaaactcaagaagtttagtaaaccaaaaacaataaaatcaaagagaactgtgccaagcgacatcattttcaacctgctgaagatcttgacagcagtcagagaaaaaagacacacttattacacagagaggaacaatacattaaatactagcacacttctcatcagagatcattaagcccagaagacagtggaatgagatctttaaagtgctgaaataaaataaatgttgattaaaaaattctatagctaatggaagtgttcttctttaaaaattaattgaagccatgtgttttgatctatttctgaactctgtgtttggttccgatgatctgttgatgtatccttgcaccactatcatacagctgattgcggcagctttataatagacaacaatggtgagagaactgagtcagtcatggtacagtggcatattgcacatctggttgatttcatctcacctctccaacctccacgcaaagaaaaagattatttttacagtgacagaagtattggacattggagtgtcataaaccatttcacattctctttgcccaaatctgaacatcacatgtgagaaattaccttgaaatcttggcatagaagcagcctcctaccagttctttgtgtccctgcattcttaattacatggctattctatgggaataatttctttttgaatgactgaagacccttgggtccaaaggacacaactgcacatcagtcatgaatctctctctgtcacccaggctggagtacagtggtatgatctcggctcactcgaaccctcctcctcccgggttcaagcgattcttctccctcagtcgcccgagtagctagtaccacagttgtctttgataacgtaagtcaccgtatcgcaaggccctttggcaaggaagtgagagcggcctcctcataatagtcagcaagaaactaaggccctcagctcaacagcctgcaaggaagcaagcccagcccacaaccctgtgagcttcaaagtggattcttcttcagtcaggcttccagatgacagcctagcccttgatcgcagtctgtgacagacactgaagcaaagcatccaactaaactgtgtctggattcttgtcccactggagttaaaataataaatttgcattatttaaactgctacgtttgtggtcatttgttacacagcaataaataatacagcatgagggcaaatcaaagctcttcctagaaatgtatgaacagcaggatagcaaagcctgtttccccttgggtaaagaaaccttgcattctggcgtcacaatgtaggaacaatgtctatttacagtaggagacattaaatcctacatttaaaatgtagaagagacaaatggacagatgaagtggaaaaagaggaaggaaaaagagggagaaaaaatgttggtagctgaccctgacaccaggattcttccagtttgtttttatattattgttagttctctgacaaaattcctcagccattgtctcagtttcatgagtcaacaaatgtattgcattgcttaaactagtttgagttgagtttctaccacttaaaacctaaatttttctacaaagagaaagggatgttaatgaagaaaaacagaatggtattcctccaaattgtataactatcctcaaagttagtgtatttatgtgagttcagaaagtcatgcacattactattcccttaagaacaacttgctgtctaagtattaaaaacatcatcctaattctgccacttatggctatgtgacttggttaagtcatgtaacttctctatacttgtgttttctcttcaaagagtggaaataatattactgtaacttgacaatgttattgtgagatataaattagtacattatttttatgcaatattactgtgtcaacaccagagatgaaataaaaactaaagaaatgttagctgctatcattactatcccctccaagaatgcaaaaaagggattctcccactagaggtatgaagtttattgaagattacggaattactggtagaaactagtgactattgtaatgtctactgttcttacatcttttgtggtattttgggggcaaatgacaagaggtattttcattggacctcaggattcttcactggacccgaggattttcatttgtcagaggataggaaattcataaatagaaatttgcatgcttaataagcaccactttctacataaaacatttctgaatgatttgaggaccttaacataaagctcctttaggttggggggtggcatctaatacatcatgaatacataaaggtaagtattgaataccttaactccccttaagtaaggcattcctcaactaatgttttgttccatatgtgtttaagtgaaagaattagggaacttaaaatgggccacagacataaatacaaaagctaactgtaaaatgtgtggaagaaaatacaggtgagatttttggggactgtgggatagacaaaggtttcataggcacaaaaatcaagaatgtataaaaattatcaagtggactttgtcaaaattagaaacttttcctttttgaaagctattgttaggcaaataagaacacaagccactgactggaagaaaatatttgtaactcattggatacaggaagacttgtatctaatatataaagaactcttcaacactaaaactggaacaagaacaactcagaaaacattggcaaaaggtttgagcagacataagatacaaaaggcctatgaatggttgattatcatgtggaaagatgccaaaaatcattactaattaaggaaatgcaaattgaaatctcagtgagataccagtgcatgttcactagaaaggctaaaatcgaaaccaaccaacaaacaaaaataatgaatattgattgtttgtgaggatttggagccactggaactttcagacatgacaggtgaaatacaaaatcatactataatacttgtttggaaaactgccctgaagtttcttaaaatgtttatatatcttaccataagatcaaggcattccactcaaagagaaatgaggacagatgttgcacaatgtcttgaagacaaatgttcttaagagccttcttcacacaagccaaatactgtaaatgactaaaatgcccacaagcagatgaacagataaacagaacaagatctatcatacagtggaatgttattcagcaaaaaaataaaaaaaaatgaggggaaaaacagtgactagtgggatgtttgtaaagatgtattcatttgtcaagttcactgaattctgcatttcaatatcatgcacaccttaataaagttgatttgatgtttaaataaaaatagtttttctatgcagattgttaattgagttttaatatttctgcagaaatattgttaaatgaatggtctgctgcagcttgcagactctaggacagttaaaccactacataacccagccggcatgcatttgggatatatctgggtcaagtgattttcaaactgtgggagaacaactttcgtcattaaatttttactcaataaatcatgcctggtgttggttttgaatccttttacttcaccaatcttaaattccacttaagtaaccatttttgttctaaagcagacagcttggcatgtctaactttttcttccaatttgacatcaggaaactgtaacctcttattattagcaaaactaattcaaaaactctctaaagtgtggtataaaaataatctctttagtgatgcaacaaaaatccctcgagaatttaaaatgcgattcaagcgacattatagcaagacctataaacatttctatgcctgcaagatagaggatccactgcagtaataacttctactacttgcacaggacttcacaatttaaaaaagcacttctaccttttatctctcctgatcattgtaataacattttataagaatattattaaatattaaagtattaaatgtttttaccaagaactaaatattgattattggtgaagatttggagctccttctcatacatggctggtagaactgcaaaattgtacaattacttcttggaaaattgctctgcagtttcttttatttttctagatgaaatgatttttattgtagagataggtgtatacatacacctaatcaaattgtacactttacatatgtgcagtttttatatattaagtatgcctcattaaacttgttttcagattttgcattaaataaacaaattctgcagtttcttaaaatattcaatgtaccttaccataagaccaagtcattctgtttctag

SEQ ID NO: 925 - DNA, 5793 bp, Homo sapiens; identical to SEQ ID NO: 924

SEQ ID NO: 926 - DNA, 5793 bp, Homo sapiens; identical to SEQ ID NO: 924

SEQ ID NO: 927 - DNA, 5618 bp, Homo sapiens
atttgcttttattttattttttattttcctacaacataatctccgcacaattattttttttaaaaacaacccacaaattttcacctactgttcttgcaaaaaccaatagcattgagtaatgcatttaatggataggaacattaatatttttaagaagtagaatatggatgctttggattataatttcaatttgttatgtaagcaaactacttgtgaccttggtctcttcaccatctctgtgattgacatgattgattgggcaggtagggagcccttctccacctaaaatgttgcctccatcctgaagctacttgctcagcacaacaggatgtccttttaagatatgggaaaggtacgtgtgtacatatatttcatttttcaaattaaaattcttttccatttattgctgtctaacctgtcatttcttcctcagcttatgcaatggaggtgtctaacctggagtctatagacctctaggttgctcagtggattttagagcatccatagtcctttcatgcgttatgcaaaattttgggaggatgtgcaaatgtctattattctgaagaaagatatccatggattaaagtcactgttaaggactcatattaaattctatagctaaaataatcctcgtgtttcatggagttacatccagtataagacacagttaaactgtgaagtgttaattccctatgacataatttatgtttgcttatttatttgcatatctgaatcctgcagaactttcttatgatctactttctgaaaagcatttgaggctctgaagaatttaatcagcatatacaactgtcattgtacaaccatggtgaatccttgtgtacaaataaatgatctggacactgggagctgggattcctggtcacccacccatccaagctgatcttaataaatatattactgaatttttaaaaattgaatcatgaagatattaaatctgagttctaagttttttattttcagaataatcttttaatttttaaaaattcctggtgttgtagaaataacctgaaatatattggtatccactcttacatctatatgaaaaacaaaattgtttaaaacccaagttgaaataaatccaaaatgtgaaacagtgagcatcttacacaatgaaatgtacatctcagcattaacaactgagcagctaaatagatgctttaattttttaaaacctccaaaagtagaatcagaaaatgtataaattatttaaaatctagaatttcgatttgtttaaaagataacggtaataatgacattcaccactgaagagcttgactcagtgtcagcgaatctggtgctgctgtctgaccatcaataagaaatctgtcccactagcaagtaccgccagtctcagggattacaggcatgtgccaccatgcctggctaatttttgtatttttagtaaaaacggggtttcgtcatgttggccaggctggtctcaaattcctgacctcaagtgatctgcctgccttagcctcccaaagtgctgggagtacagcagtctgctactgcaatagagctactgatgtacgtttatattttgtcagtaagcctagctttggaatggcgtttgtagatctagttagaatggtaattctctggggacaattcctttctaatatattgatattcacaatggtctgtatgtgcatcttctttccttattctgctttcattccaaagataactctaacctggcctcccttacataaggagccagatgtcattgatgttgagtagggctgtgatgagttggatttcaattactgaccaaacgttcagcaagtggtggaagctgaaaactgcagcacgaatgactgaggagaaagggggagtcagtggaaaagccactatggaaggccagatggaataatgaagatgccagagagagggattacttagggaaagtagtttgggcattattataatttccatatcctatgtttgtgtatatataaaacttacacatcttatgattatgcagtcatccaagatgacatcaaaactcttgggctcagctattgtgagacataagggatgaaatcactgaaaatgatgccctctgataatgccacatatattgcccagcaattcttattcagtatatataagtactagtgtttccatttgctgaggtgaagacaaaatgactcaaaatgaataaaatgaatcatacaacagggagaattttgtccgctcctgagagtaactaagacaaaacagagtgaaactgtaattgcatctttcctgtgtcttgtttgtgagatctaagacattattaatgcatttttaagtggtagactcaaaaattactattaatgaagcccctcagatctgattatcaccaagactttcttcactctacagttttgttgttgttgttgtttttgagttggagtcttgctctgtcgcccaggctggagtgcaatgctgtgatctcggctcactgcaacctccacccccgccgggttcaagcggttctcctgacttaacctcctgagtagcttggactacaggcatgtgccaccaggcctggctaatttttgtatttttagtagaaacggggttttgccatgttggccaggctggtctcaaattcctgacctcaagtgatcttcccgcctcagcgtcccaaagtgctggtagtacaggcgtgagccaggcctacaaatatttcttttagcctcccaatgacctattacactgttaccatgctgtggagggggtggagggctctccaggtacttaacggaattctgtcaatgttcaataatacttagcttttgggccaaactcaaattcagtatctccgccagcccttagtcagtgttcctctttcctaaagcatctgaacaaccgaaacgactgcctttcttctgaaatgttctccaaatgtcctgagaattgcagctgctgcatttgtatcccatagagaaacacaattctgcaactgcaaaatctcattagaggactaacaaattctgcccacagataggctgatagaggacctgcgaacccttgagagcaatggatgggagcagaaggctagagaccctgagtacaggcaggactggctgcagaccaccaagaattctgtctagagtttaattggaatataatgttctgacaccaactgcagcagatagaggagggaatttgagggactgatgaaatgttcaggaggagggtggagaagggatggtgaggagcctcagcttcagttacttagaacaagaaattaattttttttattttttgagacggagtcttgctgtgtggcccgggctggactgtagtggtccaatcttgacttactgcaacctccgcctctcaggctcaagcaatcctcccacctcagcctcccgagtagctgggactacaggcctgtgtcaccacacctggctaatttttgtgtttttagtggagacggggttttaccatgttggtcaggctggtctcaaatgcctgacctcaagtgattcacctgccttggcctcccaaaatgctgggagtacaggtgtgagccactgcaccctgcccaagaaattagtctttgcctcactgttttctgtgttccatgtatagtatctgaacttttgggcctcattttgtaagatgtttttcaaaggttcatgttttccattgcagcccagttccctgaggcatgatgaagcagtcagatcccagctcagccactgaaaagctatgaaacttcaaggcaaattcttcaaatcacaatgtatatatccttatccatgctaggtgcactttctacttgcctcaagggattagggaagttcctctcttctgtattcacataatggttggactcttgggtggctgaggaaggggttggaaggattggaatcgtctgtttatatccagagaaagggaatttaacttcagcctgcagccttgtggcacattaagggccctacccatatcatgtagaggtggggtgggaaggggatagtctgagaatcaccttggtgcctttctttaagctatccctttcccatcagtgtcttttcctcccgacctttaagggagccctaagccttaaacccatcaccagaaaccacaagttaaaatgtacaatagaggtgtctctgggtccaaccccccacccccccgtgaaggacagcatcctgagcaaggcagggaagatgctttccagaccaggggccacacttggtcagtggctgctttggctccagctgatgggtctgcactggagccctccagggggcacttcaagtactaacaggaccctggtgtgggctgggcctcctgcatagatgtgaggctaggcacttggctttcttcctggttctatgagctactattttactgtatgcttaaaagttccttttggccgggcgttgtggctgtaatcctagcacttagggaagtcgaggtgggaggattgcctgagtttgagatcagcctgggcaacatgtagagacactgtctctaccttaaaaaagaaaaaaaaaattaggcagttgtggtggcacacacctctggttccagctacttgggaggctgagaggcaggaggatcacttgagcctgggaggtggaggctccagtaacctgtgatcccaccactgcattccagcctgggtgatggagcaagaccctgtttcaacaacaacaaaaaagttcctatcactaaaattattaaaatatttaactaaaaaagctagatttttgaagaaaatttgatttactccttggtctatgcatctaattctagatatcagtatttgtatactctctgtacatattctgatttgaagaattttcaaatatatatgggtttattttttaaaacatggcaaatatagattttacatttaggaatatgttaatatgttttatatttaaaggaaggacttgagcagtgctttgttgtcttttttttcctggtagctctatgcaccatttctactgagattttaatagataattcataccctgaaaactgaacctgcgatttttgaatgagtaaactacaattaaggaggtcattttcttctcatgtaaagaaggaagaaaccacaagaaagagagatataccttttatttaaagaaaggtgtgaaaagcaaatttattaacaaatttaacactgcttgcatctagaagataggatttgaaattgtgttgctttctcaagctgattacatcaaagtatattagaaaacaaaaacaaaataaggggccaggtgcagtggctgaacaaggggcctgtaatcccagcactttgggaggccaagggggactgtggatccctggagcccaggaattcgacaccagcctggataatatgttgaaaccctgtctctacaaaaaatacaaaacttagccttgtgtgggggtgtacacttgtagtgccagctactttggaggctgagagctgggaggatcacttgagcctgggaagtcgaggctgcagtgagctgtgatcacaccactgcactgtagcctaggtgacagagtgagaccctgtctagaaaaaaatttaaaagagaaaaagtaaaggagacattcagtatttggacctgtagagaagcatggaaaagcaagaataaaat

SEQ ID NO: 928 - DNA, 5618 bp, Homo sapiens; identical to SEQ ID NO: 927

SEQ ID NO: 929 - DNA, 5618 bp, Homo sapiens; identical to SEQ ID NO: 927

SEQ ID NO: 930 - DNA, 5618 bp, Homo sapiens; identical to SEQ ID NO: 927

SEQ ID NO: 931 - DNA, 1299 bp, Homo sapiens
ccacggctgccactctacgcagccggaccggatttctcaggctggagaagctactctgcgcgtcttcgtgaaggagaactcttgcgttctgctagccagggtcccagctccgaccctgctagttaggacaaagctctaggaggtgtctaagggggtggggggaaccgtaaaggggaaacactcgagatccggaagtggcgctccggggagaaggtggctgcggctgctggggccgctgcgccggcggcggttcccgatgtggaggtccgtcttgggtggggaggcacccaggtcgctggttcgatgcagaggaagaaaccacacctagcacgtaaagccctgaaaaaatagaggtgtacagtagagttttccagaggctacatgacatgcagtatcacaacggaagcaaatataagaacccacctgtctcctgttaaaatgcaaaatgtaaaacaataccactttgctaactgtttttgtttggggaaatatagttcataaaaatatttatgttaacatgtaatttaggttaaaataaattaataaatatttgtaaattgtctgttttaatttctaatatggtaaatacagatagatataacccatataaacaaaacctgtttggggtcctcaataatattgaagagtgttatacaggggtcctaaggccaaagaatttgataatgctgctctaagtcttccttatccattaaagtccaaatgaaagctgggaacagtagctaatgcctgtaaccccagtgctttgggaggccgacataggaggattacttgaggccaggagtttgagaccagacagggcaacatacggagaccctgttgctacaaaaataaatttaaaacgtagttggtcatggtggcacatgtctgtagtcctaactacttgggaggctgaggcaggaagatcacttgagcctaggagcttgaggctgctatgatcccgccactgcactccagcctgggtgacaaagcaagaccctgtctctgaaaaaataaataaaatagttttaaacttagaaaaaaaaggttcatgtcaaagccttcctactcgataagactttttgaccactgcaactagagaggatcttgtctgtctctgaatactacacacttatggcacttacacacttatggctcttttttatcattcatctagtacagaccttgtgccaaaaaggaatattgttatgtggattcagagtgataattaaagacatgtgtttgatggtgaatcataaacaacccttttacttcgcagtctctctgattagtcttcccagc

SEQ ID NO: 932 - DNA, 1299 bp, Homo sapiens; identical to SEQ ID NO: 931

SEQ ID NO: 933 - DNA, 1843 bp, Homo sapiens
gcggcggcggcggcgggactggccctgcgcccgggcaccgcctgcgctgcgccgcccggcctcactccgcggcccgccaggacccggccccggtgaacgggctcggggtgccgaggtccggctgcggggccgggaagccacctccaccttgccgtctgttacgacccccgaggcgcaaggctgagccccatctcgctatccgggtccggaggggttcaccttagaaggattttttgaagctcttggcgctggctctaaaagaacccacttccttgcggatttcaggagtcaagaatccttaaacggagccaatttgctttgtaaagccaattgcccaagtgacttgagttcgaaaggagatacttcctggacaactgctataaaaacaacaacaaatacttttattaattcggggagcctggtcaccaactggatgctcaggggagatggaaccctgagcagcccatgtacatggaagatctttattgcagagatcttcaaaccagaacaaaacaatcagcaggcgggtctgcggcattctaagaacagacactggcaggaacaaaggttacagaagtgaatgactctaagaatcaagcaagacatggagtggcagaaaattaaattctgaatccctaaaagacatgatgcaaagatgacctcctctcccaaggacatgtcctcatcctgcgctgaccgtgtgtggtcatttcagaaaaagcgaacaatggagaacctgcttgaatgatacttagacctgggacaactgaaaggagttgcacttatacaattcggtgcagtggagtcccctgggaggagccccagtcacacgggaagagacagtcacagctgtaataaatgatggctagcatgtatcaagcactggccgagtcctcagcatacattacattacagaattcagtgtgcacctcaacactctgggggtgtattttataggagaactgtggcacaaagaggggttttgcaatcccaagaagagtcagcgtttgaattttgaatttatgtgcaaaagagacaaatatggctaaagggcatgggcacactctctctgggtccccgtgttaacgattttagtagcttctatttaaatggtgctctttctctaagaagatcattgggtattttctgaaagcttacataatggctggaagccccctgcctctgcaaaggaacacctgattcagaaaagtaaacaccataacagcaacccattcatcagctgcccagactcacaaccaagcagacatgcagcgactttccaaaaaccctcatttctggcattacagcctgtggcaataacagagttaaggaaaggtaagtgaaactcagagagacacagtgagataattattcctcacgcctgttagaagaacattccaccgtctcagaagaagccctgtctgaatctgattcagctgagaaaacaactcaggccatggtagctgcacccaactctctaaatcaacagtgacctgtgctgaagggattaaggcatcccaacattcctcagagcccaaggcaaggagaatcccttatgaagatgaaattgatcttcaagcaccctctaccttactctgcgtgatgccatattcttcctgaatcccacccaactcaagagcatgatttgcataataaaatctctaatactttgatgaacaaatgttatccaagatactttaaaaactgccttcacgtcattcaacaaatgtgtggaagatgccaggcatgcaaatatcaatcatgtgatccccaacctggaagagctcacagactaactagagagacagaggaatgaccaagccctggcaatgcagtgtgacag

SEQ ID NO: 934 - DNA, 1009 bp, Homo sapiens
gcggcggcggcggcgggactggccctgcgcccgggcaccgcctgcgctgcgccgcccggcctcactccgcggcccgccaggacccggccccggtgaacgggctcggggtgccgaggtccggctgcggggccgggaagccacctccaccttgccgtctgttacgacccccgaggcgcaaggctgagccccatctcgctatccgggtccggaggggttcaccttagaaggattttttgaagctcttggcgctggctctaaaagaacccacttccttgcggatttcaggagtcaagaatccttaaacggagccaatttgctttgtaaagccaattgcccaagtgacttgagttcgaaaggagatacttcctggacaactgctataaaaacaacaacaaatacttttattaattcggggagcctggtcaccaactggatgctcagatggaaccctgagcagcccatgtacatggaagatctttattgcagagatcttcaaaccagaacaaaacaatcagcaggcgggtctgcggcattctaagaacagacactggcaggaacaaaggttacagaagtgaatgactctaagaatcaagcaagacatggagtggcagaaaattaaattctgaatccctaaaagacatgatgcaaagatgacctcctctcccaaggacatgtcctcatcctgcgctgaccgtgtgtggtcatttcagaaaaagcgaacaatggagaacctgcttgaatgatacttagacctgggacaactgaaaggagttgcacttatacaattcggtgcagtggagtcccctgggaggagccccagtcacacgggaagagacagtcacagctgtaataaatgatggctagcatgtatcaagcactggccgagtcctcagcatacattacattacagaattcagtgtgcacctcaacactctgggggtgtattttataggagaactgtggcacaaagagggtaagtgtcttactaacagtgtggctcatctgccaa

SEQ ID NO: 935 - DNA, 4515 bp, Homo sapiens
agagtatcatggttacagctggatcacctaaggcagagagggaaggaaccaacaggtatatgaagaagactgtatttcctcctcaggaagaaaaaatcacctataacactctcaaaaccatttctatcttacaccttcagagaagccagccttcattaaagactgaatgaagtaaaataaagacttaacacagactggcaaattggataaagagtcaagaccaatcagtgtgttttattcaggagacccatctcacgtgcagagacacacataggctcaaaataaagggatggaggaagatctaccaagcaaatggaaaacaaaaaaaggcagaggttgcgatcctagtctctgataaaacagactttaaaccaacaaagatcaaaagagacaaagaaggccattacataatggtaaagggatcaattcaacaagaagagctaactatcctaagtatatatgcacccattacaggagcacccagatttataaagcaagtccttagagaccaacaaagagacttagactcccacacaataataatgggagattttaacaccccactgtcaacattagacagatcaacgggacagaaagttaacaaggatatccaggaattgaactcagctctgcaccaagcagacctaatagacatctacagaactctccaccccaaatcaacagaatatacattcttctcagcaacacatcacacttattccaaaattgaccacatagttggaagtaaagcactcctcagcaaatataaaagaacagaaattataacaaactgtctctcagaccacagtgcaatcaaactagaactcaggattaagaaactcactcaaaactgctcaactacatggaaactgaacaacctgctcctgaatgactactggatacagaacaaaatgaaggtggaaataaagatgttctttgaaaccaatgagaacaaagatacaacataccagaatatctgggacacatttaaagcagtgtgtagagggaaatttatagcactaaatgcccacaacagaaagcaggaaagatctaaaattgacaccctaacatcacaattgaaagaactaggaagcaagagcaaagacattcaaaagctagcagaaggcgagaaataactaagatcagagcagaacggaaggagatagagacacaaaaaactcttcaaaaaatcagtgaatccaggagctggttttttgaaaagatcaacaaaattgatagactgctaacaagactaataaagaagaaagagagaagaatcaaatagacccaataaaaaatggtaaaggggatatcaccactgatcccagagaaatacaaactaccatcagagaatactataaacacctctacacaaataaactagaaatcctagaagaaatggataaattcctggacacatacaccctcccaagactaaaccaggaagaagttgaatctctgaatagatcaataacaggctctgaaattcaggcaataattaatagcctaccaaccaaaaaaagtccaggaccagactgattgacagccgaattctaccagaggtacaaggaggagctggtaccattccttcagaaactattccaatcaatagaaaaagagagaatcctccctaactcattttatgaggccagcatcatcctgataccaaagcctgacagagacacaacaaaaaaagagaattttagaccaatatccctgatgaacatcaatgcaaaaatcctcaataaaatactggcaaactgattccagcatcacatcaaaaagcttatccaccatgatcaagtgggcttcatccatgggatgcaaggctggttccacatacgcaaatcaataaatgtaatccagcatataaacagaaccaaagacaaaagccccatgattatctcaatagatgcagaaaaggcctttgacaaaattcaacagcccttcatgctaaaaactctcaataaattaggtattgatgggatgtatctaaaaatagtaagagctatttatgacaaacccacagccaatatcatactgaatgggcaaacctggaagcattccctttgaaaactggcacaagacagggatgccctctctcaccactcctattcaacatagtgttggaagttctggccagggcaatcaagcaggagaaggaaataaagggtattcgattaggaaaagaggaagtcaaattgtccctctttgcagatgacatgattgtatatttagaaaaccccatcgtcttagcccaaaatctccttaagctgataagcaacttcagcaaagtctcaggatacaaaatcaatgtgcaaaaatcacaagcattgttatacaccaataacagacagacacagagccaaatcgtgagtgcactcccaatcacaattgcttcaaagagaataaaatacctaggaatccaacttacaagagatgtgaaggacctcttcaaggagaactaccaaacactgctcaaggaaataaaagaggacacaaaaaaatggaagaacattccatgctcatgggtaggaagaatcaatatcgtgaaaatggccatactgcccaaggtaatttatagattcaatgccatccccatcgagctaccaatgactctcttcacagaattggaaaaaactactttaaagttcatatagaaccaaaaaagggcccgcattgccaagacaatcctaagtcaaaagaacaaagctggaggcatcatgctacctgacttcaaactatactacaaggctgtagtaacccaaacagcatggtactggtaccaaaacagagataaaccaatggaacagaacagagccctcagaaataataccacacatctataaccatctgatctttgacaaacctgacaaaaacaagaaatggggaaagtttccctatttaataaatggtgccgggaaaactggctagccatatgtagaaagctgaaactggatcccttccttacaccttatacaaaaattaattcaagatggattaaagacttaactgttagacctaaaaccataaaaatcctagaagaagacctaggcaataccattcaggacataggcatgggcaaggacttcatgtctaaaacaccaaaagcaatggcaacaaaagccaaaattgacatgggatctaattaaactaaagagcttctgcacagtgaaagaaactcccatcagagtgaacagacaacctacagaatgggagaaaatttttgcaatattgtcatctgacaaagggttaatatccagaatctacaaggaactcaaacaaatttacaagaaaaaaacaaacaaccctatcacaaagtaggtgaagcaaaagaacagacacttctcaaaagaagacatttatgcagccaaaagacacacgaaaaaatgctcatcatcaccgaccatcagagaaatgcgaatcaaaaccacaatgagataccgtctcacaccagttagaatggcgatcattaaaaagttaggaaacaacaggtgctggagaggatgtggagaaataggaacacttttacactgttgttgggactgtaaactagttcaaccattgtggaagacagtgtggcgattcctcaaggatctagaactagaaataccatttgtcccagccatcccattactgggtatatacccaaaggattataaatcatgttgctataaagatacatgcacacatatgtttattgcggcactattcacaatagcaaagacttggaaccaacccaaatgtccatcaatgacagactggataaagaaaatgtggcacatatacaccacagagtactatgcagccataaaaaatgatgagttcatgttctttgtagggacatggatgaagctagaaaccatcattctcagcaaactatcacaaggacaaaaaaccaaacaccccatgttctcactcataggtgggaattgaacaatgagaacacttggacacaagaagggcaacatcacacaccgggacctgtcatgggttgacactgcaacttgctttgaccaatagcatggacagaaatgagacctaccaactttatattgctctcttcgaggtctgtgccaccacgtaagaagtataactatgctgcttctagtgaagttgagcctcacccagatgtctcagctaccataactaaggcactagacatgtgggtgagccatttggattttccatcctcatgcccagctgaactcccagggcaatggagctgcataaattggaccatttggaatagaaggacatcccagatgattccagtcagcccagaatcataagaatcctgagaaataatatgtcatgattgtcttaagcaactaaatgaaaacatagttggatacaaagcagtatataactacaaaagccttttagttcaagagctagtttaactttacagtaaatattcagtagaaaatctctggtctgtggtttctgtctcctgactggatcttgacagatccaaacataaatgctgaaaccaataaaataatctggtctaat

SEQ ID NO: 936 - DNA, 5974 bp, Homo sapiens
ttttcctgtggatagcagaaaacatgaggtaaattgcacggtatctgcataaggagagataagtaaagacactggcatatgatcagtgagaagtgtcgggcctctgggcccaagccaagccattgcatcccctgtgacttgcacgtatacgcccagatggcctgaagtaactgaagaatcacaaaagaagtgaatatgccctgccccaccttaactgatgacattccaccacaaaagaagtgtaaatggccattccttgccttaactgatgacattaccttgtgaaagtccttttcctggctcatcctggctcagaaagcacccccactgagcaccttgcgacccccactcttgcccgccagagaacaaaccccctttgactgtaattttcctttacctacccaaatcctataaaacggccccacccttatcttcctttgctgactcttttcagactcagcccacctgcacccaggtgaaataaacagccatgtagctcacacaacgcctgtttggtggtctcttcacacggacgcacatgaaatttggtgccctgactcggatcgggggacctcccttgggagatcaatcccctgtcctcctgttctttgctccctgagaaagatccacctatgacttcaggtcctcagactgaccagcccaaggaacatctcaccaattttaaatcaggaacttgctacacgtgctggaaatctggcaactggaccaaggaatgcccgcagcccgggattcctaagccgcatcccatctgtgtgggaccccacggaaaatcggactgttcaactcacctggcagccactcccagagcccctggaactctggcccaaggctctctgactccttcccagatcttctcggcctagcggttgaagactgacactgcccaatcacctcggaagccccctagaccatcacggacgccgagcttcaggaaacgacgaggctgaatcctgttggagtgatttgttcttcggactttgtatcttaaatgaaatcttctcccttagaggccacataaactgatggtacaatctgcaactctaagcaaattcatagaactgcaggattctccaggctcatcttgtatatttcatggctcaggcgctgaatcaccattttctccatggagcacttgtaccttgtattggagaataacatcagaaatcaagatttagttgtgttctcaatttctttaaagtgttttcagttttaagtcggagcttaaatactgagtacacatggacacaaagaagggaacaacagacacagaggcctgcttgagggtgaagagcgagaggaggatgaggatcgaaaaactacctattgggcactatgcttattactgggtgacaaaataatttgtacaccaaacccccgtgacatggaatttacctatacagcaaaccttcccatgtattcccaaacctaaaataaatgttaaacaaaaatctgggtgctaggtgtgctattgttacaagaaagtcaatgtttctaggctctgttaactgacaaagtaaggaaatacatacgcaaacactaactcatgtatacactacacattatctatcatctatctaaatttacataagatgaaacacgaattgataccgatttctccaactctaattgaataccacatatatcattctagtagtctcatcttgctggtttgttaccttccactgtaaaagtgagaaacctgcattgtataagaagactctgttcagctttgaaagaaactgtaaaaccattttccaaagtggatgtaccaagtatacaatttactcaattattcaactcaaatgtacatgtacaggattgttaacatatgccctgtcgggacaagatatgaacttgtacagtgcagagtttatgtaaagattacattgccttcagtcttaacagaatccacccttctccaaagttacttaggtcagcaccatttgtgcattgccttcaggtaggttgcttcatacattggtaaatacagttagattcttttatcacactcaacatttcatcctgggattccttgacttcctatttcttaataatttgcatatatcagctttcatgtcctgtgctgcaagtgcaataggttttgacaactgcaaagtagtatgaatccaccattatgatgttatacagaataatttcaatgccctaagaaaatgcatgtgcttcatgaattcaacctctgcccaaacccttgacaaacactgctttctttatagtttctacagttttgccgataaattgcaatcatgtattagatagtctttacagaatgcctttcttcatttagcaatattcatttaagattcatcatgacttggaatagcttgatgggttatatctatttattgctgaataatattatacaatatatttttctgttccatatttaagaatatattggttgtttccagtttattgtgatgatgtataaagctgttgttaatatctacataaagatttgtgtggggacaatttttcaaatcactggttaagtaactaggatcacaatggcctgattgtaaaataagcctatgttcagctttgaaataaactgtcaaaccatttccaaaagtgaatgtagcagtttacatccccaccagcaacaaacggagcactagttgttctgaatctacagcagttgatattgtttaatttatttatttttactttagctattctaataggtgtgatgttataccttacagattgaatttgcatttcaaatagcaaataatgttgatcatcttttcatctgtgtatcctcttacctgaggtgtctatttagatcttttgcctattttgtaattgtgtcatttgtttagttttaggtgttctttgtgtattttttattgtttagttttaggtgttctttgtgtattttagatacaagtcattttgaaaaaaaaaatgactgtgtctggttgaggagattaactcctggttcaaaacctatatgtgattttttagacctgaccacaggcaactacaaaggctttacctggcaggactcatgggaataaactgcactcccacagaccagactgggtacacagacagttcattacagtctctgaagggagttgcagttgagaactcagggcctcttgactggtcaggctcttacggtatttaaattcctagtgccttcattcctagatctctttatctgaggtctaggacagagagatcttcttcaagtatctctgctgagacctcctggaggagaaaaaggtgggaaaacttcaagatatgctttttttcccactttgactcagcacccagtaatttgtcactcccagctcttcctcctcatcctgcccctgacaccagggtctataaagctgcctgactctattgtttgcggcttcctcaacagggaaatgatccacctctctgtgcaacagaaacccctccacctgtgtgcccttccatgggagggatgagacagagagttggggcttcctttggttttagactcctgcttatgccatcacagtatgtgaataaaggcttaactcctttatttttaacttgttgctttaattggatcctccaacacttgctttaattggagcctcctgatgctaggttttcctttctctttacagtgcatttcagggaaacatagttattaatttcaacaaagtccaacttatcaattttttttctttttttttctctcaggattgttcttttggtgttgcattgaaaaacttgtcaccaaaaccaaggtcatatagattttcccttatgttttattttataagtattatagttttacattttacatttaggtctatgagccattttgagacaattattaagaatataaaatgtgttgggtctttgcacaggtatttatttttcctttttgcacatggatatcccattgttccagaaacatttgttatagtctattctttcttaattaaattggctttcaatcattgtcaaaaattaattgattgtattttattggtttattgctggaaatcaattttgtccaatttacctatgtttctattcttttgtcaataatatcctgttttgattcttataactgtaattaatgtagaaattgagtagtgtgagtgctcttatatttttcagcaatattgcatagctattctaggcattttgcctttctatataaattttagaacctttttattaacatcaataatagtttgctgggattttgattacgattgcatgaaatgcacagaccaagctggaaagaagtgacattttaataatattaaatctttcaatccgtgaacatggaatatttctccatttatttaattatttgttgatttttttcaccatattttgtagttttctacaaacagattctggagatattctattaaattatgtaaagattagaacttccctctgcctctactttctgggagattttgtaaaaattggtattatttttctttaaatgtttgttaaaattctctagtaaaaccatatgtctagtgctctctcttttagaaaatttgtaattatttaatttgtttaatatattttgaaatattcaagcattatttctccatttttcatttttggtagtcttttaagaaattgtttcattttacctaaggcagaaaattggtgcctttgagatgtttgttgtattttttatttaaattttactgcccgacagttggtagtgatggaccccactcactctgatgttgtaatttgggtcatctctctttttttcttgattagtctggatagaggtttttgaatcatatcaatcttcttagagaaaaagctttaaatttttttttaattttaattttgatttttgtgagtacatagttgatatatatatttatgagatacatgagatgttttgatacatacatgcattatgtaatcatcacattatggagaatggggtatccatcccctcaagcatttatcctttgttttaaagaacaagattttggtttcattttatttgttttgtatttcaatattcttgatatttctctaatattaattttaattttattctactttctgactgcctaactcagtctttattttctagtttcttagagacttgggttattgattgtagatctaccatattttctaatatattaatttacttcaataaatttttcctaagcattgtttttcctacaccatacaaattttgatacattttatttttattttttttaccagtttattgctgtagaagctcctgttccaggtaagtagatgttggccatgactctctggagttatctatcaccccagatattggattaaaagtttgccttgcaaattcagttctctgttggtcaaagaaaattaattgattttaagtttttccaattcatcttgttttaaagatagaagtcatgacttccaagctctttaaatgtcagagctgaaactagaaggccacaattatatattttaagaacataaaatgtctcccttattcctattacacaataggttacaaatacctgtcagctatgctttcttccttcagtaaacctaaattggtgtacaaccactgagttccaggtactcagcaaggtgtctaagatttactaaagacacaacttgacctttgttttccaggagactttaaagcttttattcaccttttacattataccaagtaattttcacagctgcagggaagtcactcttcatctttccaattagagttgttatactcaaatggtacttgcatttagtatgtaattttatcatttcactccgctataaatgacagctacccaagctaccagttaacaatagaaataatatgcaggagcatcacactagagaaaacttcaacaaataagagttagagcacaaataattgaacgagaagcttctgaatttttaaaatattattcaacgttatagaagtgtttctctttcatattta

SEQ ID NO: 937 - DNA, 13333 bp, Homo sapiens
ttttcctgtggatagcagaaaacatgaggtaaattgcacggtatctgcataaggagagataagtaaagacactggcatatgatcagtgagaagtgtcgggcctctgggcccaagccaagccattgcatcccctgtgacttgcacgtatacgcccagatggcctgaagtaactgaagaatcacaaaagaagtgaatatgccctgccccaccttaactgatgacattccaccacaaaagaagtgtaaatggccattccttgccttaactgatgacattaccttgtgaaagtccttttcctggctcatcctggctcagaaagcacccccactgagcaccttgcgacccccactcttgcccgccagagaacaaaccccctttgactgtaattttcctttacctacccaaatcctataaaacggccccacccttatcttcctttgctgactcttttcagactcagcccacctgcacccaggtgaaataaacagccatgtagctcacacaacgcctgtttggtggtctcttcacacggacgcacatgaaatttggtgccctgactcggatcgggggacctcccttgggagatcaatcccctgtcctcctgttctttgctccctgagaaagatccacctatgacttcaggtcctcagactgaccagcccaaggaacatctcaccaattttaaatcagcggccaggcgttcctccagaacctcctcccacaggaacttgctacacgtgctggaaatctggcaactggaccaaggaatgcccgcagcccgggattcctaagccgcatcccatctgtgtgggaccccacggaaaatcggactgttcaactcacctggcagccactcccagagcccctggaactctggcccaaggctctctgactccttcccagatcttctcggcctagcggttgaagactgacactgcccaatcacctcggaagccccctagaccatcacggacgccgagcttcaggaaacgacgaggctgaatcctgttggagtgatttgttcttcggactttgtatcttaaatgaaatcttctcccttagaggccacataaactgatggtacaatctgcaactctaagcaaattcataggttatactttttcttcttcatacttgacatttgaacctagcaagtttgaatagcctgtaatttgaaaactcccttgcacatctagcagatcaaggtagcttgttctgccttctggacaaatggtgcccttaagtcagcttagggagactgttccgatatcaagattctgtttgaatactatatactctcagctgcttatttattcatatatatatgacacgtttatcatggaagtatttcaaaactatctgaaaatgaatattgattattaaggcattcagttttaggaagaaaacatacataaatatatgatcttcattattttcctttctccatgcaatttcaatagatatttatcaagaactcaaaatatgcctagcactgcctaggtgttggaaacattagagaaattaaaacagataaattccttcctttagtagacttagtctaactaaataaatgatttttaaaagggcataataaatggtataagcaaaagaaaatgaaggtgaggggaatagggcatgccaagtagggagctgctattttaatgaggcctaggagaaaaccatttataaggtgacatttgagcagagacctaaagaaagtgagaaaacgtgatacatgtatgtacatggaaaaagaatataataagcaaaaaaaaaaaaaaaaatggaggccaagagggaatcttatgcattacacagattttgaactaaaagcaagaaggccataatggctaaaaataaatgaggattcattaaagagggtgaagaatatagagagttaggactattgctgtgatgtaaagtcattggagagatgacctgagagattagaaccctggggtaacttacatttcatttgctgttttattccaaagtgatattcattatctaaagaaaaaaatcaaatatacagaaatgataaaatacaaaacaatgctgacctttaagaaacattgacctataaatactaagatgttaaatatttgtttcttgtgatttgtatctttattgatgtgataattatgtatctataagtttgtgagtaaaatacataacaagcctggaatgtattttctttataattcacattaattttttgcactaaaattcaatctagtaaatttcctgttatagtcaattaattttgacaacacatattttaatgctccatggtattaacaacccattatgatttgcatttaagattatttagagtattcagtgtaataaataatgcaaatgtaggcaaaagcttttccatgtatacacacacactacacactatatttttaattatttcattcacatagattaaaataaacttttgtttaatgtaaaacaatattgatgctcccaactccctagttactttgtacaatttgcatgcctaccagcaatgatgaatatcctaattgccttaaacatatctatattatgtcaaatctttcatgcactttcagtgtctgacttctttagcactgaagttcatgctcagatttaaagggcctgtatgaataggtgaggcccacctgaatactctgcagataacctgatttggtaccttaattccatctttaaaatcctttctagcaacacctacattcatgattgatagactaactgagagaaggtatatacaccacggactgcgaattttggaggtcactttagaattctgtctaccacggatacatttgaatatatctgcacatttacatatagttgtcaccacattaaggaaaattaacatatagattaccccgaaaaatttcctcaaactattttataattccttaatcccaccccttcttgccctctttaccaccttcaattctaggaaactgcacctatgctttttgtcactatgattggtttgttgtgtctgagattttatataaatgtcaccatacactatgcactttttgtctgacttctttcaactagcatagtttgagattcctatatgttttatctatcaatagtatatttttatggctgagtcttattttattatatgactatattcaccttcatgacaatagacattaggttgtttccagtttggggcctgagaaataaagttgttttgaacattcatgtacaagtatttgtaaggacatatgcttttatttcttttgcataaatactaaaaaaaagagtggctgggctataagtgtgtttagcttttataaaacctaaataattcaaaaagcaaaaaatgaaaatctcatttaaaacaatgggcaaaggacataaacagacatttctcaaaagaatacctacatgcagccaacaaacatgaaaaaattctcaatatcactaattattagagaaatgcaaatcaaaactacaatgggataccatctcatatcagtcaaaatggctattgttaaaaaaataaaaaattacaggtgttggtgaggtttcagagaaaaggaaatgctttcacactgtcagtgggaatgtaaattagttcggccactgtggaaagcagttttgagatttctcaaataactaaaaaaacagaactactgttcaacccagcaaccccattgctgggtatatacccaaaggaaaataaattgttttttcaaaaagacatgtgcacttgaatgttcattacagcactattgacaatagggaagacatggaatctacctagatgtatatcagtgttagactggataaagaaaacatggtacacatccaccataggatactatgcagccataaaaatgaacaaagtcatgtctttgcagcaacatggatgcagctaaaggccattatcctaagcaaattaacagaggaacagaaaaccaaatactacatgttctcacttataagtgggagctaaacattgagtttagtttacacatagacataaaaatggaaacaatagacactggtcactggggacttccagaagggggagcgtgggaagaggacaagggttgaaaaattacctgttggttactatgctcactactgggtgacacaaacatttgtactccaaacctcagtgacgcaattcatccatgtaacaaacctgcacatgtacccactgaacctaaaataaaaactgaaagaaaaaaatatatttttagctgtagctgaaaaaaaaaaaaggaaacagaaaaagaaaccgccatgctattcttcaaagtatttgtgtcatattacatgtccagcatcagagagtgagagttccagttctccagcacttggccttgttctctctaacttcagatattctacaggatgtgtagtagtatctcaatgtgctttcgtttccagttccttagttactaatgatgtttaaccatgttttcatgtgctattttatcctttgtgcattttagtttgtgaagtgtctttagcaatttttaccctttttaaaaaaaagtattgtttctttcttataattttttttttttcgttgagatggagtctcactctgtcacccacactggagtgcagtggtgcgatcccggctcactgcaacctccatctcccaggttcaagcaattcttgtgcctcagcctctccggtagctgggattacaggcatgcaccaccatgcccagctatttttttttttttttttttgtatttttaatagagacagggtgggtttcaccatgttggccacgctggtctcaaactcctgccctcaagtgatccacccgcattggcctcctaaagtcctgggattacaggtgtaagccactgtgcccagcctgtttcttataattggattttgaaaacttttttatatattatagatacatgtcttgtatcagtcatgaaattttaaatatattctccaagactgtgtattgtattttcattccctgaaaagtcttaatagaagaaaaaaattgctaattttgataaagtcaaaatttttaacttttctttttcatgaatcataattttgatgccatctataagaaatatttgcttggaacgcattcataaagaatttctcctctccttctagtaatttaagaattttcatttttatattttgggacaattgtcattttgagttaactttatatatgatgtgaggtatggatggaagtttatttttgttgacaaatggttatccacctgttcctgtgaagaagcattatcttatgtccattgaattcctttgtacctttgataaaaatcagtgaaatatatgagactatttatgtacagtccattctggtccattgaactgtcttcacaccaatgccatactgtcttgaatacactgtagcttcatggtaagtcttgaggtcagataggatatacagttcaaatttatttttacttttaattgttttggctattctaactctttaacattttcattcaaattaacctatgaatgttttcaaacaagcctactataatttcaaatgagtttctgttaaaattttgttgatcaatttcaggagtattaaaattttcctaatattgagtccttggattcataaacacagttcatctctccattgatttttgtctcttgtatttgtgtcagttaaatttttgtagtttttaatatataggtctttcacatttttcatggtttaagcactaataaaattatacttgtatattatagaaaatgatattttattttaattctgattattgtttttgaatataaaagtacaatggaattttatgggttttgtatcttgtgaccaaattaattagttctaggtctttatgtaaattataggattttacatgtatgataacatcattgtgatagttttacttcttcctctgtaatctgaatgccttttgtatttttcttgcatttattacacagactagagcttccattataacgatgaatagaagttgtaagagcagatgaccttgactttctgctaccattaaaggggaaatgtatagtttacgataaactatgatgtcagcaagaggtttctctgaaatgcccttttttagattgaggaacttccaaatgattcctagattgatgacagtatttatcagggatgaatttttggatttatcaaatgtttttttctgcatttattgaaattatcatagtatttcccttctgtgagtttgttaaatatgatgacatactaattctcaaaggttagaatactttcacttttctgattcactttgtcaggttatattaacacttgattttcttaaaaaaacaacttttgattcattgattcgatttattgtttttctattttttattttgttgataattcttatctttattaacattttctatttatcattggctttaaggaacttaacttttatatgacttgatgtagttttcttcatatttctagtacttgggctttgctgaacttcttggctctgttggttgatgttttttaataaaacatggaaacattcccatcattttttctcaaatatttttctgcctctcttattatccttctagacccaaattgtgcatgtatttgatcacttaaacatatcccataattcacataagctatttactacttttaagaccctttttaatccatattttacttatatagtttctattgttggactttaagttaattaatatagttttatgttttgcttggttttctgcagtttctaatcttttatttcatagattgtgtttttcagagctttcttttttatgtctggaagttaaatttgaacttttttatattttctatatttattaataccatcaatttttatatacctcgttgaatatataaatttgattgacaaaaataatttcaatgtctttgtctactgagtctatcatattatttctatgtgtgatttggtttattattctcccaattagtgatcagatttctatgctttctgaatgcctgattaattttgactagagtttatatactgtgaattttttacctttatcctgctagctcccatatatttgtgtattcacaaaaatgttattgagctttgttctaagacacagataaatttcttggaaatagtttgtttcctctaaggcttattctagtctttgtacacaggacccaataacctaacaatctgttgctaatttatttttgccactactgagtcaatatccttccaaataagaatagaaaatattatcccatttttattagcattggggattattttttctgctttttttgggtggtgctttctctggctttttttttatatatacactcatatgctgcttagtcttcaagtaaaatcttgacagagacatctggatctctctctctccctctttcttctagtgtgttttcctgcaaactctttgtgcctcctgaactaggaagattcctaggctccaactttattttatcttcctgtactgcagcgtcaaaccacattgcagttagtatgctgggggatcataagaccatttctttcctctttttcaggaaatctctcttgcaattcttaatatctaaagtctgaaaactaaaggtttattcttttattatttttccagaatatttgactctttcaagcagtagagtatatcccatatcccatccctgttattctaccttgccctgaaaaaaaaaatcactttttgacttgtaattttttttttttttttttgagacagagtctagctctgtcacccaggctggagtgcagtggcgtgatctcggctcactgcaacctccgcctcctgggtcaagtaactcttctgcctcagcctcctgagtagatgggactacaggcgcgtgccacaatgcccagctaatttttgtatttttagtggagacggggtttcaccatattggccaggctggtctcgaactcctgacctcatgatccacccaactcggcctcccaaagtgctgggattataggcgagagcctctgtgcccgggctttgacttgtaattttaaaaacaaaatgtagaggtatcagttgtttcagacgtgttgtattaatgaggaaagtaatagagtaaaactattgataatatttcatgcttactataccattgatgtacaatattccacatacagtgttataatttagtggattttttatatattactatttaaccaatgtcactggattcagaagtatttatgttaagatgtaaaggataaataaaatattttatgatttaaaaatatatcagaaatttaatcacctggtaaacatcaatataaagccaattgaaactaacaacatttttctttgaaaacataaaccaatgtgcacatgctgaaattgggagcaactttgttaaaattcatcaaagaaaatggaaagaagaaaagttcactttaattccactggaactgcaggattctccaggctcatcttgtatatttcatggctcaggcgctgaatcaccattttctccatggagcacttgtaccttgtattggagaataacatcagaaatcaagatttagttgtgttctcaatttctttaaagtgttttcagttttaagtcggagcttaaatactgagtacacatggacacaaagaagggaacaacagacacagaggcctgcttgagggtgaagagcgagaggaggatgaggatcgaaaaactacctattgggcactatgcttattactgggtgacaaaataatttgtacaccaaacccccgtgacatggaatttacctatacagcaaaccttcccatgtattcccaaacctaaaataaatgttaaacaaaaatctgggtgctaggtgtgctattgttacaagaaagtcaatgtttctaggctctgttaactgacaaagtaaggaaatacatacgcaaacactaactcatgtatacactacacattatctatcatctatctaaatttacataagatgaaacacgaattgataccgatttctccaactctaattgaataccacatatatcattctagtagtctcatcttgctggtttgttaccttccactgtaaaagtgagaaacctgcattgtataagaagactctgttcagctttgaaagaaactgtaaaaccattttccaaagtggatgtaccaagtatacaatttactcaattattcaactcaaatgtacatgtacaggattgttaacatatgccctgtcgggacaagatatgaacttgtacagtgcagagtttatgtaaagattacattgccttcagtcttaacagaatccacccttctccaaagttacttaggtcagcaccatttgtgcattgccttcaggtaggttgcttcatacattggtaaatacagttagattcttttatcacactcaacatttcatcctgggattccttgacttcctatttcttaataatttgcatatatcagctttcatgtcctgtgctgcaagtgcaataggttttgacaactgcaaagtagtatgaatccaccattatgatgttatacagaataatttcaatgccctaagaaaatgcatgtgcttcatgaattcaacctctgcccaaacccttgacaaacactgctttctttatagtttctacagttttgccgataaattgcaatcatgtattagatagtctttacagaatgcctttcttcatttagcaatattcatttaagattcatcatgacttggaatagcttgatgggttatatctatttattgctgaataatattatacaatatatttttctgttccatatttaagaatatattggttgtttccagtttattgtgatgatgtataaagctgttgttaatatctacataaagatttgtgtggggacaatttttcaaatcactggttaagtaactaggatcacaatggcctgattgtaaaataagcctatgttcagctttgaaataaactgtcaaaccatttccaaaagtgaatgtagcagtttacatccccaccagcaacaaacggagcactagttgttctgaatctacagcagttgatattgtttaatttatttatttttactttagctattctaataggtgtgatgttataccttacagattgaatttgcatttcaaatagcaaataatgttgatcatcttttcatctgtgtatcctcttacctgaggtgtctatttagatcttttgcctattttgtaattgtgtcatttgtttagttttaggtgttctttgtgtattttttattgtttagttttaggtgttctttgtgtattttagatacaagtcattttgaaaaaaaaaatgactgtgtctggttgaggagattaactcctggttcaaaacctatatgtgattttttagacctgaccacaggcaactacaaaggctttacctggcaggactcatgggaataaactgcactcccacagaccagactgggtacacagacagttcattacagtctctgaagggagttgcagttgagaactcagggcctcttgactggtcaggctcttacggtatttaaattcctagtgccttcattcctagatctctttatctgaggtctaggacagagagatcttcttcaagtatctctgctgagacctcctggaggagaaaaaggtgggaaaacttcaagatatgctttttttcccactttgactcagcacccagtaatttgtcactcccagctcttcctcctcatcctgcccctgacaccagggtctataaagctgcctgactctattgtttgcggcttcctcaacagggaaatgatccacctctctgtgcaacagaaacccctccacctgtgtgcccttccatgggagggatgagacagagagttggggcttcctttggttttagactcctgcttatgccatcacagtatgtgaataaaggcttaactcctttatttttaacttgttgctttaattggatcctccaacacttgctttaattggagcctcctgatgctaggttttcctttctctttacagtgcatttcagggaaacatagttattaatttcaacaaagtccaacttatcaattttttttctttttttttctctcaggattgttcttttggtgttgcattgaaaaacttgtcaccaaaaccaaggtcatatagattttcccttatgttttattttataagtattatagttttacattttacatttaggtctatgagccattttgagacaattattaagaatataaaatgtgttgggtctttgcacaggtatttatttttcctttttgcacatggatatcccattgttccagaaacatttgttatagtctattctttcttaattaaattggctttcaatcattgtcaaaaattaattgattgtattttattggtttattgctggaaatcaattttgtccaatttacctatgtttctattcttttgtcaataatatcctgttttgattcttataactgtaattaatgtagaaattgagtagtgtgagtgctcttatatttttcagcaatattgcatagctattctaggcattttgcctttctatataaattttagaacctttttattaacatcaataatagtttgctgggattttgattacgattgcatgaaatgcacagaccaagctggaaagaagtgacattttaataatattaaatctttcaatccgtgaacatggaatatttctccatttatttaattatttgttgatttttttcaccatattttgtagttttctacaaacagattctggagatattctattaaattatgtaaagattagaacttccctctgcctctactttctgggagattttgtaaaaattggtattatttttctttaaatgtttgttaaaattctctagtaaaaccatatgtctagtgctctctcttttagaaaatttgtaattatttaatttgtttaatatattttgaaatattcaagcattatttctccatttttcatttttggtagtcttttaagaaattgtttcattttacctaaggcagaaaattggtgcctttgagatgtttgttgtattttttatttaaattttactgcccgacagttggtagtgatggaccccactcactctgatgttgtaatttgggtcatctctctttttttcttgattagtctggatagaggtttttgaatcatatcaatcttcttagagaaaaagctttaaatttttttttaattttaattttgatttttgtgagtacatagttgatatatatatttatgagatacatgagatgttttgatacatacatgcattatgtaatcatcacattatggagaatggggtatccatcccctcaagcatttatcctttgttttaaagaacaagattttggtttcattttatttgttttgtatttcaatattcttgatatttctctaatattaattttaattttattctactttctgactgcctaactcagtctttattttctagtttcttagagacttgggttattgattgtagatctaccatattttctaatatattaatttacttcaataaatttttcctaagcattgtttttcctacaccatacaaattttgatacattttatttttattttttttaccagtttattgctgtagaagctcctgttccaggtaagtagatgttggccatgactctctggagttatctatcaccccagatattggattaaaagtttgccttgcaaattcagttctctgttggtcaaagaaaattaattgattttaagtttttccaattcatcttgttttaaagatagaagtcatgacttccaagctctttaaatgtcagagctgaaactagaaggccacaattatatattttaagaacataaaatgtctcccttattcctattacacaataggttacaaatacctgtcagctatgctttcttccttcagtaaacctaaattggtgtacaaccactgagttccaggtactcagcaaggtgtctaagatttactaaagacacaacttgacctttgttttccaggagactttaaagcttttattcaccttttacattataccaagtaattttcacagctgcagggaagtcactcttcatctttccaattagagttgttatactcaaatggtacttgcatttagtatgtaattttatcatttcactccgctataaatgacagctacccaagctaccagttaacaatagaaataatatgcaggagcatcacactagagaaaacttcaacaaataagagttagagcacaaataattgaacgagaagcttctgaatttttaaaatattattcaacgttatagaagtgtttctctttcatattta

SEQ ID NO: 938 - DNA, 16180 bp, Homo sapiens
ttttcctgtggatagcagaaaacatgaggtaaattgcacggtatctgcataaggagagataagtaaagacactggcatatgatcagtgagaagtgtcgggcctctgggcccaagccaagccattgcatcccctgtgacttgcacgtatacgcccagatggcctgaagtaactgaagaatcacaaaagaagtgaatatgccctgccccaccttaactgatgacattccaccacaaaagaagtgtaaatggccattccttgccttaactgatgacattaccttgtgaaagtccttttcctggctcatcctggctcagaaagcacccccactgagcaccttgcgacccccactcttgcccgccagagaacaaaccccctttgactgtaattttcctttacctacccaaatcctataaaacggccccacccttatcttcctttgctgactcttttcagactcagcccacctgcacccaggtgaaataaacagccatgtagctcacacaacgcctgtttggtggtctcttcacacggacgcacatgaaatttggtgccctgactcggatcgggggacctcccttgggagatcaatcccctgtcctcctgttctttgctccctgagaaagatccacctatgacttcaggtcctcagactgaccagcccaaggaacatctcaccaattttaaatcagcggccaggcgttcctccagaacctcctcccacaggaacttgctacacgtgctggaaatctggcaactggaccaaggaatgcccgcagcccgggattcctaagccgcatcccatctgtgtgggaccccacggaaaatcggactgttcaactcacctggcagccactcccagagcccctggaactctggcccaaggctctctgactccttcccagatcttctcggcctagcggttgaagactgacactgcccaatcacctcggaagccccctagaccatcacggacgccgagcttcagatacgcgcatgaaaggaagattaagaaaaacaaaaaaatgtaaatttactggacactgaatatatactaagtactgcttaagtgatttacatgtcaagattaaaatattttgctttactttaattatcatcatattcttcatccatctttcatttcatcttcatcatgccatttctttctccttcccctgggcctgaaattttatcaagaagacacacttgctgtgtgacttgattaatttacttaagcatggtaagcctttgtataatatggaattagaaaaaaaagtcttcttagaagtattttatgaaaacgacatgagagacagtatgtatatggtttgcatcacatgtctggcattatttaccattaattgttttattctcttaatttgagcaatttacttttgaaatgctatctggaaacggtgttaattttaagaaaggttgggcctctatgtaaaaatactgtaagaggtcacaacaacaaatatgtcttaaattctgatgatgtgttaaaaagcttgagaagcactcaataacaaaaacatactcactgacatacaggaaggtgaaatgaggtgtccatggctagacagctaataaatgtaagagacagattctgatctcagatgatttgatcagaaacttttaaccactatatgctgaattagcactaaaatataaatctaaaagttgtgttctttttaactcttactaggtactatttgttaagacattttaagaatacagtataaagatttttgccaactttttcatgcttaatgcttatgtaaattaatttcttaagtaagatagcatgcctataaaaatcctagggatagtgtattacccatgagatttctaagctatattttttaatgtagtaaatcaaagtgggtgtattccaatttcttacaactagaaaagctaatttcgataaaaatgaaatatttacatgaatcaactgcaaggtttttaaaatatattatttttaattaaaaataatcgctggcgagcaaaaaggttattttggctatattgttcgtatcttgaaagtacccataccgcattagtgtatatccaaagtaatttatattttgtcctaaattaatatggtgttggttgaattttctatgtagaaatatttttgttttaatagaaaatacaattttccattttggcagttacacaaatataaaatatatttacacttaactgtatagttcaaatgttattcaattattttatatttataattattgcaatataatttaaaaaaatagttaagagattttatttacttatttgtttacgtatttatttatttatttatttatgttttgagactgagtcttgctctgttgcccgggctagagtgcagtggtgcgatctcagctcactgcaacctctgcctcccaggtttaagtgattctcctgccttggccttccaagtagctggggttacaggtgtgcgccaccacacccagctgatttttttgtatttttagtaaagacggagtttcaccatgttggctaggctgttcttgatctcctgacctcaagtgatctgctggccttgatctcccagagttctgagattacaggcatgtgccaccgctcccggcctaagagaggttatttttttaaaaaaacagttttaagtttacatcaaaacggatgggaaggtaccgagacatcctatgaaccttctgcctccacacatgcatattctcccctattatcaacgtcccttactgaagtggtgcatgtgtaacaattggtgaacctacactgagacatcattatcaccccaaatccacagttcatacaagtcttcactcttgatgctttgcattcccgggctggacaattaataatgacatgtatccatcattatagtatcacacaggttactttcagggcactgaaaataacgctatcctctgcctattcatcaatctctctggaccaacccctgcaactattgatatttttactatcttcataatttttccttttctgaaatgtcatctagctggaataatacaatatgtacccttttcagattgacttcttttattctttcttgagatttaatttgctttacctttatcttcctaaggtggaagcttagataattgcttgagttcttcttgtattctaatgttaatgctatacattttactctaaacactgccttcactgaatctcacacatcttgagaactagtgcttttatgttgatttagctcacaatatttttaaaatttctactctttctccaacccatgtgttattttgaggtatgttgttaaatctccaaatattttgtaatttctcagctatttttctgttattgatttctagttcaagtccattgtggtcagacaccagacattatgtaatttttatgtttaaaatgtgtttaaggtgattctgaaggcccaaaatacagtctattttgttgaatgtttcatgtgagcttgagaaaaatatgtattctgctgttgttggatgaagtagtcagtagatgtccattatatctatttgattgatggtatggttaattttagctatgcacttacagattttctgcctactggatctgtccatttctgttggagtgttgaagtcaattatgatactgtatgcatttatttctcctcatatttctatgggttttgcctcacatatttttatactctgttgtcaggcacatacacattaaatattgttatgtctcatcgaatgagtccttcattattacatcatgctcctttttattcctgacaactttccttactctgaaatttgctgtgtctgaaattaatatagtgctaattctggtttctttttattggtatcaacatgatatatctttctcgatttatttagtttgaatctataagtgcctataagaaagtgcgttttctgtaggcaacacatagttgggctttgttttctgattctctcctgacaaagctggattaatatctactatatttgtttcagttttctaattgctgccattattttttgcttctatttttatttttcactctttttctgtcttttgtggtttaatagagcatttcttatggttcaatttcctctttctctctgttaattccagcatgcctgctatgtctgagtctggttctgatgcttgccctgtctcttggaattattattattttgtcttttgttatgtattgtaaattgttttcttgatagttggaaatgggctggttaaaaggaattgtaaataggcctttagtaatgcgacgatatggtgtactaggagaaagggggttttctttaatcctgttagtagctctagtcttttcgtgagcctgtgcctgagttgtgaacttcgaatctgcttctcaacttttttttttgctttgttttcccacccctttaggtgggacacaatggctagagtgagctgggtttcggcattttccacgtaaagaaaggaggggctggagttctgtgtttcccttccccaaggtcatgtaggctcagataaaaccccagcagtttaggctttctttaactggtttctcctgtaggtaaatcttgtaaagaaaagactgttctggaaaatttcaaaatggttcctttacccacccactgctgaaagcttgagggtaattttctctgatattcattatgagaacctggcagagctcctgaaggcaaaactcagaaacaaatgggggggggggtcccaaagactgtagcacaggagtttttaatctttcagactcttccataatgagcctccagcaatttgtcaagaacccttaagtttttcctattttgacactggttcctatggagattgctgctcttataagttgtgagaaatttaattgttttttacttttgatataaatacctctacatgagtaatacatctgtatatttgctgtatttcaaaataagtaagatgggtccatgggcactattcagttacatgctcaagcaattttttagggtgtaagtaataagtaccctttagtcaataacatgtatatattacttattttcatggtaaaatgactagatgatttgatattccttcctccctgtccctttttatagattaaatttagcacatattcaggataacaactagatgtcagatatttgattacacagaatctgtgaaataaaccaatagataagatcttatgcagcatgcaaacccatttttttgcagtattcactgcaaaatcttataaaatcctatttcaaggttataaaatttaatcaactaggcatttttaagccaaaatcttgtactttctacattttaagcatgtcgtaagaaaagaatatagactctggctgtttccattttgaaacatcttattttgatcatataaataagcaaaagattaccctgagccagattggttttctctcttatcattaaggcctccactcatttctgccacctgagtcttcttatacaattctgtaattatacacatattaacatcaattgagtaagtaaatggatagcatcattttaatttatatttttccaaagtgaacaaaacacatgttttacagaaattaatagttgtatgcagtttgattacaaaataatacagctgatatttcaagcagtttgtagctcgctagctcattaatttttgctcattaattacactttttctctctcaactctcttactctaatctactttctctctgcaccctcaatacacacataaaatgtaagtaatagcagagtctgacataaatcagtttaaattacagttttgccagtcactgtttttgacactacggataaattattcaataactctgaggctcattttccgcatctgtgaattagggataaaaacgcttatcttatattgttcctgtgagtatctaatgagggcatatctgtaagtgcatgttacctaggcttgcacagtattttctaaaaatgaactatatatataatcatagtttccagatcgttaaccttcattttaatggtgcagaatatttttgttcagttggtctacaatttatacacatatatttaaagctacacaaaaatatattaactaataaaaaaatggactataaaatctgaaaaaggaagacttaagaacggtgatgggttaataaatagctcaatgcagacttgttaagggatgactagctgaataggtgtgtcaacaatacaatcacacaatcgtcttcaaataatttttaaataaacatattactggcatttactaatacaaagaagggtttctatctataagataatttaataggatctttctgcacagattaagttgattaccataaataaactagaactgatgtattcaaggggcatggctgtttgaagaacagaaggtagccacatgaatgtgttctatttagtaattaacagtatgtaaaatgaaagaatacctaaaccaaaatggctccacttaatcaactgttttgttggtagattacctagacccagatcctctatcactatcttctcaggagtcctaagcatattaatgcactgctcttgagtttttagaatttgttcagagtgtttaaaactacatacatgtaacatctgttttatacaagatacttcaaaaaccaaagtgattactataatacattctattaaacctaaaccaacatgtgttcaaatgcagagaacaaaaaggaatgttttgtcagatgttgcatctgatggattgaaagagttctataaaatagctcctctatagcttgtgctttctgtatttttgagtctttaggaaagtttaatgctggggaatatctgtgatgtgtgtgtgtgcctaggcaattcaaccctttgtggtaacacagcattcctagctatcattctatcgtatgacaatttattaattatcataatttactggcagtaatatttttctttaattcctcttttcaaacttgtcagattcagtaagaaaaaccaatgtaatatgcaaatgtctccactctatcattccatgagttatgagtcctttcttaccaactatatcatttataaactaagtacatgaatactaccaagtaatatactatcttatcattaacattaatcaacttatgcaatactttttatatattgaaaaatgtctactagagtataaaaaaattgtaaaaaactcaaactctttttttcttcttattttgactgctgcctgatgtaaacaatcaaacttttcatatagatccctatttctatttctatgtactactattgtaacacgctttctcattatcttaatttatgtttataaaagtcaaaacatatttttgtcatgagtaagatggtcttttcatattatgcactgtgttaatcggaggggaagtagggcagggagaaaaggaaactatagtatataaaaaaactactaagtcccagaactgcaatacccagtagtgtagcaactaatctcttgaaactattgaacacttgaaatgtagccagtggaaatagtgaagtgcggaaggtgcagtatacacattggattttgaagacaatacaagaaacagacagacaatgaataatactggtatcttgtatttatcccattttgagatgataatatttttgatatattaagatatattatgattaattatacctgtttattttcacttattaattttgttttttaggagattaaaattacatttgtgattcatattttattcttattggagaggactgtgccagatacttcacactaacactttgagttatggaggaacatgatcccttctacctgtatcatgaagtttgagaatttgaaaattatagtcctacttgaattaattttatattactatataaaaataccaaaaacttagtaacttaaacaacatccatttatgatcttacatttctatatgttacaactccaggtttgattttactggattctctgctaaaggagtttcactcaaggtatagaggctctggagaagaatccactttgagcccctttgggttgggcccactgttttctgttacatggacccctaaatcttcaaagagaagttgaatactttctgtattttgagttacgattttttcctctgtctctgacctgtagaaccttatgtgaaagttcatgtgacttggtcaggtccatctaaataatctcccttttcattaactcatttacaaaattccttttgccaactgatttggctcaaaattagtaattgatgttatagaagcctgtgggtttagggaaaggggaaattcaccaagaacctaaatagctctgtctgctttgtcttttttccaaatgtaccatgtggtaaattgctaaaccttattgagacagtgttttctcagttgacaaactgagtgtaccaacacgctacatttctgtatcatggggttgataaggattttatatgtatatatgcagaaagagactatagaggcttgtatatatgtatatgtgcatatgtatatgaacacaaaattctacaaagtgcttataccaatataagtactatcgcttagaatgcacctttttagctacctttcagattcttgtccactaagcattgccaagtcttcaaaggtaattgctgcaattttggcaaaatctctaagactacttttctgttctcatgaaactctgtttaaataggaaaaacacaaaataggtaggcaaacttttttctttctttctttctttttccacaggaaacgacgaggctgaatcctgttggagtgatttgttcttcggactttgtatcttaaatgaaatcttctcccttagaggccacataaactgatggtacaatctgcaactctaagcaaattcataggttatactttttcttcttcatacttgacatttgaacctagcaagtttgaatagcctgtaatttgaaaactcccttgcacatctagcagatcaaggtagcttgttctgccttctggacaaatggtgcccttaagtcagcttagggagactgttccgatatcaagattctgtttgaatactatatactctcagctgcttatttattcatatatatatgacacgtttatcatggaagtatttcaaaactatctgaaaatgaatattgattattaaggcattcagttttaggaagaaaacatacataaatatatgatcttcattattttcctttctccatgcaatttcaatagatatttatcaagaactcaaaatatgcctagcactgcctaggtgttggaaacattagagaaattaaaacagataaattccttcctttagtagacttagtctaactaaataaatgatttttaaaagggcataataaatggtataagcaaaagaaaatgaaggtgaggggaatagggcatgccaagtagggagctgctattttaatgaggcctaggagaaaaccatttataaggtgacatttgagcagagacctaaagaaagtgagaaaacgtgatacatgtatgtacatggaaaaagaatataataagcaaaaaaaaaaaaaaaaatggaggccaagagggaatcttatgcattacacagattttgaactaaaagcaagaaggccataatggctaaaaataaatgaggattcattaaagagggtgaagaatatagagagttaggactattgctgtgatgtaaagtcattggagagatgacctgagagattagaaccctggggtaacttacatttcatttgctgttttattccaaagtgatattcattatctaaagaaaaaaatcaaatatacagaaatgataaaatacaaaacaatgctgacctttaagaaacattgacctataaatactaagatgttaaatatttgtttcttgtgatttgtatctttattgatgtgataattatgtatctataagtttgtgagtaaaatacataacaagcctggaatgtattttctttataattcacattaattttttgcactaaaattcaatctagtaaatttcctgttatagtcaattaattttgacaacacatattttaatgctccatggtattaacaacccattatgatttgcatttaagattatttagagtattcagtgtaataaataatgcaaatgtaggcaaaagcttttccatgtatacacacacactacacactatatttttaattatttcattcacatagattaaaataaacttttgtttaatgtaaaacaatattgatgctcccaactccctagttactttgtacaatttgcatgcctaccagcaatgatgaatatcctaattgccttaaacatatctatattatgtcaaatctttcatgcactttcagtgtctgacttctttagcactgaagttcatgctcagatttaaagggcctgtatgaataggtgaggcccacctgaatactctgcagataacctgatttggtaccttaattccatctttaaaatcctttctagcaacacctacattcatgattgatagactaactgagagaaggtatatacaccacggactgcgaattttggaggtcactttagaattctgtctaccacggatacatttgaatatatctgcacatttacatatagttgtcaccacattaaggaaaattaacatatagattaccccgaaaaatttcctcaaactattttataattccttaatcccaccccttcttgccctctttaccaccttcaattctaggaaactgcacctatgctttttgtcactatgattggtttgttgtgtctgagattttatataaatgtcaccatacactatgcactttttgtctgacttctttcaactagcatagtttgagattcctatatgttttatctatcaatagtatatttttatggctgagtcttattttattatatgactatattcaccttcatgacaatagacattaggttgtttccagtttggggcctgagaaataaagttgttttgaacattcatgtacaagtatttgtaaggacatatgcttttatttcttttgcataaatactaaaaaaaagagtggctgggctataagtgtgtttagcttttataaaacctaaataattcaaaaagcaaaaaatgaaaatctcatttaaaacaatgggcaaaggacataaacagacatttctcaaaagaatacctacatgcagccaacaaacatgaaaaaattctcaatatcactaattattagagaaatgcaaatcaaaactacaatgggataccatctcatatcagtcaaaatggctattgttaaaaaaataaaaaattacaggtgttggtgaggtttcagagaaaaggaaatgctttcacactgtcagtgggaatgtaaattagttcggccactgtggaaagcagttttgagatttctcaaataactaaaaaaacagaactactgttcaacccagcaaccccattgctgggtatatacccaaaggaaaataaattgttttttcaaaaagacatgtgcacttgaatgttcattacagcactattgacaatagggaagacatggaatctacctagatgtatatcagtgttagactggataaagaaaacatggtacacatccaccataggatactatgcagccataaaaatgaacaaagtcatgtctttgcagcaacatggatgcagctaaaggccattatcctaagcaaattaacagaggaacagaaaaccaaatactacatgttctcacttataagtgggagctaaacattgagtttagtttacacatagacataaaaatggaaacaatagacactggtcactggggacttccagaagggggagcgtgggaagaggacaagggttgaaaaattacctgttggttactatgctcactactgggtgacacaaacatttgtactccaaacctcagtgacgcaattcatccatgtaacaaacctgcacatgtacccactgaacctaaaataaaaactgaaagaaaaaaatatatttttagctgtagctgaaaaaaaaaaaaggaaacagaaaaagaaaccgccatgctattcttcaaagtatttgtgtcatattacatgtccagcatcagagagtgagagttccagttctccagcacttggccttgttctctctaacttcagatattctacaggatgtgtagtagtatctcaatgtgctttcgtttccagttccttagttactaatgatgtttaaccatgttttcatgtgctattttatcctttgtgcattttagtttgtgaagtgtctttagcaatttttaccctttttaaaaaaaagtattgtttctttcttataattttttttttttcgttgagatggagtctcactctgtcacccacactggagtgcagtggtgcgatcccggctcactgcaacctccatctcccaggttcaagcaattcttgtgcctcagcctctccggtagctgggattacaggcatgcaccaccatgcccagctatttttttttttttttttttgtatttttaatagagacagggtgggtttcaccatgttggccacgctggtctcaaactcctgccctcaagtgatccacccgcattggcctcctaaagtcctgggattacaggtgtaagccactgtgcccagcctgtttcttataattggattttgaaaacttttttatatattatagatacatgtcttgtatcagtcatgaaattttaaatatattctccaagactgtgtattgtattttcattccctgaaaagtcttaatagaagaaaaaaattgctaattttgataaagtcaaaatttttaacttttctttttcatgaatcataattttgatgccatctataagaaatatttgcttggaacgcattcataaagaatttctcctctccttctagtaatttaagaattttcatttttatattttgggacaattgtcattttgagttaactttatatatgatgtgaggtatggatggaagtttatttttgttgacaaatggttatccacctgttcctgtgaagaagcattatcttatgtccattgaattcctttgtacctttgataaaaatcagtgaaatatatgagactatttatgtacagtccattctggtccattgaactgtcttcacaccaatgccatactgtcttgaatacactgtagcttcatggtaagtcttgaggtcagataggatatacagttcaaatttatttttacttttaattgttttggctattctaactctttaacattttcattcaaattaacctatgaatgttttcaaacaagcctactataatttcaaatgagtttctgttaaaattttgttgatcaatttcaggagtattaaaattttcctaatattgagtccttggattcataaacacagttcatctctccattgatttttgtctcttgtatttgtgtcagttaaatttttgtagtttttaatatataggtctttcacatttttcatggtttaagcactaataaaattatacttgtatattatagaaaatgatattttattttaattctgattattgtttttgaatataaaagtacaatggaattttatgggttttgtatcttgtgaccaaattaattagttctaggtctttatgtaaattataggattttacatgtatgataacatcattgtgatagttttacttcttcctctgtaatctgaatgccttttgtatttttcttgcatttattacacagactagagcttccattataacgatgaatagaagttgtaagagcagatgaccttgactttctgctaccattaaaggggaaatgtatagtttacgataaactatgatgtcagcaagaggtttctctgaaatgcccttttttagattgaggaacttccaaatgattcctagattgatgacagtatttatcagggatgaatttttggatttatcaaatgtttttttctgcatttattgaaattatcatagtatttcccttctgtgagtttgttaaatatgatgacatactaattctcaaaggttagaatactttcacttttctgattcactttgtcaggttatattaacacttgattttcttaaaaaaacaacttttgattcattgattcgatttattgtttttctattttttattttgttgataattcttatctttattaacattttctatttatcattggctttaaggaacttaacttttatatgacttgatgtagttttcttcatatttctagtacttgggctttgctgaacttcttggctctgttggttgatgttttttaataaaacatggaaacattcccatcattttttctcaaatatttttctgcctctcttattatccttctagacccaaattgtgcatgtatttgatcacttaaacatatcccataattcacataagctatttactacttttaagaccctttttaatccatattttacttatatagtttctattgttggactttaagttaattaatatagttttatgttttgcttggttttctgcagtttctaatcttttatttcatagattgtgtttttcagagctttcttttttatgtctggaagttaaatttgaacttttttatattttctatatttattaataccatcaatttttatatacctcgttgaatatataaatttgattgacaaaaataatttcaatgtctttgtctactgagtctatcatattatttctatgtgtgatttggtttattattctcccaattagtgatcagatttctatgctttctgaatgcctgattaattttgactagagtttatatactgtgaattttttacctttatcctgctagctcccatatatttgtgtattcacaaaaatgttattgagctttgttctaagacacagataaatttcttggaaatagtttgtttcctctaaggcttattctagtctttgtacacaggacccaataacctaacaatctgttgctaatttatttttgccactactgagtcaatatccttccaaataagaatagaaaatattatcccatttttattagcattggggattattttttctgctttttttgggtggtgctttctctggctttttttttatatatacactcatatgctgcttagtcttcaagtaaaatcttgacagagacatctggatctctctctctccctctttcttctagtgtgttttcctgcaaactctttgtgcctcctgaactaggaagattcctaggctccaactttattttatcttcctgtactgcagcgtcaaaccacattgcagttagtatgctgggggatcataagaccatttctttcctctttttcaggaaatctctcttgcaattcttaatatctaaagtctgaaaactaaaggtttattcttttattatttttccagaatatttgactctttcaagcagtagagtatatcccatatcccatccctgttattctaccttgccctgaaaaaaaaaatcactttttgacttgtaattttttttttttttttttgagacagagtctagctctgtcacccaggctggagtgcagtggcgtgatctcggctcactgcaacctccgcctcctgggtcaagtaactcttctgcctcagcctcctgagtagatgggactacaggcgcgtgccacaatgcccagctaatttttgtatttttagtggagacggggtttcaccatattggccaggctggtctcgaactcctgacctcatgatccacccaactcggcctcccaaagtgctgggattataggcgagagcctctgtgcccgggctttgacttgtaattttaaaaacaaaatgtagaggtatcagttgtttcagacgtgttgtattaatgaggaaagtaatagagtaaaactattgataatatttcatgcttactataccattgatgtacaatattccacatacagtgttataatttagtggattttttatatattactatttaaccaatgtcactggattcagaagtatttatgttaagatgtaaaggataaataaaatattttatgatttaaaaatatatcagaaatttaatcacctggtaaacatcaatataaagccaattgaaactaacaacatttttctttgaaaacataaaccaatgtgcacatgctgaaattgggagcaactttgttaaaattcatcaaagaaaatggaaagaagaaaagttcactttaattccactgg

SEQ ID NO: 939 - DNA, 19387 bp, Homo sapiens
ttttcctgtggatagcagaaaacatgaggtaaattgcacggtatctgcataaggagagataagtaaagacactggcatatgatcagtgagaagtgtcgggcctctgggcccaagccaagccattgcatcccctgtgacttgcacgtatacgcccagatggcctgaagtaactgaagaatcacaaaagaagtgaatatgccctgccccaccttaactgatgacattccaccacaaaagaagtgtaaatggccattccttgccttaactgatgacattaccttgtgaaagtccttttcctggctcatcctggctcagaaagcacccccactgagcaccttgcgacccccactcttgcccgccagagaacaaaccccctttgactgtaattttcctttacctacccaaatcctataaaacggccccacccttatcttcctttgctgactcttttcagactcagcccacctgcacccaggtgaaataaacagccatgtagctcacacaacgcctgtttggtggtctcttcacacggacgcacatgaaatttggtgccctgactcggatcgggggacctcccttgggagatcaatcccctgtcctcctgttctttgctccctgagaaagatccacctatgacttcaggtcctcagactgaccagcccaaggaacatctcaccaattttaaatcagcggccaggcgttcctccagaacctcctcccacaggaacttgctacacgtgctggaaatctggcaactggaccaaggaatgcccgcagcccgggattcctaagccgcatcccatctgtgtgggaccccacggaaaatcggactgttcaactcacctggcagccactcccagagcccctggaactctggcccaaggctctctgactccttcccagatcttctcggcctagcggttgaagactgacactgcccaatcacctcggaagccccctagaccatcacggacgccgagcttcaggtaactctcacagtggaaggtaagcccgtccccttcttaatcaatacagaggctacccactccacattacttccttttcaagggcctgtttcccttgcctccataactgttgtgggtattgacggccaggcttctaaacctcttaaaactgcccaattctgctgccaacttagacaatactcttttaagcactcctttttagttatccccacctgcccagttcccttattaggctgagacactttaactaaattatctgcttccctgactattcctggactacagctatatctcattgccgcccttcttccctatccaaagcctcctttgcatcctcctcttgtatccccccaccttaacccacaagtataagatacctctactccctccttggcgaccgatcatgcaccccttaccatctcattaaaacctaatcacccttaccccactcaacgccaatatcccatcccacagcacgctttaaaaagattaaagcctgttatcactcgcctgctacagcatggccttttaaagcctataaactctccttacaattcccccattttacctgtcctaaaaccagacaagccttacaagttagttcaggatctgcgccttatcaaccaaattgtttttcctatcccccccgtggtgccaaacccatatactctcctatcctcaatacctgcctctataacccattattctgttctggatctcaaacatgctttctttactattcctttgcacccttaatcccagcctctcttcgctttcacttggactgaccctgacacccattaagctcagcaaataacctaggctgtactgccgcaaggcttcacagacagcccccattacttcaatcaagcccaaatttcatcctcatctgttacctatctcggcataattctcataaaaacatacgtgctttccctgctgatcctgtccgactaatctcccaaacctcaatcctttacaaaacaacaactcctttccttcctaggcatagttagtgaggtcagaattcttacacaagagccaggaccgcaccctgtagcctttctgtgcaaacaacttgaccttactgttttagcctagccctcatgtctgtgtgcagcagctgccgctgctttaatacttttagaggccctcaaaatcacaaactatgctcaactcactctctgcagttctcataacttccaaaatctattttcttcctcatacctgatgcatatactttctgctccccggctccttcagctgtactcactctttgttgagtctcccacaattaccgttgttcctggcccagacttcaatccggcctgccacattgttcctgataccacacctgacccccatgactgtatctctctgatccacctgatattcaccccatttccccaaatttccttctttcctgttcctcaccctgatcacgcttgatttattgatggcggttccaccaggcctaatcgccacacaccaccagcaaaggcaggttatactatagtacaagccactagcccgcctcttagaacctctcatttcctttccattgtggaaatttatcctcaaggaaataacttctcagtgttccatctgctattctactactcctcagggataattcaggccccctccctttcccacacatcaagctcgaggatttgccccacccaggactggcaaattagctttactcaacatgccctgagtcagataactaaaatacctcttagtctaggtagatactttcactggataggtagaggcctttcctacagggtctgagaaggccaccgcagtcatttcttcccttctgtcagacataattcctcagtttagccttcccacctcaatacagtctgataacagaagggcctttattagtcaaaacagccaagcagtttttcaggctcttagtattcagtgaaacctttatatcccttatggtcctccgtcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccattggagctcctgtatagatgctcctttttattaggccccggtctcattccagacaccagaccaacttagactgtgcccctaaaaaacttgtcttccctgctatcttctgtctagtcatactcctattcaccgttcctaactactcatacatgccctgctcttgtttacactgctggtttacactgtttttccaagccatcacagctgatatctcctggtgctatccccaaactgccactcttaactcttgaagtaaataaataatctttgctggcaggactatgctgaatctccttaggcactctctaatcagatatcctgagtcgtcccaattcttaagactttttatacctgtttttctccttctgttattccatttagtttctcaattcatccaaaaccgtatctaggccatcagcaatcattctataggacaaatgtttcttctaacatccccacaatatcaccccttaccacaagacctcccctcagcttaatctctcccactctaggttcccacgctgcccctaatcccgcttgaagcagccctgagaaacatcgcccattctctctccataccacgccccaaaaatttttgccgccccaaaacctcaacactattttatttttcttattaatataagaaggcaggaatgtcaggcctctgagcccaagccaagccatcacatcccctgtgacttgcatgtatatgcccagatggcctgaagtaactaaagaatcacaaaagaagtgaatgtgacctgccccaccttaactgatgacattccaccacaaaagaagtgtaaatggccggtccttgcctcaagagatgacattaccttgggaaagtccttttcctggctcatcctggctcaaaaagcacccccactgagcaccttgcaacccccactcctgcccgccagagaacaaaccccctttgactgtaattttcctttacctacccaaatcctataaaacggccccacccctatctcccttcgctgactctttttggactcagcccacctgcacccaggtgaaataaacagccatgttgctcacacaaagcctgtttgctggtctcttcacagatacgcgcatgaaaggaagattaagaaaaacaaaaaaatgtaaatttactggacactgaatatatactaagtactgcttaagtgatttacatgtcaagattaaaatattttgctttactttaattatcatcatattcttcatccatctttcatttcatcttcatcatgccatttctttctccttcccctgggcctgaaattttatcaagaagacacacttgctgtgtgacttgattaatttacttaagcatggtaagcctttgtataatatggaattagaaaaaaaagtcttcttagaagtattttatgaaaacgacatgagagacagtatgtatatggtttgcatcacatgtctggcattatttaccattaattgttttattctcttaatttgagcaatttacttttgaaatgctatctggaaacggtgttaattttaagaaaggttgggcctctatgtaaaaatactgtaagaggtcacaacaacaaatatgtcttaaattctgatgatgtgttaaaaagcttgagaagcactcaataacaaaaacatactcactgacatacaggaaggtgaaatgaggtgtccatggctagacagctaataaatgtaagagacagattctgatctcagatgatttgatcagaaacttttaaccactatatgctgaattagcactaaaatataaatctaaaagttgtgttctttttaactcttactaggtactatttgttaagacattttaagaatacagtataaagatttttgccaactttttcatgcttaatgcttatgtaaattaatttcttaagtaagatagcatgcctataaaaatcctagggatagtgtattacccatgagatttctaagctatattttttaatgtagtaaatcaaagtgggtgtattccaatttcttacaactagaaaagctaatttcgataaaaatgaaatatttacatgaatcaactgcaaggtttttaaaatatattatttttaattaaaaataatcgctggcgagcaaaaaggttattttggctatattgttcgtatcttgaaagtacccataccgcattagtgtatatccaaagtaatttatattttgtcctaaattaatatggtgttggttgaattttctatgtagaaatatttttgttttaatagaaaatacaattttccattttggcagttacacaaatataaaatatatttacacttaactgtatagttcaaatgttattcaattattttatatttataattattgcaatataatttaaaaaaatagttaagagattttatttacttatttgtttacgtatttatttatttatttatttatgttttgagactgagtcttgctctgttgcccgggctagagtgcagtggtgcgatctcagctcactgcaacctctgcctcccaggtttaagtgattctcctgccttggccttccaagtagctggggttacaggtgtgcgccaccacacccagctgatttttttgtatttttagtaaagacggagtttcaccatgttggctaggctgttcttgatctcctgacctcaagtgatctgctggccttgatctcccagagttctgagattacaggcatgtgccaccgctcccggcctaagagaggttatttttttaaaaaaacagttttaagtttacatcaaaacggatgggaaggtaccgagacatcctatgaaccttctgcctccacacatgcatattctcccctattatcaacgtcccttactgaagtggtgcatgtgtaacaattggtgaacctacactgagacatcattatcaccccaaatccacagttcatacaagtcttcactcttgatgctttgcattcccgggctggacaattaataatgacatgtatccatcattatagtatcacacaggttactttcagggcactgaaaataacgctatcctctgcctattcatcaatctctctggaccaacccctgcaactattgatatttttactatcttcataatttttccttttctgaaatgtcatctagctggaataatacaatatgtacccttttcagattgacttcttttattctttcttgagatttaatttgctttacctttatcttcctaaggtggaagcttagataattgcttgagttcttcttgtattctaatgttaatgctatacattttactctaaacactgccttcactgaatctcacacatcttgagaactagtgcttttatgttgatttagctcacaatatttttaaaatttctactctttctccaacccatgtgttattttgaggtatgttgttaaatctccaaatattttgtaatttctcagctatttttctgttattgatttctagttcaagtccattgtggtcagacaccagacattatgtaatttttatgtttaaaatgtgtttaaggtgattctgaaggcccaaaatacagtctattttgttgaatgtttcatgtgagcttgagaaaaatatgtattctgctgttgttggatgaagtagtcagtagatgtccattatatctatttgattgatggtatggttaattttagctatgcacttacagattttctgcctactggatctgtccatttctgttggagtgttgaagtcaattatgatactgtatgcatttatttctcctcatatttctatgggttttgcctcacatatttttatactctgttgtcaggcacatacacattaaatattgttatgtctcatcgaatgagtccttcattattacatcatgctcctttttattcctgacaactttccttactctgaaatttgctgtgtctgaaattaatatagtgctaattctggtttctttttattggtatcaacatgatatatctttctcgatttatttagtttgaatctataagtgcctataagaaagtgcgttttctgtaggcaacacatagttgggctttgttttctgattctctcctgacaaagctggattaatatctactatatttgtttcagttttctaattgctgccattattttttgcttctatttttatttttcactctttttctgtcttttgtggtttaatagagcatttcttatggttcaatttcctctttctctctgttaattccagcatgcctgctatgtctgagtctggttctgatgcttgccctgtctcttggaattattattattttgtcttttgttatgtattgtaaattgttttcttgatagttggaaatgggctggttaaaaggaattgtaaataggcctttagtaatgcgacgatatggtgtactaggagaaagggggttttctttaatcctgttagtagctctagtcttttcgtgagcctgtgcctgagttgtgaacttcgaatctgcttctcaacttttttttttgctttgttttcccacccctttaggtgggacacaatggctagagtgagctgggtttcggcattttccacgtaaagaaaggaggggctggagttctgtgtttcccttccccaaggtcatgtaggctcagataaaaccccagcagtttaggctttctttaactggtttctcctgtaggtaaatcttgtaaagaaaagactgttctggaaaatttcaaaatggttcctttacccacccactgctgaaagcttgagggtaattttctctgatattcattatgagaacctggcagagctcctgaaggcaaaactcagaaacaaatgggggggggggtcccaaagactgtagcacaggagtttttaatctttcagactcttccataatgagcctccagcaatttgtcaagaacccttaagtttttcctattttgacactggttcctatggagattgctgctcttataagttgtgagaaatttaattgttttttacttttgatataaatacctctacatgagtaatacatctgtatatttgctgtatttcaaaataagtaagatgggtccatgggcactattcagttacatgctcaagcaattttttagggtgtaagtaataagtaccctttagtcaataacatgtatatattacttattttcatggtaaaatgactagatgatttgatattccttcctccctgtccctttttatagattaaatttagcacatattcaggataacaactagatgtcagatatttgattacacagaatctgtgaaataaaccaatagataagatcttatgcagcatgcaaacccatttttttgcagtattcactgcaaaatcttataaaatcctatttcaaggttataaaatttaatcaactaggcatttttaagccaaaatcttgtactttctacattttaagcatgtcgtaagaaaagaatatagactctggctgtttccattttgaaacatcttattttgatcatataaataagcaaaagattaccctgagccagattggttttctctcttatcattaaggcctccactcatttctgccacctgagtcttcttatacaattctgtaattatacacatattaacatcaattgagtaagtaaatggatagcatcattttaatttatatttttccaaagtgaacaaaacacatgttttacagaaattaatagttgtatgcagtttgattacaaaataatacagctgatatttcaagcagtttgtagctcgctagctcattaatttttgctcattaattacactttttctctctcaactctcttactctaatctactttctctctgcaccctcaatacacacataaaatgtaagtaatagcagagtctgacataaatcagtttaaattacagttttgccagtcactgtttttgacactacggataaattattcaataactctgaggctcattttccgcatctgtgaattagggataaaaacgcttatcttatattgttcctgtgagtatctaatgagggcatatctgtaagtgcatgttacctaggcttgcacagtattttctaaaaatgaactatatatataatcatagtttccagatcgttaaccttcattttaatggtgcagaatatttttgttcagttggtctacaatttatacacatatatttaaagctacacaaaaatatattaactaataaaaaaatggactataaaatctgaaaaaggaagacttaagaacggtgatgggttaataaatagctcaatgcagacttgttaagggatgactagctgaataggtgtgtcaacaatacaatcacacaatcgtcttcaaataatttttaaataaacatattactggcatttactaatacaaagaagggtttctatctataagataatttaataggatctttctgcacagattaagttgattaccataaataaactagaactgatgtattcaaggggcatggctgtttgaagaacagaaggtagccacatgaatgtgttctatttagtaattaacagtatgtaaaatgaaagaatacctaaaccaaaatggctccacttaatcaactgttttgttggtagattacctagacccagatcctctatcactatcttctcaggagtcctaagcatattaatgcactgctcttgagtttttagaatttgttcagagtgtttaaaactacatacatgtaacatctgttttatacaagatacttcaaaaaccaaagtgattactataatacattctattaaacctaaaccaacatgtgttcaaatgcagagaacaaaaaggaatgttttgtcagatgttgcatctgatggattgaaagagttctataaaatagctcctctatagcttgtgctttctgtatttttgagtctttaggaaagtttaatgctggggaatatctgtgatgtgtgtgtgtgcctaggcaattcaaccctttgtggtaacacagcattcctagctatcattctatcgtatgacaatttattaattatcataatttactggcagtaatatttttctttaattcctcttttcaaacttgtcagattcagtaagaaaaaccaatgtaatatgcaaatgtctccactctatcattccatgagttatgagtcctttcttaccaactatatcatttataaactaagtacatgaatactaccaagtaatatactatcttatcattaacattaatcaacttatgcaatactttttatatattgaaaaatgtctactagagtataaaaaaattgtaaaaaactcaaactctttttttcttcttattttgactgctgcctgatgtaaacaatcaaacttttcatatagatccctatttctatttctatgtactactattgtaacacgctttctcattatcttaatttatgtttataaaagtcaaaacatatttttgtcatgagtaagatggtcttttcatattatgcactgtgttaatcggaggggaagtagggcagggagaaaaggaaactatagtatataaaaaaactactaagtcccagaactgcaatacccagtagtgtagcaactaatctcttgaaactattgaacacttgaaatgtagccagtggaaatagtgaagtgcggaaggtgcagtatacacattggattttgaagacaatacaagaaacagacagacaatgaataatactggtatcttgtatttatcccattttgagatgataatatttttgatatattaagatatattatgattaattatacctgtttattttcacttattaattttgttttttaggagattaaaattacatttgtgattcatattttattcttattggagaggactgtgccagatacttcacactaacactttgagttatggaggaacatgatcccttctacctgtatcatgaagtttgagaatttgaaaattatagtcctacttgaattaattttatattactatataaaaataccaaaaacttagtaacttaaacaacatccatttatgatcttacatttctatatgttacaactccaggtttgattttactggattctctgctaaaggagtttcactcaaggtatagaggctctggagaagaatccactttgagcccctttgggttgggcccactgttttctgttacatggacccctaaatcttcaaagagaagttgaatactttctgtattttgagttacgattttttcctctgtctctgacctgtagaaccttatgtgaaagttcatgtgacttggtcaggtccatctaaataatctcccttttcattaactcatttacaaaattccttttgccaactgatttggctcaaaattagtaattgatgttatagaagcctgtgggtttagggaaaggggaaattcaccaagaacctaaatagctctgtctgctttgtcttttttccaaatgtaccatgtggtaaattgctaaaccttattgagacagtgttttctcagttgacaaactgagtgtaccaacacgctacatttctgtatcatggggttgataaggattttatatgtatatatgcagaaagagactatagaggcttgtatatatgtatatgtgcatatgtatatgaacacaaaattctacaaagtgcttataccaatataagtactatcgcttagaatgcacctttttagctacctttcagattcttgtccactaagcattgccaagtcttcaaaggtaattgctgcaattttggcaaaatctctaagactacttttctgttctcatgaaactctgtttaaataggaaaaacacaaaataggtaggcaaacttttttctttctttctttctttttccacaggaaacgacgaggctgaatcctgttggagtgatttgttcttcggactttgtatcttaaatgaaatcttctcccttagaggccacataaactgatggtacaatctgcaactctaagcaaattcataggttatactttttcttcttcatacttgacatttgaacctagcaagtttgaatagcctgtaatttgaaaactcccttgcacatctagcagatcaaggtagcttgttctgccttctggacaaatggtgcccttaagtcagcttagggagactgttccgatatcaagattctgtttgaatactatatactctcagctgcttatttattcatatatatatgacacgtttatcatggaagtatttcaaaactatctgaaaatgaatattgattattaaggcattcagttttaggaagaaaacatacataaatatatgatcttcattattttcctttctccatgcaatttcaatagatatttatcaagaactcaaaatatgcctagcactgcctaggtgttggaaacattagagaaattaaaacagataaattccttcctttagtagacttagtctaactaaataaatgatttttaaaagggcataataaatggtataagcaaaagaaaatgaaggtgaggggaatagggcatgccaagtagggagctgctattttaatgaggcctaggagaaaaccatttataaggtgacatttgagcagagacctaaagaaagtgagaaaacgtgatacatgtatgtacatggaaaaagaatataataagcaaaaaaaaaaaaaaaaatggaggccaagagggaatcttatgcattacacagattttgaactaaaagcaagaaggccataatggctaaaaataaatgaggattcattaaagagggtgaagaatatagagagttaggactattgctgtgatgtaaagtcattggagagatgacctgagagattagaaccctggggtaacttacatttcatttgctgttttattccaaagtgatattcattatctaaagaaaaaaatcaaatatacagaaatgataaaatacaaaacaatgctgacctttaagaaacattgacctataaatactaagatgttaaatatttgtttcttgtgatttgtatctttattgatgtgataattatgtatctataagtttgtgagtaaaatacataacaagcctggaatgtattttctttataattcacattaattttttgcactaaaattcaatctagtaaatttcctgttatagtcaattaattttgacaacacatattttaatgctccatggtattaacaacccattatgatttgcatttaagattatttagagtattcagtgtaataaataatgcaaatgtaggcaaaagcttttccatgtatacacacacactacacactatatttttaattatttcattcacatagattaaaataaacttttgtttaatgtaaaacaatattgatgctcccaactccctagttactttgtacaatttgcatgcctaccagcaatgatgaatatcctaattgccttaaacatatctatattatgtcaaatctttcatgcactttcagtgtctgacttctttagcactgaagttcatgctcagatttaaagggcctgtatgaataggtgaggcccacctgaatactctgcagataacctgatttggtaccttaattccatctttaaaatcctttctagcaacacctacattcatgattgatagactaactgagagaaggtatatacaccacggactgcgaattttggaggtcactttagaattctgtctaccacggatacatttgaatatatctgcacatttacatatagttgtcaccacattaaggaaaattaacatatagattaccccgaaaaatttcctcaaactattttataattccttaatcccaccccttcttgccctctttaccaccttcaattctaggaaactgcacctatgctttttgtcactatgattggtttgttgtgtctgagattttatataaatgtcaccatacactatgcactttttgtctgacttctttcaactagcatagtttgagattcctatatgttttatctatcaatagtatatttttatggctgagtcttattttattatatgactatattcaccttcatgacaatagacattaggttgtttccagtttggggcctgagaaataaagttgttttgaacattcatgtacaagtatttgtaaggacatatgcttttatttcttttgcataaatactaaaaaaaagagtggctgggctataagtgtgtttagcttttataaaacctaaataattcaaaaagcaaaaaatgaaaatctcatttaaaacaatgggcaaaggacataaacagacatttctcaaaagaatacctacatgcagccaacaaacatgaaaaaattctcaatatcactaattattagagaaatgcaaatcaaaactacaatgggataccatctcatatcagtcaaaatggctattgttaaaaaaataaaaaattacaggtgttggtgaggtttcagagaaaaggaaatgctttcacactgtcagtgggaatgtaaattagttcggccactgtggaaagcagttttgagatttctcaaataactaaaaaaacagaactactgttcaacccagcaaccccattgctgggtatatacccaaaggaaaataaattgttttttcaaaaagacatgtgcacttgaatgttcattacagcactattgacaatagggaagacatggaatctacctagatgtatatcagtgttagactggataaagaaaacatggtacacatccaccataggatactatgcagccataaaaatgaacaaagtcatgtctttgcagcaacatggatgcagctaaaggccattatcctaagcaaattaacagaggaacagaaaaccaaatactacatgttctcacttataagtgggagctaaacattgagtttagtttacacatagacataaaaatggaaacaatagacactggtcactggggacttccagaagggggagcgtgggaagaggacaagggttgaaaaattacctgttggttactatgctcactactgggtgacacaaacatttgtactccaaacctcagtgacgcaattcatccatgtaacaaacctgcacatgtacccactgaacctaaaataaaaactgaaagaaaaaaatatatttttagctgtagctgaaaaaaaaaaaaggaaacagaaaaagaaaccgccatgctattcttcaaagtatttgtgtcatattacatgtccagcatcagagagtgagagttccagttctccagcacttggccttgttctctctaacttcagatattctacaggatgtgtagtagtatctcaatgtgctttcgtttccagttccttagttactaatgatgtttaaccatgttttcatgtgctattttatcctttgtgcattttagtttgtgaagtgtctttagcaatttttaccctttttaaaaaaaagtattgtttctttcttataattttttttttttcgttgagatggagtctcactctgtcacccacactggagtgcagtggtgcgatcccggctcactgcaacctccatctcccaggttcaagcaattcttgtgcctcagcctctccggtagctgggattacaggcatgcaccaccatgcccagctatttttttttttttttttttgtatttttaatagagacagggtgggtttcaccatgttggccacgctggtctcaaactcctgccctcaagtgatccacccgcattggcctcctaaagtcctgggattacaggtgtaagccactgtgcccagcctgtttcttataattggattttgaaaacttttttatatattatagatacatgtcttgtatcagtcatgaaattttaaatatattctccaagactgtgtattgtattttcattccctgaaaagtcttaatagaagaaaaaaattgctaattttgataaagtcaaaatttttaacttttctttttcatgaatcataattttgatgccatctataagaaatatttgcttggaacgcattcataaagaatttctcctctccttctagtaatttaagaattttcatttttatattttgggacaattgtcattttgagttaactttatatatgatgtgaggtatggatggaagtttatttttgttgacaaatggttatccacctgttcctgtgaagaagcattatcttatgtccattgaattcctttgtacctttgataaaaatcagtgaaatatatgagactatttatgtacagtccattctggtccattgaactgtcttcacaccaatgccatactgtcttgaatacactgtagcttcatggtaagtcttgaggtcagataggatatacagttcaaatttatttttacttttaattgttttggctattctaactctttaacattttcattcaaattaacctatgaatgttttcaaacaagcctactataatttcaaatgagtttctgttaaaattttgttgatcaatttcaggagtattaaaattttcctaatattgagtccttggattcataaacacagttcatctctccattgatttttgtctcttgtatttgtgtcagttaaatttttgtagtttttaatatataggtctttcacatttttcatggtttaagcactaataaaattatacttgtatattatagaaaatgatattttattttaattctgattattgtttttgaatataaaagtacaatggaattttatgggttttgtatcttgtgaccaaattaattagttctaggtctttatgtaaattataggattttacatgtatgataacatcattgtgatagttttacttcttcctctgtaatctgaatgccttttgtatttttcttgcatttattacacagactagagcttccattataacgatgaatagaagttgtaagagcagatgaccttgactttctgctaccattaaaggggaaatgtatagtttacgataaactatgatgtcagcaagaggtttctctgaaatgcccttttttagattgaggaacttccaaatgattcctagattgatgacagtatttatcagggatgaatttttggatttatcaaatgtttttttctgcatttattgaaattatcatagtatttcccttctgtgagtttgttaaatatgatgacatactaattctcaaaggttagaatactttcacttttctgattcactttgtcaggttatattaacacttgattttcttaaaaaaacaacttttgattcattgattcgatttattgtttttctattttttattttgttgataattcttatctttattaacattttctatttatcattggctttaaggaacttaacttttatatgacttgatgtagttttcttcatatttctagtacttgggctttgctgaacttcttggctctgttggttgatgttttttaataaaacatggaaacattcccatcattttttctcaaatatttttctgcctctcttattatccttctagacccaaattgtgcatgtatttgatcacttaaacatatcccataattcacataagctatttactacttttaagaccctttttaatccatattttacttatatagtttctattgttggactttaagttaattaatatagttttatgttttgcttggttttctgcagtttctaatcttttatttcatagattgtgtttttcagagctttcttttttatgtctggaagttaaatttgaacttttttatattttctatatttattaataccatcaatttttatatacctcgttgaatatataaatttgattgacaaaaataatttcaatgtctttgtctactgagtctatcatattatttctatgtgtgatttggtttattattctcccaattagtgatcagatttctatgctttctgaatgcctgattaattttgactagagtttatatactgtgaattttttacctttatcctgctagctcccatatatttgtgtattcacaaaaatgttattgagctttgttctaagacacagataaatttcttggaaatagtttgtttcctctaaggcttattctagtctttgtacacaggacccaataacctaacaatctgttgctaatttatttttgccactactgagtcaatatccttccaaataagaatagaaaatattatcccatttttattagcattggggattattttttctgctttttttgggtggtgctttctctggctttttttttatatatacactcatatgctgcttagtcttcaagtaaaatcttgacagagacatctggatctctctctctccctctttcttctagtgtgttttcctgcaaactctttgtgcctcctgaactaggaagattcctaggctccaactttattttatcttcctgtactgcagcgtcaaaccacattgcagttagtatgctgggggatcataagaccatttctttcctctttttcaggaaatctctcttgcaattcttaatatctaaagtctgaaaactaaaggtttattcttttattatttttccagaatatttgactctttcaagcagtagagtatatcccatatcccatccctgttattctaccttgccctgaaaaaaaaaatcactttttgacttgtaattttttttttttttttttgagacagagtctagctctgtcacccaggctggagtgcagtggcgtgatctcggctcactgcaacctccgcctcctgggtcaagtaactcttctgcctcagcctcctgagtagatgggactacaggcgcgtgccacaatgcccagctaatttttgtatttttagtggagacggggtttcaccatattggccaggctggtctcgaactcctgacctcatgatccacccaactcggcctcccaaagtgctgggattataggcgagagcctctgtgcccgggctttgacttgtaattttaaaaacaaaatgtagaggtatcagttgtttcagacgtgttgtattaatgaggaaagtaatagagtaaaactattgataatatttcatgcttactataccattgatgtacaatattccacatacagtgttataatttagtggattttttatatattactatttaaccaatgtcactggattcagaagtatttatgttaagatgtaaaggataaataaaatattttatgatttaaaaatatatcagaaatttaatcacctggtaaacatcaatataaagccaattgaaactaacaacatttttctttgaaaacataaaccaatgtgcacatgctgaaattgggagcaactttgttaaaattcatcaaagaaaatggaaagaagaaaagttcactttaattccactgg

SEQ ID NO: 940 - DNA, 8455 bp, Homo sapiens
ttttcctgtggatagcagaaaacatgaggtaaattgcacggtatctgcataaggagagataagtaaagacactggcatatgatcagtgagaagtgtcgggcctctgggcccaagccaagccattgcatcccctgtgacttgcacgtatacgcccagatggcctgaagtaactgaagaatcacaaaagaagtgaatatgccctgccccaccttaactgatgacattccaccacaaaagaagtgtaaatggccattccttgccttaactgatgacattaccttgtgaaagtccttttcctggctcatcctggctcagaaagcacccccactgagcaccttgcgacccccactcttgcccgccagagaacaaaccccctttgactgtaattttcctttacctacccaaatcctataaaacggccccacccttatcttcctttgctgactcttttcagactcagcccacctgcacccaggtgaaataaacagccatgtagctcacacaacgcctgtttggtggtctcttcacacggacgcacatgaaatttggtgccctgactcggatcgggggacctcccttgggagatcaatcccctgtcctcctgttctttgctccctgagaaagatccacctatgacttcaggtcctcagactgaccagcccaaggaacatctcaccaattttaaatcagcggccaggcgttcctccagaacctcctcccacaggaacttgctacacgtgctggaaatctggcaactggaccaaggaatgcccgcagcccgggattcctaagccgcatcccatctgtgtgggaccccacggaaaatcggactgttcaactcacctggcagccactcccagagcccctggaactctggcccaaggctctctgactccttcccagatcttctcggcctagcggttgaagactgacactgcccaatcacctcggaagccccctagaccatcacggacgccgagcttcaggtaactctcacagtggaaggaaacgacgaggctgaatcctgttggagtgatttgttcttcggactttgtatcttaaatgaaatcttctcccttagaggccacataaactgatggtacaatctgcaactctaagcaaattcataggttatactttttcttcttcatacttgacatttgaacctagcaagtttgaatagcctgtaatttgaaaactcccttgcacatctagcagatcaaggtagcttgttctgccttctggacaaatggtgcccttaagtcagcttagggagactgttccgatatcaagattctgtttgaatactatatactctcagctgcttatttattcatatatatatgacacgtttatcatggaagtatttcaaaactatctgaaaatgaatattgattattaaggcattcagttttaggaagaaaacatacataaatatatgatcttcattattttcctttctccatgcaatttcaatagatatttatcaagaactcaaaatatgcctagcactgcctaggtgttggaaacattagagaaattaaaacagataaattccttcctttagtagacttagtctaactaaataaatgatttttaaaagggcataataaatggtataagcaaaagaaaatgaaggtgaggggaatagggcatgccaagtagggagctgctattttaatgaggcctaggagaaaaccatttataaggtgacatttgagcagagacctaaagaaagtgagaaaacgtgatacatgtatgtacatggaaaaagaatataataagcaaaaaaaaaaaaaaaaatggaggccaagagggaatcttatgcattacacagattttgaactaaaagcaagaaggccataatggctaaaaataaatgaggattcattaaagagggtgaagaatatagagagttaggactattgctgtgatgtaaagtcattggagagatgacctgagagattagaaccctggggtaacttacatttcatttgctgttttattccaaagtgatattcattatctaaagaaaaaaatcaaatatacagaaatgataaaatacaaaacaatgctgacctttaagaaacattgacctataaatactaagatgttaaatatttgtttcttgtgatttgtatctttattgatgtgataattatgtatctataagtttgtgagtaaaatacataacaagcctggaatgtattttctttataattcacattaattttttgcactaaaattcaatctagtaaatttcctgttatagtcaattaattttgacaacacatattttaatgctccatggtattaacaacccattatgatttgcatttaagattatttagagtattcagtgtaataaataatgcaaatgtaggcaaaagcttttccatgtatacacacacactacacactatatttttaattatttcattcacatagattaaaataaacttttgtttaatgtaaaacaatattgatgctcccaactccctagttactttgtacaatttgcatgcctaccagcaatgatgaatatcctaattgccttaaacatatctatattatgtcaaatctttcatgcactttcagtgtctgacttctttagcactgaagttcatgctcagatttaaagggcctgtatgaataggtgaggcccacctgaatactctgcagataacctgatttggtaccttaattccatctttaaaatcctttctagcaacacctacattcatgattgatagactaactgagagaaggtatatacaccacggactgcgaattttggaggtcactttagaattctgtctaccacggatacatttgaatatatctgcacatttacatatagttgtcaccacattaaggaaaattaacatatagattaccccgaaaaatttcctcaaactattttataattccttaatcccaccccttcttgccctctttaccaccttcaattctaggaaactgcacctatgctttttgtcactatgattggtttgttgtgtctgagattttatataaatgtcaccatacactatgcactttttgtctgacttctttcaactagcatagtttgagattcctatatgttttatctatcaatagtatatttttatggctgagtcttattttattatatgactatattcaccttcatgacaatagacattaggttgtttccagtttggggcctgagaaataaagttgttttgaacattcatgtacaagtatttgtaaggacatatgcttttatttcttttgcataaatactaaaaaaaagagtggctgggctataagtgtgtttagcttttataaaacctaaataattcaaaaagcaaaaaatgaaaatctcatttaaaacaatgggcaaaggacataaacagacatttctcaaaagaatacctacatgcagccaacaaacatgaaaaaattctcaatatcactaattattagagaaatgcaaatcaaaactacaatgggataccatctcatatcagtcaaaatggctattgttaaaaaaataaaaaattacaggtgttggtgaggtttcagagaaaaggaaatgctttcacactgtcagtgggaatgtaaattagttcggccactgtggaaagcagttttgagatttctcaaataactaaaaaaacagaactactgttcaacccagcaaccccattgctgggtatatacccaaaggaaaataaattgttttttcaaaaagacatgtgcacttgaatgttcattacagcactattgacaatagggaagacatggaatctacctagatgtatatcagtgttagactggataaagaaaacatggtacacatccaccataggatactatgcagccataaaaatgaacaaagtcatgtctttgcagcaacatggatgcagctaaaggccattatcctaagcaaattaacagaggaacagaaaaccaaatactacatgttctcacttataagtgggagctaaacattgagtttagtttacacatagacataaaaatggaaacaatagacactggtcactggggacttccagaagggggagcgtgggaagaggacaagggttgaaaaattacctgttggttactatgctcactactgggtgacacaaacatttgtactccaaacctcagtgacgcaattcatccatgtaacaaacctgcacatgtacccactgaacctaaaataaaaactgaaagaaaaaaatatatttttagctgtagctgaaaaaaaaaaaaggaaacagaaaaagaaaccgccatgctattcttcaaagtatttgtgtcatattacatgtccagcatcagagagtgagagttccagttctccagcacttggccttgttctctctaacttcagatattctacaggatgtgtagtagtatctcaatgtgctttcgtttccagttccttagttactaatgatgtttaaccatgttttcatgtgctattttatcctttgtgcattttagtttgtgaagtgtctttagcaatttttaccctttttaaaaaaaagtattgtttctttcttataattttttttttttcgttgagatggagtctcactctgtcacccacactggagtgcagtggtgcgatcccggctcactgcaacctccatctcccaggttcaagcaattcttgtgcctcagcctctccggtagctgggattacaggcatgcaccaccatgcccagctatttttttttttttttttttgtatttttaatagagacagggtgggtttcaccatgttggccacgctggtctcaaactcctgccctcaagtgatccacccgcattggcctcctaaagtcctgggattacaggtgtaagccactgtgcccagcctgtttcttataattggattttgaaaacttttttatatattatagatacatgtcttgtatcagtcatgaaattttaaatatattctccaagactgtgtattgtattttcattccctgaaaagtcttaatagaagaaaaaaattgctaattttgataaagtcaaaatttttaacttttctttttcatgaatcataattttgatgccatctataagaaatatttgcttggaacgcattcataaagaatttctcctctccttctagtaatttaagaattttcatttttatattttgggacaattgtcattttgagttaactttatatatgatgtgaggtatggatggaagtttatttttgttgacaaatggttatccacctgttcctgtgaagaagcattatcttatgtccattgaattcctttgtacctttgataaaaatcagtgaaatatatgagactatttatgtacagtccattctggtccattgaactgtcttcacaccaatgccatactgtcttgaatacactgtagcttcatggtaagtcttgaggtcagataggatatacagttcaaatttatttttacttttaattgttttggctattctaactctttaacattttcattcaaattaacctatgaatgttttcaaacaagcctactataatttcaaatgagtttctgttaaaattttgttgatcaatttcaggagtattaaaattttcctaatattgagtccttggattcataaacacagttcatctctccattgatttttgtctcttgtatttgtgtcagttaaatttttgtagtttttaatatataggtctttcacatttttcatggtttaagcactaataaaattatacttgtatattatagaaaatgatattttattttaattctgattattgtttttgaatataaaagtacaatggaattttatgggttttgtatcttgtgaccaaattaattagttctaggtctttatgtaaattataggattttacatgtatgataacatcattgtgatagttttacttcttcctctgtaatctgaatgccttttgtatttttcttgcatttattacacagactagagcttccattataacgatgaatagaagttgtaagagcagatgaccttgactttctgctaccattaaaggggaaatgtatagtttacgataaactatgatgtcagcaagaggtttctctgaaatgcccttttttagattgaggaacttccaaatgattcctagattgatgacagtatttatcagggatgaatttttggatttatcaaatgtttttttctgcatttattgaaattatcatagtatttcccttctgtgagtttgttaaatatgatgacatactaattctcaaaggttagaatactttcacttttctgattcactttgtcaggttatattaacacttgattttcttaaaaaaacaacttttgattcattgattcgatttattgtttttctattttttattttgttgataattcttatctttattaacattttctatttatcattggctttaaggaacttaacttttatatgacttgatgtagttttcttcatatttctagtacttgggctttgctgaacttcttggctctgttggttgatgttttttaataaaacatggaaacattcccatcattttttctcaaatatttttctgcctctcttattatccttctagacccaaattgtgcatgtatttgatcacttaaacatatcccataattcacataagctatttactacttttaagaccctttttaatccatattttacttatatagtttctattgttggactttaagttaattaatatagttttatgttttgcttggttttctgcagtttctaatcttttatttcatagattgtgtttttcagagctttcttttttatgtctggaagttaaatttgaacttttttatattttctatatttattaataccatcaatttttatatacctcgttgaatatataaatttgattgacaaaaataatttcaatgtctttgtctactgagtctatcatattatttctatgtgtgatttggtttattattctcccaattagtgatcagatttctatgctttctgaatgcctgattaattttgactagagtttatatactgtgaattttttacctttatcctgctagctcccatatatttgtgtattcacaaaaatgttattgagctttgttctaagacacagataaatttcttggaaatagtttgtttcctctaaggcttattctagtctttgtacacaggacccaataacctaacaatctgttgctaatttatttttgccactactgagtcaatatccttccaaataagaatagaaaatattatcccatttttattagcattggggattattttttctgctttttttgggtggtgctttctctggctttttttttatatatacactcatatgctgcttagtcttcaagtaaaatcttgacagagacatctggatctctctctctccctctttcttctagtgtgttttcctgcaaactctttgtgcctcctgaactaggaagattcctaggctccaactttattttatcttcctgtactgcagcgtcaaaccacattgcagttagtatgctgggggatcataagaccatttctttcctctttttcaggaaatctctcttgcaattcttaatatctaaagtctgaaaactaaaggtttattcttttattatttttccagaatatttgactctttcaagcagtagagtatatcccatatcccatccctgttattctaccttgccctgaaaaaaaaaatcactttttgacttgtaattttttttttttttttttgagacagagtctagctctgtcacccaggctggagtgcagtggcgtgatctcggctcactgcaacctccgcctcctgggtcaagtaactcttctgcctcagcctcctgagtagatgggactacaggcgcgtgccacaatgcccagctaatttttgtatttttagtggagacggggtttcaccatattggccaggctggtctcgaactcctgacctcatgatccacccaactcggcctcccaaagtgctgggattataggcgagagcctctgtgcccgggctttgacttgtaattttaaaaacaaaatgtagaggtatcagttgtttcagacgtgttgtattaatgaggaaagtaatagagtaaaactattgataatatttcatgcttactataccattgatgtacaatattccacatacagtgttataatttagtggattttttatatattactatttaaccaatgtcactggattcagaagtatttatgttaagatgtaaaggataaataaaatattttatgatttaaaaatatatcagaaatttaatcacctggtaaacatcaatataaagccaattgaaactaacaacatttttctttgaaaacataaaccaatgtgcacatgctgaaattgggagcaactttgttaaaattcatcaaagaaaatggaaagaagaaaagttcactttaattccactgg

SEQ ID NO: 941 - DNA, 12863 bp, Homo sapiens
ctaaaacctaaagtataaaaaaagttggagtgagaaaatactatctgcaagtttatgtagtaaaactctacaaagttaatcttaaaaaaaaaagctgcatcgtctatagggggatcctcgtttacattaacagcagcaagaaaaatggatgacaaccactttgaacctcagttttctcatttgtaaaaatgagaacaagaatacttatcacccataaagaattgtcattaaggtcaaataagcaaatgaatatggggccagaaaatatagctgacaaaatgtaagatactaagcagtggatggagctggaggccgttattctaaatgaagtaactcacttattatttgaaaaccaaatattgtatgttctcagttgtaagtgggaaccaagccatgggcatgcaaaggcatacagagtggtataatggacattggagactcaggagtgggtggggagaggagaaggagggataaaaaaactacatgttgggtacaatgtatactactcggggggctgttacactaacatctcagatttcaccactatgcaattcattcatgtaataaaaaaccacatgtaccctaaaagctattgaaataaaaaaaatcttaaaaaaaccaatatattaagtgatgtccataataggcaaatgatcaaatgtgtgccagttatactttgggggaataaagggaaacatgtttaattgcataggatttttaaatagctctatttttctaaaatgtatctttccttagtacccttcccctacaaaggggactatataaatttagaatcttctgtttaaagttccacaaaaatggtattttttcctctccagaaaaaaaatacagaaaagctgtttcaaaaccaaaatctccttattttcccagaatagaatgaggcaagtatttagtactttatatctgttattagatagtatatttttatttcactatttatataaaagctagaaagctcaggaaaaactgctgaagctatctatcatgaatgtaattttcttagtcaataaaacccagaagaaatagtaaactcaatatcctacaacaaatacatctagaaaataagttctttatcaaaatgcattcttgcttccttcaagtatggtctaaagtggtaaactattatcacaggagaaaacaactatttttgagccattaatgtctgacagttccagaatgcaacaattaaaaattgttaccaacttgtgacaattccattatatacatggctaaaaagttttcctgggagagtgtacaaaatatgttaccaaacctatcaaaagcaagccatgcaataaaaaatgactgaataataataataaaaaaaagacccacacacaaaagaagaaaaaaagagaagccctttcgaaatagggaaaacatttcataaattccttgaagacaagatttggctcttagaaagcatgcctaccatacaatcaacgctgtgcattgctattaccatcttttgcctcagtaacagctactgagctaaaagactactccagctaaaagaccacaggtaacctttgcagctgacctatgaaacaaagatttccaatttcagctgtcactttcatagagtagcacaattaaaacaacagaaacgcttaacatttaattttctgaacatcagatataatgctacaaatgggtgggaaatgcaaacttgggaaaacaaataaattaataaggacatgaatgactgtactcaataccaaatatattattctcattttacagaggaagaaactaaaatcgagagaggttaataattgtgcccgaggctacacagctactaagcaaaccagatctatgctcaaagcccatgcaggactgtaaccacggtactccacttccttcttagctttatactaagctatgccatttgccccagggctggcttaaaggccagccacattccctacacttcaccactaataacatttaggattacagttcctcttatgccctataaataaaacaagaacagatatttaacatctgcactaaagctgtggaataacatgctgttatacttgaaaggaatatatataaagcctgactgaaggtctgatgtaagcttctaaacaccaaagtatgatcataacctaatgggggttcttcctgaacttccctgaagcactgtgatcctctgagtcattctaaaacagtcttagagaataaatggctgcaagcatgaaagacaagctctatatactaaacaaaaagttgatctaatttaatggtgtcataattttaaaaattgtgttgattgcaaatttttttttttttttttttgagagacaaggtcttgctctgtctccttggctggagtgcactggtgtgatcatggctcactgcagcctcgacttcctgggctcaagtgatcctcctgcctcaacttcctgagtagctgggactacaggagtgcaacaccatgtccagatattttttgtagtttttgtagagacagggttacaccatgtttcccaggctggccttgagctcctggtctcaagtgatcctcctgcctcagcttcccaaagtcctgggactataggcatgagccactgcacttggtcacaaattctttttttttttttttttgagatggagtcttgctctgtcacccaggctggagtacagtggcacaatctaggctcactgcctcccgggttcaagtaattcttctgcctctgcctcccaaccagctgggactacaggcacaccccatcatgcccggggtaatttttgtatttttagtagagacggggtgtcaccatgttggccaggctggtcttgaactcctgacctcatgattcatctgcctcggcctcccaaagtgctgggattacaggcatgagctaccacgcccggccacaaattcatttttaaaaactcaccaattctttttaatttgggacagacgtttattatcaatatgaaacatgcccttttctaagtatttgttttctgaaaaaaaaatacatatttaaatatctggggcagaaattaatggaaaatttcaagatgcgacaatgtttagttcccaaaggcatttgttcaattgtttgataattgtaatgcaattcatttgccgtatgaaatgaaacagtttttgagtaagagttatctaagttgtaggagtaacaattatttctcagctctatcaacacagagatttcgcaaactggggccctgttgtccatcaaggcagccacacaccaccgcagcaccacagcagtctctgtggttggaccgcttctctcccattaggggcaacagaactgggactctggcatttcagaacagaataggatacaggtttctcccatcttcctgcaatagacttaaaataaaaagtccttaccaggaagttccagttagcatcaatttgagccaccatgccagagaggaacatgcccagaaagaggagcgaaaagaaaaacgctgtcacggacacaaacatgacccatccttgtagtagaggtagaggaacattggaggaggcaaccaaaatccagacaagacccccgaacagctgaaagagaaaaagagggtaattggtttgcttaaaagatacctttcacacaacagaattaaacatgcttgtattaccctcagcattgccttcattttcctcccagacccctgcacatattccagcaaccccatcccttcgattttccccttattatgtaagatgccttctttcctcaggtgcaagatcaatcctcctgcttggagaactgatccaactccacacctgtatcttcaggttggactcgcttcttcaacccatgtacatgtccagtattccttcatcattgacaaataccttcctttgactttactgattctctgactaccaccttttcaatgaaggtattttttcagtcaaccattttaacaaattcatctttgcttggtctccaattcctctccttgaagttgctcttcacatcactataaaccagcttttgatctcattgcttcttagagagttagtaaaaaaaatggatagaataatagttgcagctgttgtatatggcggtaaacaataaaaactaccatcatttattgagtattatgtgttcgacataggaataagtacttcacatatctatggatctaagtatcaataaatacctactacatttcaggcactatgccaggtgctgggaatcaaatggtaaacaggttacacttggtttctgtcaccacagaactcacagtctattagaggaaagagacaagtaagcaagcgattaaaaagctgcttcataaatgtcacaattgggcaaatactgggcactgcaggtccacacagcaagggctataaatccagatttgaaaatacttcctagaagcaacaatccaaagcacagggctatggggtaaagcagagggaggaaaggggggttccatggcaggagctgagagtagccccgcataggtgaagaacaaagctcagcaagacaggaggggcatgtgctggtggggaacggagagaactgtactggagactgagcgaggaggtgctgaagctcgggccaaggaactgaacttcacctaagggcgatgacaaagccaagatcatcttgagcagaaactagcatggtcaagatttgcctttagaaatttctctctggctagaatgtgagaatggactggggaggaaagggtggatggtgaggcagcacatctctgtgtttctcagctctatcaacacagagatttcacaaacattgggtaacacaggagactgttagaccaacagagtgtaagaatcagaacactgaggacagagagaaaggaatggattagagtgaaatttagaagtagacatgataatagttggtaactgatcagatgtgggacacaacagaaaaaggacagataaggaaaatacccagatttctggaatgggcctctaggcttgagagaacaccgcaggagaaatggtgtgaagatgagttttatgcatctatcaccattggtctcctccatactaccatgcctggcattccaagccatttgtgatctgacatgtctttttcatccttgtctcttgccactatgcccctcacattttgtattagggggagaaaaaaaatccacagttccaagacaaagatctttcacatcagagtggcctgttacttgcatgccgtgaatgtcattccctccctatgtgtacttgagattctcccactcacatctaatcttgagcacatcatttacaacatttttcctgagatccacccctgctcagttatgcctccctcctctgggcaacctccctactgggctttgttacatcagtgagatacactgtaattaaatccctttggctctccatctgcactaccaggccttcttggcagcatactgctttatatgtctctgcatcccaagccatttattaatctacacagtaatcctttcctaaccatcagtcaggtactatgctagatttggcagcacaaaaccttaggctacatacctgccctgaagacacctcaagcaagtgagaatcaatctctctctctctctctctgtctctctctctcacacacacacacacacacacacacacacacacacccagggagagtgatagagcacgctcttaaattatttgcttagtaaacaagctagtgctcatgtgagaacagttggagctccaaatattaaaaatcaatactcatctgtacattgcatttcagtatctagatatccaaattactccacaagtcactgaaagttaaaaacacaagttttaattcaagcttcaagaaaaggcccaatcatataatttgttactactttgaagaaacatttttgaaagcataaatgatcacttgatcaatgataatcaaatcaccagtctaaaaaaatgtatagttgtggtgtatacctcaactcctaaagtcaaataaaaaattaacaattgatccagaaagtgttatgaaataaatctaatgaatatcagtgcatcttaaacatttaaccaccaccttatcagtgcctataaaagaaaaaacttgttcctaatattatttacctttacatactattaaataaatatctgaaggcgatataagtatgtcttcagtggatcaatctttcctttttttccactttcttctttctggtagtcttttcttactctcccacaaagaataacctacataactttaaatacagtttaagaaatatacattaagtatctcttctgagttatttcctgagaacctatgtgcaaatataaaggataataaaaagcaattggccactgtttgttagggacaggcagagccaaatagataaacataatgagttagggatgatgatacattcacacctctaaagaggaggctatatgatcctttggaattcaacacagcatttactaaacccagactggacctcaaacaggccagccccgaacctactgctaggtactatagaagaacactcaagaaaaaacaaaaaaggcaaggttccatctccaggagcttgaaataaggaagaaatagacactattaaactgattcaggagcagattgcggtgggtgctataaaaagagctcaacacagtgtgttctgagaggctgggaggggagaggagagaagaaatataatgggaagaatctggaaaggtaggcaggggaggcaggcttcagagtaagctttcaagacagaccaaggctttgacagcagaggctatactgtaaaatagtatagactaaccgttcttatcgtactcaaaattacagcccttcaaacacctcaaaggcttggaagggaaactaaatgctgcatgaacaggagtcagattcacctcctcacttgtggggtatgtgctgcatggaaaggggagagggaaggagtgtaggaatgccccctctctctcactcaagtaaatacatatgatacatccctagagctgagattctgtgaaatccaggctcgctttggaagagagaggatgggccagagaacataattgagcccactttggagggccaccatcctcattttgagactgtcatactggtgtatggatcactctggccttgacacagttattattccctactttgtgatttccttttgacaaaagctacttttcttcttgagcttcccaacttggctccaacttaaacttggctccagtttttttaagttaaaaaactgaacttaaaaaattgagatgaccaatgctcagtatattcacttcctctaattccgggcattagtgagcttagagtgtttgcaaaacggtgtaattatcagcattcctgttcagtagagacgactctggaggtggccatatttttagaagtaaaaagcagaacacaaaaatggttaaatctgacagagaacagatgataaatacagtagcaactgcagagtacacactgtgaagaaaggtattcggaactattatatgtttcgcccacgttattctcatcgtcttggatctgaatccatattctgaccccttccctgccactgccttccactgctttctagtgttctaaaaaatccaataattatgtataaaatagccaaaggcacctcaatttgaaatttctttaagaaactaagtcagtgcttatgacgtcaaacctcaagctctaacaaaaagactacctttgcttccaggcaatacaaaggtaaaaacctcctaggagtaggtatcagcatctcccggtgactcagtcaccttttatcttcttaacccaactttaggtgtactgggtacataccagaagtactcaaatatattctgagttgcagttattaaattgctacacattcctaaaacaactgatcttctttctggtttaacacatgtttgttatgtttgcttggtctctgcagaccagaaaggtatgacttggctgaaaccctaccataagaaaaccacggaagtatttatccacaaatcacactaaactgaatcctcagggtttgatgtgaagacatgttttcactagaaactgtggaatgggaaaaatacatagtcccacgggaaaacatgctcttgagcaagtagcaactcttgcaattctgggtgcatgaattacagattcttaactcatctcctgtttggacggtcttatgttcccaaagggttccttttgcaaatgccctttttcttttcaaatgtcacttatttcctaattacctgcttttaaacataccctctgacagctaaaaattttttcaaaccaatttgacacctccatcttagtatacccacaaagtaaaccggctaatttctactgtgacctattttcaattaatgtttggaatgagaacaggaaaaggtaagtgaatttgaaaggataaaggctggctaaactacccataagggaaaacactatttagaactttccgtattaagctccctccttctaattctattatctatatattggataattcattattctactgcagtgagaatgaacacccagcaaacatagaggaaaagcaaaaaaatatttgtcttccagtctggcttgtagagttagagtaagaagttgaagctaatggtgatagcagaaatagtacttaacatttactgagctcttatgttataagcaccgttataagggttttatttgtgccaatttaatcctcacagaccttgagagacaacattattattcctactttataggtaagttaattgaggtacaaatccattcataacttgttcctagttatatagttaataagtgttagacctgaaatttgaacttggcaattggcttccagaacttatgattttaacattctgctattctgcccctctcatggtttagtgttcattctaaagcagggtttctacccatattccatatgatttcctaaaatcatataaaattgggtggacaagtacatatgcatttttctgaggacacagtccacacctttcatcagaatcacaaaggggtatgtggcccccccacccagaagttcagaacactttatctacttgtaaccccttctattttaatggatgtttacttatggggtgctgcacaggaaacatcatggttatagaagtgttcagtatattcagaaatttatcagctagaaaaaaaaagattatctacaattagctatattttacatacaattcgcattttgaaagatttccttaaactagaaacatacttagccaacacatacaatataactggtagatgtatttacaaagcagcccacacaagtatggattcattcacaatgcgactgtagatcactggtaccactacaaggcatactgctgcccccctccccaagctcatcatcttccctgtaatgcttcttttcctaccaccctctctttgcattccagcctctacccctcatcccctgagcatagagaaatgatcacacttgaccatgtttctgcctagcatgctgccagtaaaaattctgctgcataactaaactccagttaccatgttttccagaaagacttccctggccaggtgccatccctcggtgcttccacggttactgacgcgtgtattctccacagcaattacaactggatcaaaatcatggatctacatgcccatttcacccactagactgtgacgtcagagtcggtgacattgccttcaacatctccgtatgctcattacccagggtggtgctttctacagaaggtcctcaatccatcctccttgaaatgaatggaaaccaaccggcatgtgtaatgaatggttccaaaagagaatgctctaggagtgcagcttgggatgctaggaacacactccggtctggagcccagctcactccctggttcatggtggatgtccaaaaataggcatgaaaacgagtgaagcgagaatatgtacttctcaattctcaagttattattggtgacacccaccacctagtaccagatctcaggaggctgagatggaaagttatgggaaactttgtacctcttgccagttgaattcatgacacccaattttaaatcttttttcggccccaaatttgcccacatgacctatttctattgtaactgccactggaacttttgaccagggtaaatcttgtgccttcttccagtgcctcctgctcccctcatcagtccccatctgtcctctaaccatgctgacttctgtccaaactgcttctggactggccctggcatagacctgcattagagatgcaaggcagcaaggtgtttatttatttagttagttaggaaaacagaacaaattctgggatgtaatgagaaatgacatacacataagaggcttatgaccaaaatacgttaatactcattgcaaaagaagttctactttttagctttacatttgaaggctttaaaaatatgtctgagagtgctatagagagttatactttcttcctccccatgtgacctaaacctccaattcagctgcttaaatagctgacaccgaccctaaaatggaaagctcatattacagaggagaaatatgttctggttctttttattcttctttataataattcctctcgattttgaaaattcccttttcatgtttgcaggtaactagttatcacttttagtttaaagctgttcctgcgtgccaatgccctgatattggccagacccgtataaatcactgcctctttcctttctttttaccttcctccttctcatagctattatacagaagttgagattgttatatatgttgtctataaaaggatatggtactcttatataaaatagaacacttaggaaattcaagttaaagtgcagaaacctggagaagaattatggcagtttacatgttgggcaagatttaagagggcatctactcccaagctgcccttctccactccagccaatgtctccagactattttcacatactgctcagtttgtactatagaacaaacaagtagcatttgttaagtactgcatgtgcatgatactgggtatgccaacctggttcctgtcctttgtcattacagggtcatttctattcagccatatcactgcaaatacaccatgtccacagctcctaccaccacgtacaacatttctatcaggctctacaaaacaaatctcttctctatgactttttcctttggagctcaaggtgaatcttttcagctacttggtttaaagttttccatatttcagttcttcgtatttttttttaaaggactgccagtcggagcaaatgattgttgataataatctctggcaggggcattggtttattttcccttatgaaactttaaaggttatttatttattcatttattattttggggatgtagtttcgctcttatttcccaggctggagggtgatggtgcgatcttggctcactgcaactctgcctcccaggttcaagcaattctcctgccacggcctcccaagtagctgggattacagtcatgtgccaccacacctggctaattttgtatttttagtagagatgggggtttcaccatgttggtcaggctggtcttgaactcctgacctcaggtgatccacctgcttcagcctcccaaagtgctaggattacaggcatgagccactgcacccggcctaaagattcttttaatgtggatgaagatttttaatccagaggcaaaggaaaaaaaatacctacagttttaaaacccatttaggggacaactatgtccatggacagctccctcttgcacactgcaaataagcaatgtcccttcacagtcaacattttccaggcaataaactctatacatcagaacatatacatgttactagtccaaagtcaaagctctcagttgaaaataacctgaagtccctttcatagatttatctgcatgactgaacctgcctcccctaaagtccctccctcacaatcatcctttcattaacatttgtttttctggcataattcctctgagttacatcttatatttaagtttagtctaggtatcactttggggcaagtcaaactttacatacttaattgacttcccaaacctcaaacctctctctctccttctccatccttctttcattggttctatttcaggttcttttcatcccttatctaaactattgcaataagccccctaactgctcttcctgccttcagtccctttgttttacaaccaaacttcatcactcaaaggtttctaagacacaagctggatcaagtttctctctgtccttcacagctttccatcagacaataaatccaatgccttggcctagcatttctcagcaaaccagaacctgagtcctacctgctgtttttcctttttctgccacggcccaccaaaatctcacaactgacagaacgttcttgccattgtccttcttgtctctgtgtttgtacgtgtccttgtttctacctggaattctctttcccattttctaatgaaccatggctcattattgaaggctaacctcaaatgtccccacctcattaaagctgcctgttctgacctctccagaagtcagatgtactctatcctgctgttccacaatactttttataaacctatattagcacttcatacacagcatggtaattctttcttgactttatattccaccaaacagtaatttcttttaagggcaggagccatgttagttactctattttcagggcataaaagaaggcttgatgcatagtatgttcttaattataagctgagtaaatgaaaattactatggcatccaaaacactgcagttagaagcatgtgaataagaatcctagagtatctcccacaaagataaatgtgaatgaataacttggggaatataagtagtttcttaaacactaaaactgcaaaataaaac

SEQ ID NO: 942 - DNA, 12863 bp, Homo sapiens; identical to SEQ ID NO: 941

SEQ ID NO: 943 - DNA, 12863 bp, Homo sapiens; identical to SEQ ID NO: 941

SEQ ID NO: 944 - DNA, 12863 bp, Homo sapiens; identical to SEQ ID NO: 941

SEQ ID NO: 945 - DNA, 4663 bp, Homo sapiens
agagtgtgatgttccccttcttgtgtccatgtgatctcattgttcaattcccacctaagagtgagaatatgcggtgtttggttttttgttcttgcgatagtttactgagaatgatgatttccaatttcatccatatcgctacaaaggacatgaactcatcattttttatggctgcatagtattccatggtgtatatgtgccacattttcttaatccagtctatcgctgctataaagacacatgcacacgtatgtttattgtggcattattcacaatagcaaagacttggaaccaacccaaatgtccaacaatgagagactggattaagaattatgtattctggatactggacccttatcagatgtatttgcaaatgtttcccattgtgtaagtttttactttctttgcagtgtcctttgatgtaaaaatagtttaaacttttgatggagaccaatttatctgttttttctttgattgcttatgcttttagtgtcatacctgagaatccatgatcaaattcaaggtcattgggatttacccctatgttttctgagtttatctgatgacacttttgtggaataaaagtgctccgatgtgagaatatatacagtcatgtgcagtgggcttatggagtgcttgctccagaagcatgaaatcacactcaacttagcatctaaccaggagatagccccatgactgtggtcattgaccatatcacataattcatgatccaggatcaaccagcctgatagtgttggaatagcctgctaaaagcacatttgaagcaccagcacagaggcaatacccatgacagtggggtgccattttcctgaatgccacatgcacattgaatttgaatttgaaacttctatagagtattgtgttcccaaaaggaaaaactaatcggcctgggaaaagagagatgaaaacaggagtggcctcatttaccatcactcccagtgactcactatggattttgtgcttcccatccttacagtttggggttctgcttgattaccattctgatctccaaaggaggcttattcttatctggggcagagcaagggttttattgaactacaagctgtggctgctgttgaggcattttggagtctttaagcaccaagcgggcaggaaggagttgccctttttgcaggggtaatttatcctgataaaaaggtatgtagggctgttattacacaatagaaataggaatatgtatgaaactcaggtgatccacatgggcacctttgtggtaattccttgtccaattatgactgtggatggacaagtgcagtgacccccacctgaaaaagttactgttgtcttggtttcagacccttcaagaatgagtgtgtgggtcacaccaccagataattcacccagacctgcaaaggtaggtgatagctgctaagacaattcagaatggatggttggagagagagatgaataccagttgtggccccaagaccaactgcagtgatgtggctgagtttgacccactaacctttcttttttaaaagtcttaccctcaggatgagaggcccactgaggagtagctcccaggatatgcatggagaagtggattgatttggtacaaggggtgaaaagtggcagttatgaagtgtgctatttagatctccaaaagataaccatccacagggagtgcagttatctgacagcaccagttgcagataccctcaggatcttccttcagtgtccacaccaatgagctgaggccattcattctgggcagtccacaggcaatgactgcacatggtgttggtatcagggctcatcgtttccagctagtgtgagactcctcctctatgggcagtcttggtgttggagctcactgctaaattggttgagactttctcagaatgagcacagtctgaggctcttcctacctaatcttacttctcctttcatgtgagtcaaacctatatcaggggcagaaatattttttttcctgcttgtgctctctctcctctttatattttataggcattatctccaacaaacatctcgtactttgaactgcatcttggcttcttctttccaaaggacctcctctcccagacttgcatcatcatcactggtagatgataacttaggcttgaataaattaagtggctcacctcaggtcccacaaatgttaaatggactattttttcacaatacttattctcatactgaataatatccatgaaatcacgcaattgatgtgcaagttataattccctaattcacattgaaagtataactaactattaaatttaaaataaaaaacaagactaagtctggtcaacttagttatcccacactggaaaagtacataatatcacattttttttttgttgagaatttgtttgttctatgaaagcatatttggccaagagttaatttttgagatttagtcaatgtagtcattctgaagaaatggagtacctatcgtcttactgagaaaccaatttcaatgcttatggctgccagcctgtgttagacacatccatcaaaacagcaaaggagatagtccagttttatgccctccaagccaatattctattcctatggcctctaaaatggagtatgtgtacttaaagaaatatgcaagataatacacagagtgacaaaggaaatattttaactattttgtgaacataaaattaaacttttactaataggttggtgcaaaaggaattgcagcttttgccattacattcaatagcaaaaaccacaattacttttgaaccaaccaaatacttaaaataggcggacaccagttcatatattccacatgcataaactatgtatgctcaaaaatggagacaactgttaaaacctgctgtctaaaattaacaaaacacaagccttccattctagtggagaagaggacaaatataataaattaatgctatatgcatatacactatacataaagtatgtcctaagagctatggagaaaaatgtagaaaaggagaacagggagtgctagtgtgagattcaagattaaatgtggttctgaggtaggacctcactgtaaaggtgatgactaagcaaagacccaaagagggtgagaaagccagctctgtaggtaacttgagaaaaaagtgctccagagagaggaactaggattgtccttttgctaggggcacagcctaataaaagtataactaacgtccttttttgttacaaagctggacattcaaaacattaaacatattataaccaatttttgccagaggttgcaagtgttttttgtgaaaaatcagaccttggcgatgaccttgagcagtaggatataaataactcccacaagcttaatgttccaataatggaacactaggcatagataggttaaagatcattgctatccccatactctggacccctgcctgatgaatacattaagctgacacctgagacactgattcaccaattaacaaacttcaggcatgttgttaatgatagaaccttcatgacagtgatccagagttccagattctagagtattcagaggtggaaattcatagtccatgctcaagatcgaatggcatctctcagactggaagacctttctgaagtcagttccagacatccctggaaggctggataatttgggaaaaggctgactcaatgtaagcccaacttatacatggcactccaaggggatgcttcagccagaaagtaaagggctgaaaaagtagaacaatacaaaagccctcgtgtggtgggaactgtggcctcactcttacttgtccttccattcaaaacagtttggcacctttccatgacgaggatctctacaggactctgcctgagaaattttatacattcctccaaaggtaagtattctccaaaggtaagtatttgactattaacacaaaggcaatgtgattattgcataatgacactaaatattatgtggcttttctgttaggtttataagttttcaatgatcagttcaagaaaatgcagatcatatataactaaggttttacaccagtggttgacaaactatggcccacaggctaaacccagcctccccttgtttttataaataagttttattagaacataaccacactcattcatttctgtattgtgtatagctgctttcacgctatactagcagaactgaatagttgtgacagagactgtatggaccgtgaagcataaatatttaccatctggcccattctaaaaaaagtgtgccaattcctggtttacactaaaatatagagtttagtgggaagcctatttgaaatgtgttttttttaggggctgtaattaccaattaaaattaaggttcaggtgactcagcaaccaaacaaaagggatactaattttttatgaacaatatatttgtattttatggacataaaaggaaactttcagaaagaaaaggaggaaaataaagggggaaagggaaaaaggggagagatgtaaaataaaaggccatttctttaatatcataataaaattaacattccatccatgaaataaaccagaacttgagcttagagtctctctctactaaacacattacttttggaatgtttttgcatctggacaaaatggtatccaaattgatcagacatataaagtagacaagtgaaactaacatacgactgccagtttctaaggagtgttacggtcg

SEQ ID NO: 946 - DNA, 676 bp, Homo sapiens
aattcataatacaggtttaggtgtgtggtatggagctaggaaaaccaaagtagtaggatattatagaaaagatctgatgttaagtataaagtcatatgcctgatttcctcaaaccttttgtttttcctcatgtcttctgtctttatatttttatcacaaaccaagatctaacagggttctttctagaggattattagataagtaacacttgatcattaagcacggatcatgccactcattcatggttgttctatgttccatgaactctaatagcccaacttatacatggcactccaaggggatgcttcagccagaaagtaaagggctgaaaaagtagaacaatacaaaagccctcgtgtggtgggaactgtggcctcactcttacttgtccttccattcaaaacagtttggcacctttccatgacgaggatctctacaggtaggttaaaatacttttctgtgctattcagccagaaatagtttttgtgctggatatgattttaaaacagattttgtctgtcaccagtgcaaaaacattacagatgtctgggctaatacaaaaacacataagaatctacaactttatatttaatactctattcaaatttaactcaaagtaatgcaaaataattagaagtaaaaacttaattcttctgagagctctatttggaaaagc

SEQ ID NO: 947 - DNA, 676 bp, Homo sapiens; identical to SEQ ID NO: 946

SEQ ID NO: 948 - DNA, 676 bp, Homo sapiens; identical to SEQ ID NO: 946

SEQ ID NO: 949 - DNA, 676 bp, Homo sapiens; identical to SEQ ID NO: 946

SEQ ID NO: 950 - DNA, 676 bp, Homo sapiens; identical to SEQ ID NO: 946

SEQ ID NO: 951 - DNA, 676 bp, Homo sapiens; identical to SEQ ID NO: 946

SEQ ID NO: 952 - DNA, 676 bp, Homo sapiens; identical to SEQ ID NO: 946

SEQ ID NO: 953 - DNA, 676 bp, Homo sapiens; identical to SEQ ID NO: 946

SEQ ID NO: 954 - DNA, 676 bp, Homo sapiens; identical to SEQ ID NO: 946

SEQ ID NO: 955 - DNA, 676 bp, Homo sapiens; identical to SEQ ID NO: 946

SEQ ID NO: 956 - DNA, 1631 bp, Homo sapiens
ctttaaacttaaacctttatggtagtcccattcaaccacttgacagctccattaatctatttttactattaaacatgccattttacaagatatttattccacttggtcgtcatccaaacgctttttgacattactgccctgggagtgaactgcttaaactcgctgccctcataaacagaaaatcaccttttgactcaaatcttgaagagctctcagaacctcacccccttcacttctacaggcattaatttctgccatatataaaggagagaacaaacaaaaggccaccgcgaaacagttgaaggtagagacctactggctttgaagactatcaatcaggtggaaacctgaacaaatcacaatttggcttcctcatcaagttttctccccagcctgacaaaccctcctccgccgccgcctccacctcctcctccgcctcccaggctcagcacagctacgaggccaaagggaccgtcctgtgatgcctgctggtttccaactttccgctcatcttcgtctccgcagcctcctgcaaagcggctgggaaaagggcaagtttgcaaagccgaggatacaagtcctggggaagccacaaagaagctgcaacaccaacaaagattaacctcttgtggggcagacgaaaagcgccagctgccgttcaggggggcgaacgtgggctcgggctggcagaggctccggccagctggcagcggacagcagggccgggggtcccgcggccgccctcggccccccgccccgcgcggactccccctgcacctgagcgggggtgaggacagcgccgcgctccggccctgcccccgccaggtagctcggctgccgcccgcgctgcgcgcccgctgcctgcagccgccgggagcgacgagagcagaggcagcctcggcccacggcgtcatgcttcctgccaccacattacggcgaatcgtcaccgggagaggggagcgaggggagagggggagggaggggagcagacacacgcagccccccgcctgccaaaacgcgcggagacggggccacgtcccggtggagtccccgcgggacctgccccgtttgcacaaagcgccgcagtttggccaagaagggagggagacggccacgaaataaataaataaaaacagtcgggtctacgtaacgccctgtcgaaagcggacgccatatttttttgtggcttatgtcgacatagggaaacgtagacatgtttttcctcctcctcctcctcctcctcgctctggctcccatttatccaaacttgtaatcaaaactcttaaaaaaaaaatcttcttccctctctgtatccgctcatttcctcccacccgcaaaaagagcctgcacacccccccccttccgtaccccccttccaatcacaaacccggccaagtcccattaacaacacattttcgggagccgcggcggcgacggcggcggtgggaaagttgggctggagtggccggcgcccggcgtgcggggtttggggccggcggcgccggctggggggctccgcgccgaggcgaagtttcttacctgcgctggggctgtgaacgcggggacccgggctgggaacgcggagacgcggcacgggcgttccaaaatggaactctgctggctccccccac

SEQ ID NO: 957 - DNA, 15042 bp, Homo sapiens
ctctgccgttgctgctgtggctaggcccggaggctgcgccgtcagtcaagcgaaccgcagagtccgcgcccactgcctgcgtcataatccagcgtcataatccagcgctagagacgctccccatgtcgtcatcacccatggttgccatggtttccgcccacctcctcagcttactctagcttcgtgccaccccgtggcgcatgcgcttttcggtagccgcgctttccggcgttggagttgcagcttcaccctcgcagattcggcttagcgagcgagtcggtgcttccgcggatcaaaattattagccgttttattagagcccattaaacgttgcataaacatggttcagagctgcctgggagaagaaaagccaaaggatgccaccctctcgatttatcccaccctcgggagtctgaaagccgacgccaggagaaatcccgcgaaggccgcccgggatcctggtagaggcgacgctgtgtgcgtttatggagcgcttgcggtgcgtggcactaggctgggtgtggtgggtgctgccgaaaaaagggttcctcccatccatttgcacgtcacccttcccacctcctgcccagatggacagaagtgaggacattcatcggccgcattttactaatggcaaggagatagcgactgaagggcaagaacctagggtttcctgtctttgatatttctcatctttgagagaagccagtatttggagatgtttaccctgctgttttggaagttgtccactttacttgatattgggacatatcaagagaccactatatggtcttgagtgtaaactacagctcctgatgattggattcatttaccccaactaacatggtgactcttccttgcctgctggtctcctagcacaaggaccttgaaccgggaaacctcagcaagttaaagtttaaaggatctattattgtgtctcttgatgaaaaggttcctctcttgggaatcaggacttctaattcacaaagttgcggggatgagaagtccaaactccccacttgggtcactgggagtgagagtatgtggttatattaatttcctatcactgctatgacactacgaacttagtggtttcaaacaacacaaatttattttcttacagttctggaagcctaaaatcaagatatcaactggactgtttttcctgaagtcttcaagaaaaagtctgtttccttgcctttttcaatttctagaggctacctacatttcttggctcatggccccttactcatatcaccccatcctcctgcttaagtcattgcatctactaggcaaatctgcctctctcttgtaagaatctttatgattatattgggcctattggatagtccaggataatctctgtatcttgagatcattaacttagtcatatccacaaagtctcttttatcttgaaggtaaaatattcatagaatccaggattaggatctgaacatatttgggggccattattcagcctactacacagtaggaattctatttatatcctttcattcccaaacatgcatgttatgtatatatgagacacagcaccataaaatgagtgttgatttagagtatatactgtaccctggtggacaaggtcattccattttcacaggctattatcttcaagcttttgcttcagtttcaccttcaaaagggtttttcatcattccatcagacccgcattttctcggttatatagtatgtgataggactagtggatctcatggttatgtacctgctgatacacctcctttgctgtaaagtgcatccctaaatcaaaggcaatattacacaggatacatgttgatggatcaaatacctgtaaacctgtgagtagtagagctggccaacaacttataggcaaggaagtcaaactcatacatgcagatgggcagtttctagtcaaggagaatcactgcccattctaggatggaaggaatccaacataaatcaatttgctgcccaagtagctgtttggtatccttgagggttggtgctgtatcaggaacttggtgtttaacactggggagtggctattttgttgttgttgttgttgttgttttgttttgtttgagacggagtttcactggttgcccaggctggagtgccgtggcgccatctcggctcactgcaacctctgcctcctgggttcaagggattctcctgcctcagcctcgtgagtagctgggattacaggcatgcgccaccacggccagctaattttgtatttttagtagagacggggtttctccatgttggtcaggctggtctcaaactccagacctcaggtgatccgcccacctcagcctcccaaagtgctgggattacagacaggagccaccgcgcccagcctggggagtggctattggataagtggaggctatctattggcttcttgctcacttgcattcctgcaagatgactactttgtcataagccccctgtgccattcctgggggcggagggagggggcggtggagccgatggttgtagctgctgaagtttactggctaaatctgtctacttggttatttaatgctgcttacatgttggattgtctctggcagataaagattgtgttatacaatacaaaaagccctccttatgtgccatatctgatatatttctcctctgcttctccagacttcttgtccctgatataccagtcttattccagacccctgatcaactagccaacttatttgccatgaaaatatgttcttagttcaagacactttctttccacacacagttgatgaccaggaatactgccccacattatgccttttgggagggttctccttactgctgtcttttaaggccagtcctgtgtggggctgtagggcagtagcagtccatttttgttttgaacctatattccaagaaacctcagtgaattcagctcaggcttttttgtcctccataagctagacatgagagcctcccaagtggccataattgtgagctgaggaagggacattggtaaagaatcagatatgacatgggagcctgaccacctgcctttgcccagctcatgatgggcctctctggctacatggtcacttgatgtccataatcagttcttaccaaggcacattagcatggatagagttgtttttgggattttgcactgcagatggcccagccttgccacagaatgccaggagtcgaccttgtgattctcccattggagcttgccttcaactttcatggcttcttatcacatttactcttgtcccatagaatatcctgaattggtccatgcaacagggctaaatacaccatacctgctagagaacttttacatgctatggatcccactgaaaactggcagatttctatctcacccagtttacgagtcagaacagtactgccaacttctgaattcccacagaagcctacacagcttggtgtgcttccctggtggcagaataattttggtgaaatgagtgggtgagatgcaataatttgtcctttactgtgaaggggatatcttggcattcaagcagcctactgggccctaaaagtttcactgaggtaacagcttgctgggtcttaaggattatttcccatcctccagtgtacagtatgctagctgcttattattcaccttatccagctagcatgatgtcatcaatgtggtaggtcattgtgacattatgtgggatgtttagatggtctagatctcttcggattatgacgcagtgtggaagagttaacataaccctaagccaatactataaatgggtactgctgtcctatataaacacaaacttaattcttgtccagcactctcaggacccagttccatacacatgctcatggttcctgttggtacatgttggttagatcctgcatctctttggtcatataagcccatttggaattgaaagtagacacacagaatgagggcaaaacacctgcagaacagctgcttcatcatggtgggcttttttcatattaggttttgttacctttgagtttttaaattatgtgtaaagcttcgattaaaaaaataaaaattattaaaaagaaactgagacagtctatccacctatctctatttacccagtgctgttgttgtgttacataaaattcaattttagcttcatgttcatgcaatattttcgtttacccttgattcaaccttgacctttaaaaagccaaaaagacaaatacctattttgacactggttctgatctctctgaaattctgtgtgaccaatggtcaagtaaccttgcaggttatttatcatgtctaatctgaaaaaagtcattgtatttactaatattttaatattcaccttataggtaagcattctaaacatgattgtggcaagaaattcttatatgctttacatgttgaaattctgtgtcaaatgaagtacatatgtatattattgcaagagtgaatttcttcagtaatgattgtgacagctagtaaatttaagtagaaagtaattataaacttccaaatactttttttaaatgggcaaaatatatgaaacaatggccctgaaggcattggacataggcagtgaaggatagtaatccatgagagatggaatgcaaacaaggtgagcaatacaattgctccaacttgctgcctgaagaaaggctttggcatggggagagggaacccagaagactctgtgaggtgaggagatataagtgggagtcctgagagcccaaggcaactagagttcacagggtagaatactagagaggacagagtgacacagagagaactccagagatctgctgaccattctcctgaagtattaagctaaataatgattagtacatgcatgagaggaaataaccaaaggcttggcaaagaaccatcagaaaggattaaagaaaacaatactcaaagctcacacaggatggtgaatgattcctgatcccgtcagcaagagtggaaaagatcctaattcacaaggcaccagttagagtactaagaaaggtcttgcttcaatagcgggaaaaattaaccctcgactaaatgctctagaataacctaacaaagcttaaaagagagacccaaaaacattcaaactgtgtccaaataacttaatcatactccagaagaaagttcaaactgttttagggatatgaaaataatctacaaagtaaaattcacaatggctggcatccaatcaaaaattaccaggcatgcaacagaaaaatacaacccataataagaaaaataaaacattctgggctaggtgcagtggctcacacctgtaatcccagcactttgggaggccaaggtaggtggatgacctgaggtcaggagttcaagaccagcctggccaacatggcgaaaccccgtctctactaaaaatacaaaaattagcagggagtggtggtgctcacctgtagtcccagctattcaggaggctaaggcaggagaattgcttgaacccaggaggcagaggttgcagtgagattgtgccaatgcactccagcctgggcaacagagcaagactccatctcaaaacaaacaaaaaataaaacattctgtcaaaactgactcagaaattacagatgatgaagattattagacaaggacattaaaacagttattataattatattccatgtattcaagaaaccagaggaaagactgaagatattacagacaatgaaggtataaaaagacccgtatcaaacttctagagatgaaaactccaatgtctgagatgaaaaatatgttagatgagattaatggcagattagatattgcagaaagaaagatcagtgaacttgaagatgcagcagtagaacctccctgaaacagagagaaaaaagaataaaatgagacacacacctcctaccaaaataaatagagcatcagtaaagggtgggacaacttcaggcagccaaatgcatgtgtataattgcagtccttgaaggagaagagtggggagcaaaaaatggtggtggtctagtccaaagtaagtagaaaaaaaagaaatagagcagaaatcaaaaggtgggccgggcacggtggctcatggctgtaatcccagcactctgggaggcagaggagagtggatcacgaggtcaggagttcaagaccagcctagccaagatggtgaaaccccgtctctactaaaaatacaaaaaattagctgggcttgggggtgggtacctgtaattccagctactcgggaggctgaggcaggagaatcacttgaacccaggaagcggaggttgcagtgagctgagatcgcgccactgtactccagcctgggcgccagaacaagactccatctcaaaaagaaaaaaaagaaagaaagaaaaagtagaaatacaatagagaaaaatcaatgaaaccaaaagctaattctttgagaagctaagtttgataaagctctaggccgactgatcaggaaaagagaggacaaattatcagtatcagtaatgagaggtgataacactacagattttacagttgttaaaaggaacattttgaacactttgtatcagtatatttggcaaattagataaaacagaaaaattccttgaagatgcaaactactaaagctcagccaagaaatagataccctaaaaaactctttcagagaaactgaatttgtagttacaaatcttcccataaagaaaaaaatccaggtccaaatagcttcattggggatttctaacaaacattaaggaagtaataataattgtacataaacttttccagaaaatggaagaatgcatcccaactgagtcaactaattctatgagccagcatttttcccatgaacgtaaacgaaaaatttattgactatgaattatgtatacaaagccaactccttgtacaatcccatgtcaccacagttgttggaaatgagggtgggcagatgaaggaatattaggggttagtgtatgtgttgagtatatttttaaatgttttagaatactaggattttgataaactgaatttgcaagacatcacatatttaaccatgtcacatttttgcttagacccttcaatgacatcccattgctgctgggatggtgttcttaatatagcctacattgccccctgcctgatctgaccatcacttaactctgcagcctaattaacattccttcaccccttactctttcctctccatccaccctacccttcattttggcccctcaaattcctccacatggcacttgcacacactgtcagagcctggaaagctgttccccattttagccactcattaattcctactcaccattcagctcgcagctaagtcatcaaattctcagggaagactgccctgacctttctgaccaggccaacccgtcataggttccaattgcaccccgagaacctctcctcacagcatttactagaatgcaagttgttacatgaaatgttgtatgtggtgtgtgattattggataaatgcctatccctctcattagagtataaggtccatggagtctgggattgagtcttgttttgttggctattttactcccagtggttgccacagtgtctggcacatgattggggcccaaaaacatttatgaaagggcaagaagagacagaagggaaaagagacaaaacaacactccagcctgtggtctagtaactaagcttctgtgcttttatggctacagcctgagttagattcctgttcagggaacgaatcccattattgagtatctatcactttgattaaaaaaaaaaaaaaaagaccaaacgcagtccttggagtcatggataaattaatttcaaggctgaatgaagtttttatttcactggatggaagcattaaccgatgaaacacctgaaaaaaagaactgatttcaagatgccctgttttgggtggtatgagctctgtgagcattcccactcagtttttatttactcacttctattatatatgtctaatttatttggttaatctagtactcagaatatcaggtagaaatatttcttgcctgtaagttaaaaaaaaattcgcacagtgacttaaatagacttgggggtgggattgcaggttattttatttttttattttttcacatgacaagtgcagagatagacatttcagggctgtgtagctgatcaaagatccccttaagaaatcagtcctacaatgctgctctgccagtcttagcatgcttggagagatggctgctacatctccagggtcagagacccaaagccctccccggggacctctgcctgcagctccttgccagaactggttcacatggtcactatctgtgcaagagaggctgggaaatttagtacttgagttttccagcttctcctttttaagagaaaggggaattgggatggatactgtgagtcaattctgggccccagtgaaaaggttcttgggaacaacttggagaatctggagaagggcctataggaaacacacaatggtaactgtaagattcaaaagaaagtttcaatgagacaaatagcttatcttggagaagaggttaaggggccctcacttcctctgcctttacatagttgattctattcaaaattcagctctaggacaggcaccatggctcatgcctgtgatcccagcactttgggaggctgaggttagaggatcacttgagccctagagttcgagaccagcctgggcaacatagtgagaccctctatctataaaaaaaattaaaaattatgggtgggcacagtggctcacacctgtattcccagcactttgggaggctgaggtgggtggatctcttgaggtcaggagttcaagaccagcctggccaacatggtgaaaccctgtctccactaaaaacaaaaattggctaggcatggtggtgcacacctgtaatcccagctactcgggagggtgaggcaggagaatcacttgaacttgggggggtgggtgtgtgggaggttgctactcaggaggctggggcaggaggattgcagttcaggaggtcaaagctgcaagtaagtcttttgtttgtttgtttgtttgtttggtgggggacagagtctcactctgtcacccaggctacaatgcagtggtgtgatctccgcttactgcaacctccgcctcccgggttcaagcgattctcctgcctcagcctcctgagtagctgggattacaggtgtttgccaccatgtctcactaattttcgtatgttttttttttttgggggacggagtcttgctctgtcacccaggctggagtgcagtggtgtgatactggctcactgcaatctctgcctcctgggttcaagcgattctcttgccgcagcctcccgagtagctgggactacaggtgcccaccaccacccctggctaagttttgtatttttagtagagatggggtttcaccatcttggccaggctggtctggaactcctgaccttatgatccacccgcctcagcctcccaaagtgctgggattacaggcatgagccaccgcacctggccaatttttgtacttttattagagacaggatttcaccatgttggccaggctggtctcaaactgctgacctcaggtgtgatttgcccacctcagcctcccaaagtttacaggcgtgagctgggattacaggtgtgagccactgcacccagcctgcagtgaaccttgattgcgccactgcattccagcctgggcaacaaagcaagaccctaaaaataataaaatgcagctctggtgttccttcctgtaggaagtgtttccaagttctttgcttttttttttttaacagctttattgagatataattcacatactataaaattcacccttttagtatatatgttgctgaagcaagtagggaaattcaccctttaaaaatatacaattaaatggctggttcatatattatagagttgtgcaatcatcaccaccatctattttcagaacattttcatcttcccacaaaatcaacccagtacctattagcagtcattctccattctccactccccccagcacctgggaacttactttctgtttctatagatttgcctattctggccatttcatataaatgggaccatacaataaatgaccttttgcaactggattctttcactcagcataatgttttcaaggttcatccagaaaccatgtatcagtactgcattcctttttacagattccattgtatatatatgacattttgtttaaccactcatcagttgatggactttgggttgtttccacattttgtctatgaataatgctgctacaaatattcacgcacaagcctttgtgtggacatatgtttgcattctcttgggtatatatacctctatcacatatgtcttatttatttggttaattcactgctgggtaatatgctaaccctatgttcaacactttaaggaactgccacaactgtttcccaagtgaacagggttggatctttattttaaacattttaaatgcttgtaatcattttaaataatagttgagtttgaaaatgactacttttacagcttgtgcaatataaagtggctgtaccctgaggctgttcagagtgatatatattggattttgtcacatgtatgcccagggtaggagaaaatgaaatttaaattctatttgtttcttactatttttaatttctgttcgtgtatggtttttctgtttttgagacagagtcttgctctgttgcccaggctggagtgcagtggcacaatctcggcttactgcaacctccacttcctgagttcaagagattctcctgcctcagcctcccaagtagctggaattatagaagcccaccaccacacctggcttatttttgtatttctagtagagacagggttttgccatgttggacaggctagtctcaaactcctgacctcaggtgatccacctgccacagcctcccaaagtgctgggatcacaggcataagccaccgcacctggcctatttgtgtatttcaaaggcacatattgtactcatatattactgcactcatataattttttaaattacaaagttaataaagcagctcaagtttgagggagtttttaaaaattactattttttaaaaatcacaatatctctatcaggtggctgcattgactggcaactaatactgaagcttgcatgggaagcctttagagcttatacaaattgctggactgagatgacaaggaccccatgagcctcccgaacccttcagtcttttttcattggttccataagatgcctcttcccaaccagggcaatccagcaagtcctcaaagaaaactaaaatgtaaatgaacatgcttaagtagagaaaaagcttaagggaggcttctgttcttccatccacacattaactcctgctcattctttaacactcccttaggcatccctgctcctaccttcctagtcaccctgttcaatcctcaacccacatcctcaaatgagggtggctgcctctcctatgtgtgcccataaaaacccttatttctatctaagcactcagtaaacagcactgacattgttttctctgtatctgtgtcaccagatagtgatcccattgtgggcaggactcagttttattcatctctatgtcactggctccaagcacagcgcttaatggagagagtacacagtatctcctaattaatcagtgaatggcttttcaaaataatgacattctgcctcaagtaggccagacatacagcaacccctcacagccaaattggaaagtggtggttcatcatatacaaagactgactgatagaatgaagtgtgaaaggaaaataaaaagtcagaccccaaacttactatgccaaagggaaaagtgaagcctggaaactcagtcatgcaaaaaaactgcctttccttttgcctaaacacagccgcaagatagaagattccatatctcctcagttggcctcccttaccttgacaatgtaaacagcttatcttcacagatacagcacaaagtcaagactagaaaccatccctctgcccacctcagacatatgcatatttactgagtcctgacaaatgcttaattgactgttcctctaccccacttcacatgtaacatgtggattcagtgagcactaatcaaagcctcacaagaatgtgaccacttaactcactacctacactcctttttgtttttttcctctacccctactcctcctaccctcactttcccctttaaatactgaagccctcaaaatcctctttggaaaaatgtgtgggccacagatcctactgtgacttgtgtctttttcccatgtgtgtcctcaaccttggcaaaataagcctctaaactgattgagacctgtctcagatactttttattttacaaaagtattcaccactcagtgagtcacgatgatgacagcttaacatatattcatttaaacctaagaactaccctacaggatatgtacaattgttaaccctaatgtacagataaggaaactaaatcttgagagattcataacttgcctgaggtcacccagaaagtagaggagtcaggagttgaatgagtggaatctaaattctaagaggcatttgggaggccgaggcgggtggatcccttgatgtcaggagttcaagaccagcctggccaacatggtgaaaccctctctaccaaaaatacaaaaattagccgggcatggtggcagatgcctgtaatcccagctactcaggaggctgagacaggagaattgcttgaacctgggaggcggaggttgcagtgagctgagatcgctccactgcactccagcctgggcgacagagcgagactccatctccaaaaaataaaaacaaataaattatatgaaggcagagccatgtcagtcttacatcactgcacacacagggcccatatatatatgtatatatttatttatttatatatttatatatgaatatatatattatatatgaatatatatattatatatgaatatatattatatatgaatatatatatattatatatgatatatatattatatgaatatatatataatatatatatgagagagggagagtgcaagcatgcaggagtccaacaactgttggtcgaatgagttcaactggccacacctgacatcagctgtctatccagagcttgtggcaaaaaggcaaatcctcagtccccagactgactctctggctcctcttcctcattgtttctccttgttcccttcccatattggctcaacctccaggttggtatctttatagtttgaggacagcaagccatggacacacaagtgaggaaaaacccactatgtaaaagaggagatgactggctgggcatggtggctcatgcctgtaatctcagcactttgggaggatgaggcgggcagatcacaaggtcaggagattgagacaatcctggctaattcggtgaaacccgtctctactaaaaatacaaaaaattagccaggcgtggtgacacacacctgtagtcccagctacttgggaggctcaggcaggagaatcgcttgaacccaggaggcagaggtttcagtgagccgagattgtgccactgcactccagcctgggtgacagagtgagactctatctcaaacaaaaaaaaaaaaaaaaaggaggagatgattaaggtaacacaggaagaccgctctgtgagatgggaatggaaataagcaggctgtttgtttttgtggtgggatcacatgctggctaacatctccctaggggattactgtgtacaagacacagtgcttttttaatccttacaacaacccccatcttcaacacatctctcactgcttcctctgttccaaacttatctaataacaacataccattttctgaggattcaaacttttgcatctgttattctcttctactagtgcctgtttctacccgcaacctacccatcaaaatcttacccagttttcatgagccaattcaaacactacctctgaagacttcactattcagttctgagaactcctttcccaccttttcattcctacaacgtgctatcactcacatggcactcatcttactgcattccaagtctttctttgagtacttgtgttatttctgctgctagattgtgggtttctcagagacaggaactctatctaatggatcgttatgtttcctgtggcttttgtatataataggcacttaatatttgttggataacacaaacagcaccaacctgtccttactgctactgttgcaagagaaggatgagtagccatgcccaaatccagccagccaaatgtcaggtacaatcatacaaggccacacttttctatatttccttcacctagcaaaccagcctagatagcttcaaaatacaccagaacaaagctctgagtggtaatcaacaattagtcatcttgggtcatgcgtggtggctaacacctgtaatcccagcactttgggaggtcgaggtgggcagatcacttgaggtcaggagttccaaaacagcttggccaacatggtgaaaccccatctctactaaaaatacaaaaattacctgggcatggtgctgcacacctgtaatcccagctacttgagagtctgaggcttgagaatcgcttgagcctgggaggcagaggttgcagtgagccaagatggtgccactgcactccagcctgggtgacagagcaagactctgtctcaaaaaaacaaaaaagcaaacaaacaaaacaacaaacaattattcactccagtggcaaaccatcttttatggcagacagccataaaataaggtgaggctggaaatgctctgcagaatatctcacattccctatagcttcttaggttgtccctcctgttctcagccacggtaggaagatgaagagggagtatgaggcctatacgaatctaagattttaataggaactttaaactaataagtattaattggcagctattgcacaagcttgaggctagaaatctagattccctatgatttagaacagtgattcgtcctcagcagatgagctttaaaaaaaaaaatagactggtgattcttaaccatatttctaccacaacaaaccaaatttataagacaacccctcacaatcatttaggaatgccacagtaagggaat

SEQ ID NO: 958 - DNA, 1914 bp, Homo sapiens
ccggaggctgcgccgtcagtcaagcgaaccgcagagtccgcgcccactgcctgcgtcataatccagcgtcataatccagcgctagagacgctccccatgtcgtcatcacccatggttgccatggtttccgcccacctcctcagcttactctagcttcgtgccaccccgtggcgcatgcgcttttcggtagccgcgctttccggcgttggagttgcagcttcaccctcgcagattcggcttagcgagcgagtcggtgcttccgcggatcaaaattattagccgttttattagagcccattaaacgttgcataaacatggttcagagctgcctgggagaagaaaagccaaaggatgccaccctctcgatttatcccaccctcgggagtctgaaagccgacgccaggagaaatcccgcgaaggccgcccgggatcctggtagaggcgacgctgtgtgcgtttatggagcgcttgcggtgcgtggcactaggctgggtgtggtgggtgctgccgaaaaaagggttcctcccatccatttgcacgtcacccttcccacctcctgcccagatggacagaagtgaggacattcatcggccgcattttactaatggcaaggagatagcgactgaagggcaagaacctagggtttcctgtctttgatatttctcatctttgaggtaagtacacctggacagtcccttccttcctcctcagggctcatgctttcttgcctatccgtgtaattaatatgatctggctatctttgtctttgttccgaaacttcagctgcaaatgaaagtgtaagttaggtctgagtctgcactatagacctagctatcctaggttaaaggggataaaataggaatcaagaagcctggcccgcttgggctcccagctcaagtgcattctgcaatccagtttatattaggcctccatgtgggtggctatcctttatcaagatcccccccagggggaggaggattattagtcacattatcaaactcccctccaacccctttctctgcttagaggtatgtgtaatgtgtagtagaaagaccgaatccccacccaaaagtccttactgctactcatgtttttaaccttctgttctttaccctactccctaataatgaccgccatcatttatctactgcttaatggatactaggcactgtgctaagggttttatgttttacttcaatcttttcatcggctttattttgatagtttgttttatagaggaggaaacagacttaggtaagttacaagatgacaaggttactaccttgttcagttagtagtcagcagctagtatatccaaagatagtacgagtcagaactaggattataaactcagggctacctgaaactcacaacttcaggcatctttgatttcttcttttcacccacagccaattcttcaactaaattgtatccattctgttttcaccgtctcttgtactggtctcctttctattgtaactgtcatcatcctaactcaagatccttctgtagctttccccggttattggaatatccttattacgactgccaccttttctaatccagtctgtttactactgccgggttaatttccccaaactgcatgtctggggaataaccttgtggttatgacagaattcccaaaggaaagcaaacttggcaaggtgcaaagactatgaagacttagaacttaagagttctatggagatcttcagaaatataaattagctactcaacatatctgttattctgccctgattgcactgtaaagcaaaaggagagaggccattatggggaaaaagatccaaaaggactcatctaaaacacaagttgggtagaggagataggtgagtactattatattatgttcatggaaaatgagttcatgggctttcctctaatttttattttaaa

SEQ ID NO: 959 - DNA, 1914 bp, Homo sapiens; identical to SEQ ID NO: 958

SEQ ID NO: 960 - DNA, 3858 bp, Homo sapiens
ttaatatcagactctgtatggttcttagccctttctcatccctgcagctaaaggcatgtggtcctctgttcctataccaaacagtatcagttaagatggagatttcaggggccttgtttttacatactgttgaaatcaatcctgctttagctaagtctgttttgggcctaatttccagattcctaattcttgggattgttttctccagctgaggaattcttaaccaaacaagagacttgttttttcatttcctaatctgatgattcccttttctatcacctgtttttaagacttaattcctgcctctaaactccagctaagtgttgccttttgagcctaatccttatatctctggaagtcagtattttctacctgtcaggcctctgagcccaagctaagccatcatatcccctgtgacatgcacatacacatccagatggctggttcctgccttaagtgatgacattccaccacaaaagaagtgaaaatggcctgttcctgccttaactgatgacattgtcttgtgaaattccttctcctggctcaaaagctcccccactgagtaccttgtgacccccactcctgcccaccagagaacaacccccctttttcctttacctacccaaatcctataaaagggccacacccctatctcccttcgctgactctcttttcagactcagcctgcctgcacccaggtgattaaaaactttattgctcacacaaagcctgtttggtggtctcttcacagggacatgcatgaaatttggtgccgtgactcagatcgggggacctcctttgggagatcaatcccctgtcctcctgatctttactccatgagaaagatccacctacaacctcaagtcctcagactgaccagcccaagaaacatctcaccaatttcaaatccggaccctactgaaaatcagactgttcaactcacctggcagccactcccagagcccctggaactctggcccaaggctctctgactgactccttcccagatcttctcagcttagcagctgaagactgacactgcccaatcgcctcagaagcctacaggaccatcacagatgctctaggtaactctcacagtggaagactcagcccgcctgcacccaggtgaaataaacagccatgttgctcacacaaagcctgtttggtggtctcttcacacggatgtgcatgaaactacctacacccatacggaagggaacaaatcatgaaaagtaatggaatgctacagcctagtcagttttgagaaaaggctaaccaacaacaacaacaacaaatcatagtcatgctcagattgcacatgaacaaaaaaatgttggagagaaaccattgaaataactcaccggtcctcttgtgttgctgcttatctgattatctgaggtcaagggaactgaggacaacaaaggaaattaggtctttcatagttctcattaaatgctggaggagtctgactactgctgagctgagcacttcagcggctttggaaaaggaagtgtggttacttatttcaccaccttcattgtgctggaggaaataagaaatagctctgagactaataataacagaaacggcatccacagcagcagagcccagttgcacttcctaaaggcagtataaataattaagtgtctctataggcaagccactaggaataaacgaaaaagagctgcaattgctgatgtggtttcaccccagtcctgcccatgtttcttaacaggaaagggagttgcaatgccaataataaaatcttagagctggaaagaacatttatttgcctgtttattcattcatttactcagtcattattgggcacttacggtagactagtcgttatgttacctactaggagcttggatatcacccacttttatgtcttcattctttgagcgaagagctatctacatggtgagtccaaaagtgcacaagaggaaacctggcttgtccaaaccaagggctataacttagtttcctaactgcccagcaaaaatattttcagttaggctccactttaactcttaaaaatgtggcttgtgaattacttgatgaataattttactttcttgattatattaagcacaaaaaggaagagaaacacaattacaatattaaaattgtgaaaggcatctcaccaaggtgcttcttctgagaactccatgtctccattgcttatctgaaacctttattttgcttggcctctgggtcccactgcctctggatttacttctcacctgctgactgctccttcttttttactttttctgtgtgctctccatcttcctgacctctttaatttgaatgtcctgggactcagccctttggcttctctttgcaatcagtgcacacactctagatttacccatccaatgccacagccttaaataacatcaatattcttctgatggctctcaaagtaatatattttgctctgacgtccctctttaattctacatgtatatcagactgtctgtctatttggcagccccagtgtgatgttcctctagaatcactaccttaacatatgtgaaacaaactcttttcaccccacccctcaccaaaaaaatctattttttatatacgtatccattcaagaaaaggaaaccttctttcatttgctcgggtaaaacactctgagtaaccggttcctctaatttctctatttcccatattcagtccatgagcaaattttacaactgttaactttgaaataatacacacagcatccaatcacttatctaaactctgtcgctgccgctcgggtctaagcaccatcatgtctcacctggattattgtgacagtcttcttaatgggttttctgcatttcctttttgctccactgtagtctatgcttctcagagcagcctaagtcaatcctctgctcaaaatgctccaatgcacactgcactctatcaaagctctaactattgctaaaatgacccattgtctcctttattcctgctacctctcaagtcacatgccctatcccctatgcctcctccaactgtccctctgacgcagctatcgagtaccttgctgttcctcaaacacagtaagcacaccctatcttagggtgtttgcattatctatgcaaaaacactgcatggtgtgcttttttttgctatgcacccgcatggtttatcttcacagagatcttggctaacactagcaccttttcattctatggtcctttcctctgctttatttttctctttgcacctttcaccgtctgatccatactttttgattgttttcccctcaaggacataagcaccatgacaataggaatgtcactttatttatttatgtctccttctacgtaagtgcattggccccagaaatctagacctctaattataaagaggccatttttttttcctccagcttcaaaataattgcacttcaaaattgtaatactttgtgaacaaaggaaaaagatttaaaattatgggtctagggtcaaggcaatggtggaagataaaaaggaaagatgttacattccttgggggacaaggttggtcttgaagaagaaagaaaacaatgaggatgttgaatgaagtaaaaaacaatgttggccaggcgcggcgactcacgcctgtaatcccagcactttgggaggcaaaggcgggtggatcacaaggtcaggagtttgagaccagcctggccaacatagtgaaacctcgtctctactgaaaatacaaaaattagccgggcatggtggtgcacgcctatagtcccagctactctaggggctgagccaggagaatcgcttgaacccaggaggcggaggttgtggtgagctgagatcacgccacctcattccagcctgagcagccaaccgagac

SEQ ID NO: 961 - DNA, 1243 bp, Homo sapiens
ggggcaacccacccctacatctggtgcccaacgtggaggcttttctctagggtgaaggtacgctcgagcgtggtcattgaggacaagtcgacaagagatcccgaggacgtctacagtcagccttacgaagataatctcactttagacatttccaaattaaaagaacaaattttcgaagcatcaaaagcccatttaaatttggtgccaggaactgaggcaattgcaggagttgctgatggcctcgcaaatcttaaccctgtcacttgggttaagaccattggaagtactacgattataaatctcatattaatccttgtgtgcctgttttgtctgttgttagtctgcaggtgtacccaacagctccgaagagacagcgaccatcgagaacgggccatgatgacgatggcggttttgttgaaaagaaaagggggaaatgtggggaaaagcaagagagatcagattgttactgtgtctgtgtagaaagaagtagacataggcgactccattttgttatgtactaagaaaaattcttctgccttgagattctgttaatctataaccttacccccaaccccatgctctctgaaacatgtgctgtgtcaactcagagttaaatggattaagggcggtgcaagatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcctgacacctgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaactgccttagggctggaggtgggacctgcgggcagcaatactgctttgtaaagcattgagatgtttatgtgtatgcatatctaaaagcacagcacttaatcctttatattgtctatgatgcaaagacctttgttcacgtgtttgtctgctgaccctctccccacaattgtcttgtgaccctgacacatccgcctcttcgagaaacacccacagatgatcaataaatactaagggaa

SEQ ID NO: 962 - DNA, 1243 bp, Homo sapiens; identical to SEQ ID NO: 961

SEQ ID NO: 963 - DNA, 1243 bp, Homo sapiens; identical to SEQ ID NO: 961

SEQ ID NO: 964 - DNA, 5792 bp, Homo sapiens
gcccacctgagactcaaggactgggacacctgtccctcctcctccacccacgctgcggggaactgcatggctcctccgggcggggaccatagctttccgcctcaacgtacctggggctcggcatgctgcgttgaattttggagtggatgaggagtgagggtgtggcagggcggctggagctgcccaactgctgaaactgctgcaggtgccacagcggctggctccctgaaagcgtcctcctgcctctgagaccgtagcgcaggagggtgcgagtgcacctccgcaaggcctgacgctgctgatccacttcctctccccacgatggggacacacttggcgacagttccatctggggtaaaagacccaccaaaaggtcgctggcatgggcactccagggacaccaaagtggagtctgggagacccctcggcttgtgcggggagcattcctccccgaaatgctcgtccacttctggttacagcaatctttgagggcagggagggtggccagcagggggcattgtggagcaagcacgtgggcctcggatccaagcctgggttcaaatccgggctgtgggacgtcctcaccaagtctcgatttcctcccgtaaatgagggatgctggcgcccctctcgctgtgggggaatagggcttccagcactgctcccagcagatctcagacctcaggacgtgaaggttattttagggacaagctaaccatgaagtctatttagtgtaacagcaagagctgctaaaaacgtgcacagacattccttgtacagcctgagtatcccttatccaaaatgcttgggaccagaagtgttttggcggccgggaacagtggctcacgcctgtaatcccagcactttgggaggccgaggcgggcggatcacgaggtcaggggatcgagaccatcctggctaacacggtgaagacccgtgtctactaaaaaaaaaaaaaaaaaattagctgggcgcggtggcgggcgcctgtagtcccagctactctggaggctgaggcagtagaatggcgtgaacccgggaggcggagcttgcagtgagtcaagatcgtgccactgcactccagcctgggcgacagagcgagactctgtctcaaaaaaaaaagctttggctttttttggggaatatttgtaccatagttagcaggtgagcctcccaaattcccacatccgaaatctgaagtgttccagtgagtatttccttttgtgcggcatgtcagctgctcaaaagttttgaattgggggtgtttggatttgggatacttagcccgtagtgctgaggagaaaatttctgtctcttctatttttcctacacttcccaaatttctttaaagagtatgaataaatgctattgggtaaaaagaaatctgtttaaaacctgtgatctttaaagacttgaccagggtatcccacgcttgaggcactgcctaggcccagtgagccaagcccagcccgagtcggcagcgcggccccgcccccgcaagccccgccccatgccgagggcatttccgggcgctctaggcagctcggaggacccgttcggaagactggcgggggaccccaggcgaacccaagggtggcgggctgtgaactagcacggggctacgttgtagagagagagatggggcgtcacggaggcagggggtgccaggcagggcgcggctgccagaggcccagaggccgagctgggccctgcaggtctgaggtgcaggacccgattctggcccaagcaggggcgtcccacggctcgagctgcccgtccaggtggtgtctgaggagagcctgggcagcggccttgcagagggcaggccagcagctcctgctttgagggcttggaggagaacagattcccgaaccaggcccatgatcaatgtatttgggtatttgaactaaatccagatttcctggcttcccctgaggcctgctgaatcccttggggtggggcctgggaatctgcgttttccagtgggcctctcaggtagttgggtggtccctgagtgggttcccatgaccccatgaaacaagaccctagaaaacgcaaggcaaagcggcctggtgagtggccaatggtctacaggaactggatgtgatcagagcgagacctgcatcaactgggcaggggaggcgtggagccatacctgaggaagagacccagccggaacccagggaagagcaggctgtgaaaactgggcagaaacttgcggcgactcggaagacactgccaggaaaccctccccgggcctcctgtggggcttgtagcagccgcaggggttggctctcaccttctagtcccagccaggttgtcttggagtcagctaatgggcaaggcccctacctctcttaggatctgaggatgggaggggctgcgtttttccagaggatctgcacgtgtgcaggctgagtgttgagacttgattggtgtcaactggcactgcctgcccatgatgcacaaaagctactgtaagaaacagggtccatgtctccagggagcaggaccccgttctgaggccacaaccccgagggcagtctccgcctgcagagtcctccctctcgcaccggctcacctcgtggtgaatcccttggctacggtttggtgtgagaaaagagatgggtgtttcactccctgctgcatccctggtgacggccctggcatttcggggcatgagatctttgcttaaaggttttgcggtggtcactgcacagggggtgggggtggggtcccttggtgcaatttatccgattctgctgcgtggatgacatccacagtgttcctctccagtggggattatctgagacctttccgcatgcccgcacccacagtccgctccctcacggcagcatgaactcaggaggcgggcgttcccacagtcattacatttgcagggcctctctatgtccactctgatgcctgaggaccagcgcttccacgaaggtgtggccacgtccagtgctgctcattggcttctctcctgcgggaatgttctgatcccgaacggagcctgagcatgcgcgaaacccttcccacgttcacaaggtgcttctccagtgttccattacatctcacctatgcacactacatgcatacggtttccaccggctgtgcgtgtccctagaagtcacattcacggcgtttctccctgggaggaattctcccgtgcatggctgctctgagaccatttgcacctgcggccacgcgtgggctcctcgaggcttacaaaccaggctggactcctgaagccctagctgcacttggcactcggcgaggtttttctacaaaatctcatctcagccatctgagtccttcaccatttatcttatgaatccgctcgaacgtacaaggaaggcctctctgccctcctgctccagggaggaggttttgaccctcagctccacctctgcggctggcccggtctccgcaaacctttttctgcttggccagctggtgccatgctaggctttcccactaggggcgccagagaaagcgcgcgaggctgcggaggagagaggggcacactctttccggtttgcttccggttttttcctcaggcttccggtctgtttggtgccctggtcgcgtgtcttccgaactctgctgcttcgccccggcaagagcacttccttccgcggctgctaaaactggtgcgcgggttcccaacttcgcagaagagcttcatcggccccccgctagagacctcagaccgcagccatcgacgcctcgcctcggggatctgtccccaccctcggggccaggtcagggaccagagacctgcgaagccctctccttaggggtttagttcccaggctttctgaccccagtaattccaaacgcttccctttgtttccacagccctagcgtagcaggtgctccctgcagtttttgcttctgagatagagttctcttttcagctccttcggtagtcacttcgtacatagtgattcatgatgcgaaatcctctctgttgaaataactgacgaggcctctgtcttctgactggaccctgacttccatgccctttccactctcactccagtacatgcccaaaccccaatctttgttgctccaggcattgcctctgtggcgctgtgtcccctcctttgaactctgatccttctgctcaggccctttctcccagtctgaactcaccatgagtcaggccctgtgctaggtgctgggatgaagcagtgactgacacaggcctggacctgtccttgggaagagtgcgtctgtgacacagatactgtgccatgtggcaaaacttgaatggagacatcagctctttgtgggtctcaagtctactggctttcaatcagctcttctgcttgacagctgcaggtcttgggactgcccagcccccataaccctgtgagtgcattcctgataataaccctctttctcttgtcctcccccaccccacatcattggttctgtttctctggagaaccataatacatcatttactaatcaggaaatagattcagagacattaataactcatccaacctcacagttaactgtagagttgggcttgaaattccaaggtcgattttcttagccaatacaccatgctacatatatgtatgtaaaaataaaaacgcttgtgaactgaaaagggtccaaacttaagctcattttggtccttaattgctaatccataggcatgttttggtccttaattgctaatccataagcatgtttcggtccttatttgctaatccataggcctgcacacctgcccccaaggccatggttaggtcagcacttggccctccccttgtctggggctgccagaagctgcctcagaagacctctccctgcagctccagtgctttagggttcagcgcccctccagggcctttatttccttctgggctcaaaagcagatactgtgccagatacagatgatcactttctgggttccagaactcacatgcaccccttttcctggtctctcacatttgctgtgaccaacccaagcctcaggtggtcctctgctgagactgtccactcacgctgttgacagagcccttccaggagctctttttgtggggatttgctatgtacctggcactgtgcaaagaaccccacccatgccgtccttgcagccgccatgtgcggtgcggagcgggctgcgctaaccaccattgtcagaggcagaaacaggctccgtgaggaaggataagtgtgggttatggaatcagggctggcagatcccaaaccttggctcccagataccatgggatctttaggaagatccctggtcacttcggggaggagagagagggcgaaggctgagaatcggggtcctgggtcggaggagggagaggggtggtggtgtgggcttggaggtggtgtgggttggagattggccgttgagctggagatgcgtgaccaagaggccgagcacagctcagggtcgcaggcgtcccgggagggctcaggaatatcacgtccggttcaactgcacgctgataaacccggcagccaccacaaggtagaaaaatgcccttaaaagtccacgcctgggtcctgccgggccgctctggggttcccgagaaatgttgagtggatcagatggcacgttcgagaatcagccccgtgcccgcgggcttggagaaggcactgaggacactgggaaagacgtaaatgccatttcagcgcatctcgcgggccctgcccaacgagggaggacacagagaccttgcagagagtttaggacccggcgcggaggaacagccctgcctggcccaggacccgccgcaccccacttccttctc

SEQ ID NO: 965 - DNA, 1126 bp, Homo sapiens
tccggttttttcctcaggcttccggtctgtttggtgccctggtcgcgtgtcttccgaactctgctgcttcgccccggcaagagcacttccttccgcggctgctaaaactggtgcgcgggttcccaacttcgcagaagagcttcatcggccccccgctagagacctcagaccgcagccatcgacgcctcgcctcggggatctgtccccaccctcggggccagccctagcgtagcaggtgctccctgcagtttttgcttctgagatagagttctcttttcagctccttcggtagtcacttcgtacatagtgattcatgatgcgaaatcctctctgttgaaataactgacgaggcctctgtcttctgactggaccctgacttccatgccctttccactctcactccagtacatgcccaaaccccaatctttgttgctccaggcattgcctctgtggcgctgtgtcccctcctttgaactctgatccttctgctcaggccctttctcccagtctgaagtaactcaccatgagtcaggccctgtgctaggtgctgggatgaagcagtgactgacacaggcctggacctgtccttgggaagagtgcgtctgtgacacagatactgtgccatgtggcaaaacttgaatggagacatcagctctttgtgggtctcaagtctactggctttcaatcagctcttctgcttgacagctgcaggtcttgggactgcccagcccccataaccctgtgagtgcattcctgataataaccctctttctcttgtcctcccccaccccacatcattggttctgtttctctggagaaccataatacatcatttactaatcaggaaatagattcagagacattaataactcatccaacctcacagttaactgtagagttgggcttgaaattccaaggtcgattttcttagccaatacaccatgctacatatatgtatgtaaaaataaaaacgcttgtgaactgaaaagggtccaaacttaagctcattttggtccttaattgctaatccataggcatgttttggtccttaattgctaatccataagcatgtttcggtccttatttgctaatccataggcctgcacacctgcccccaaggccatgg

SEQ ID NO: 966 - DNA, 621 bp, Homo sapiens
cacggcccacccacccgactcagtccatccacccgactcacggcccacccacccgactcagtccatccacccgactcacggcctacccacccgactcacggcccgtgcccacatttccatgattgtctcaaaagtgacttcgcactcggtttgctcctaccagggtcacacacagccccctcggcctttctgcgtgcccgtcttcccacagaaacgtcgccgtctggtggcatctccagccggatctggctcagggcttcctctcggtgtgttcaaccttctcctcatccccctatttcttgtaaactcgtttctgattccaacattacatatgcatctgttggctggaattttttttttgagacggagtttcactcttactgcccaggctggagtgcaatggcgcaaccttggctcaccacaacctccacctcccggattcaaacgattctcctgcctcagcctcccgagtagctgggatttcaggcgtgagccaccacgcctggcctggctgcaattcttaaagaaaaacaggcaaaagcaaaaataattggctaacctgaaacacggcagtgtcccgacccattcccacgggggtcttcccttgggaacaccactggc

SEQ ID NO: 967 - DNA, 5530 bp, Homo sapiens
ggccgcgcgcccggagaccccggcccagcgccgccggagaccgtgaggcccgcacttcaaagaccccgacccccgggagcccaactgttgacccaaggctcaaagttcccagcctgacccctgaccctcgccccggaagtcggggtgactcggaagttccggctcagtcgctaggaaacgagcgagcccgacgccaggggcggagctctggcctcctcgccgagttgggggaggcaggtgcgacaggagaatggacagtaagaaggggagacccaaagctgcagctgggaagtggcagacgctccaccctgggcccaagacaagagctgctgctgggaagcccggggagaaccgcccgccgcagaggaaagcgggctggcaggcgagggagcccgcgtcggctgagagcccacaggcccccacagggacacctggtcgccatcacatggacacgctatttttgcactcgaggctattccaggaagtccatccagacagagcacgccttccccagcctcctcttattggcctgcagccctgctctccccacgtctggtgatctgtaaagagggcttgttctgcgtgggtgggacctgctctagatccatcttggaaaatgagctcatgccgttggtgtaaccaccattcctgcccccatgccactctgccccggggcctgctggctgacgtccatggtgcagtcgtgatgtccacgagcctgtctgtgccctcgctgcggccgactctctctaggagcgtccccacaggatgcagaacctccctttgagctcggtgttccctgctcctcacagagccacccccaagcctttcccagctgtccgcatcaccactgtcccgggctcgttcacttcaggccctggagagccagcccagccctcactggtgtccggagtcagtgatacacagcgctcaagtgactcttcccacccacaggaagtgggtgatgaggtgccccccgggggcttcccttgctgctgcccgccaggatctccctgcttgggactacagcatgcgggggaggtcaggctggagttggtgtgggagcctttcccagcctttcctctgcattggtgccctccccaggaggcatctgagctgcaaaaggggcgaatgcgatgtagacacttgggccccgggactcgcctgtgtcatctgggctgggccccacaaacaccacaaacaccttttccaccacgcaatagatggctgctgggctgcccaggggtgtgatgtggagctgggaaacccagcctgggaaggcagcattccaggagctgctttccaaaagaagaatagcctccaccaggaaggtgtggctgagccccagagccccagaaacctgcgggaagctccaaaggggggcctgccagaggatacacaaccaccctacctcctgcacacgggatcctccaaccagacagtgtggcccaagcagcctggctactttcaccttagccagcagccctgggccacactggggatggtcccaaacatggcctgtgctgctgtcacggtgctaaggggcctggcaagcacggggtctttcttgctggacggaggcacaggtgccagaatctatcttttgccctacagtgtcccggcacagcctagatctatggaccccttcaccgggtgctttatcccccaccccccagaactcctgggaccattgagatgcccaggagatgggggggccctgtgcctgtgtcccgttgctgctatagcagccaccacatctaccagctctgcagggtagccaccgggcacggccttgccaggctgacgtcgaggaaagccagccgtgctgtgggtttccttccctctggctctccacttctgcctccctcttccactgtttttggtttgggtttttgttttgttccgttttgtttttttttgagacagggtcagctgtcttgcccaggctggagttcaggggctattcccaggtgtaaccctagctcactgcaacctccaactgctgggcttaagtgatcctcctgcctcagcctgagtagctgggactacaggtgtgtgctcccacgtctggcaagcctctttcagtataactgtatgggtttttctccatctttttttcgtctttacaatttttgttctcaaggacttgggctgtttgacttgagtcttccagtctggattttgctgataagatggaacacctcgagagtgcatctttgttaacatttagacatgcgtcccctcctcgcttgctcagtggaattacgattgcacttggaaatgtatcgtgttgggtgtgttccttaagctgaacttccgtagatctggcaggacatttaacaccagaacacgaagcctgcttcagaagtgactgaaacggcatctgcctcacagtgcatatttaaaaaatgattttgttgtgtgaataattatgctgccatctacagataagtgagatcagaaacattagtttcatatattgtagtttttagtttctgaatacttattggattctttttcttttttttttgagatggagtttcgctctgttgccaggctggagtgcactggggcttggctcactgctacctccgcctcccaggttcaggcaattctcctgcctcagcctcctgagtagctgggactacaggcacccaccaccacacccagctagtttttgtgtttttagtagagacagggtttcaccatgttggccaggatggtctcgatctcttgaccttgtgatccgcccgtctcagcctcccaaagtgctgggattacaggcgtgagccaccaggcctggctccttttccactttcatggaccctcgtgattgcattggatctccccgggtaatctgggatgttcttcctggcctaaggtcagctgattagcaaccttagttcatctgcagtctccattctctttttgctgaatcacgtcaagtattcacaagttccagggggcaggaggtggacatctttgggggacattattccgcccaccagaaaacccaggagcagccacagccccaagacgaggcagggaaggagtgctgctgtctgccggtgaagatgaactgcttctgaccctcccgagcgaggatattgagaagaaagaatttgccaagatgctagtcacacaccaagtacagaggctatgttggtcggctgcagcaaaaagaccactcgcggcgtggcagctctcactggccctgctgcctcttcaagttgactgcagtccatcacccacggtcattattaatttgtttttgcaaaggccaggcaggtgaatctaatggagatggaaaccaccacacctgcttccctggtctctgatgttggtgttaacctctgcaattcctcaagcaaagcactccttctatcaggctcactgtcttgctggagggaggaagttccacaggctctcacttggttctttctgccgtaacaacccttactcctccggccaaggagccaatgtgagcattcagctggcagctaagaatgtgtatcccaataaacagggcagacctacagacccactggacccactagagatggacttgggccacagtgccttccatgacttcagtaaacagaggggtgtggtgatcttgtcaaagtcctggcgtcaatgtcagtgtccggctacacaccatgttcccgtcctcgaaaagcctctctgtacccctctatgttggtgacacaaccctggcaaatggccacagactcctttggggacagagtaggagcgtaactggtgggagtggttggcatgctttgtattgggagagccgcacgccctagggcttccagcctcctcttcagtttggcagctgtgagtctgaatttcactcaaatctggaaactgggtgagagactgtggcagctgctgtccggctggcagagcctgacgtgtctctgatcatactcactgggtcagcaacaccctactgaccttgtccagaatcccacatcccagttgatatcagggcaatcagtttcctggctgttttccccaatatcaacccgggcttacagaagacagtcaccacagagctcctgccaggagttcactcattcgtgcatttcttccttttttttttctttttgagatggagtctcgctctgtcgcccaggctggagtgcagtggagcgatctcggctcattgcaacctccgcctcctgggttcaagcgattctcttgcctcagcctcccaggtagctgggatagcaggtgtgtgccaccatgcccagctaatttttgtatttttagtagagatggggtttcatcatgttgcccaggctggtctcaaattcctgacctcaggtgatctgccctcagcctcccaaagtgctgggattacaggcttcagccaccacacccagcctcattcatacatttcttattgttgttgtttgagacagggtctttctctgtcacccaggatggagtgcagtgttgtgatcatgcctcagtgcagcgatcatggctcagtgcagcctcaaactcttgggctcaagcagtgctccaacctcagcctcctgagtagctaggactataggcacacagcaccatgccccggctatttttttattttgtagagatggggtctcactatgttgcccaggctagtattgaactcctggcctcaagcaatcctcccacctcggcctcccaaagtgctgggattaaaggcgtgagccaccgtaccttgcccttggtggaatctttagggttttctattcatacatataaaatcatatcattggcaaacagagataattttacttcctcctttccaatttggatgccttagatttcttttccttgcctaactgctctgtctagaactcccagcactatgctgaatagagtggcaagagcaggcatttgccttgttcctaaccttagagaaaaatccttcagccttttaccattgaggatgatgtttgctgttagtttttcataaatgatctatatcaggctgaataaatttctatttctagtttgttgagtgttccttgtttattttggttttggtttctctcactctcttctttttgagcaggggacaggggcacagtctgtcacccaggctggagtgcagtggtgtaatcccagctcactgcagcctcgacctctggagctcaagccatcctcccatctcagcctcccaagtagctgggactacaggtgtgtgccatcatgtctggctaaatttttaattttttgtagagatgggttctcactatgttgtccagactgctcttgaactcctaggctcaggtgatcctcccaccttggtttcccaaagtgttgagatgacaggtgtgagccaccatgcccaggctttgtttggagatgtttgattactgatttaatctccttgctagttatatgtctattcagatttcctatttcttcatgatttagtcttgataagttttgtgtttttaggaatttgtccacttcatctaggtcactcaatttgttggcatataattgttcagagtactctcttatg

SEQ ID NO: 968 - DNA, 5530 bp, Homo sapiens; identical to SEQ ID NO: 967

SEQ ID NO: 969 - DNA, 5530 bp, Homo sapiens; identical to SEQ ID NO: 967

SEQ ID NO: 970 - DNA, 5530 bp, Homo sapiens; identical to SEQ ID NO: 967

SEQ ID NO: 971 - DNA, 5530 bp, Homo sapiens; identical to SEQ ID NO: 967

SEQ ID NO: 972 - DNA, 5530 bp, Homo sapiens; identical to SEQ ID NO: 967

SEQ ID NO: 973 - DNA, 5530 bp, Homo sapiens; identical to SEQ ID NO: 967

SEQ ID NO: 974 - DNA, 5530 bp, Homo sapiens; identical to SEQ ID NO: 967

SEQ ID NO: 975 - DNA, 5530 bp, Homo sapiens; identical to SEQ ID NO: 967

SEQ ID NO: 976 - DNA, 5530 bp, Homo sapiens; identical to SEQ ID NO: 967

SEQ ID NO: 977 - DNA, 6435 bp, Homo sapiens
gtgtctgctccccaggggccctggctcatggaccagccggcctcaggccagctcagagggcgtccctggaggctacagtggccgtgtgctcccacgccaggcttggccccctgttccaggtcctgccccttgctggagcccgcagcaccgcagctcgggactctggctctgcctatgggcctcactgaccccactcggtggggccaggccacgccagggagtttatagggactccacggcgcggtggctcgcctgggctgagaggctgactaacgcgctgacacggcggcacggggctttacaggccacgggccctgccggcgagactgggagggaggctgagaagctggaggaggcagcgcagcagccagagtgcctgctgtgcgcagcaacgggcgtgcctggtcctgccctgggcggcaccaatgccccccgcccccgccccatcccggctcccccggtcccacagctggtcgagggaaactcaaactgcaggccacagggccaggagctgcatcctggtcgcactgaccctcagggcccagaccctccctggccacagacaacctgagcccagctggccatgggaacccgcagcccatgcactctggagggctccagggcagctagcacgcccacaggagccccgctggggtttggtggagacaaaggacccagggacccggtgggagctagggcagggttcgggccactgcactgcggctggctggagagactgggccctcaaagccctgcgtggcactttgtgaactgatgtggggccccgaggaaagtcctggcggtcatggaggtggggcgggggctcttggtgccatcctggctgggggctggctgtcctgcactgcactgcaacaagggcctgactggatcagagctgcctttgggtctccaggctggaggtgggggtgcagggctagccccaaatgccggcgtcctctgggcttcttgttgggagggtgggctccaggtggcctcctccctagcgtttccccagcccggggctgctgactcacgcccacgcccagggccccatcccagccggctcagccacactggccggactggtttgcctggcgcaaccctgcctgaagcagtgctcctgctcctgttcagtcctagtcccagaagctcaggagcagagggacagccacctgccaggggagtgccgaattggacacacagagaccggaaagggcctgggggagggacgtggcacaagggaagcccggggagaaccgcccgccgcagaggaaagcgggctggcaggcgagggagcccgcgtcggctgagagcccacaggcccccacagggacacctggtcgccatcacatggacacgctatttttgcactcgaggctattccaggaagtccatccagacagagcacgccttccccagcctcctcttattggcctgcagccctgctctccccacgtctggtgatctgtaaagagggcttgttctgcgtgggtgggacctgctctagatccatcttggaaaatgagctcatgccgttggtgtaaccaccattcctgcccccatgccactctgccccggggcctgctggctgacgtccatggtgcagtcgtgatgtccacgagcctgtctgtgccctcgctgcggccgactctctctaggagcgtccccacaggatgcagaacctccctttgagctcggtgttccctgctcctcacagagccacccccaagcctttcccagctgtccgcatcaccactgtcccgggctcgttcacttcaggccctggagagccagcccagccctcactggtgtccggagtcagtgatacacagcgctcaagtgactcttcccacccacaggaagtgggtgatgaggtgccccccgggggcttcccttgctgctgcccgccaggatctccctgcttgggactacagcatgcgggggaggtcaggctggagttggtgtgggagcctttcccagcctttcctctgcattggtgccctccccaggaggcatctgagctgcaaaaggggcgaatgcgatgtagacacttgggccccgggactcgcctgtgtcatctgggctgggccccacaaacaccacaaacaccttttccaccacgcaatagatggctgctgggctgcccaggggtgtgatgtggagctgggaaacccagcctgggaaggcagcattccaggagctgctttccaaaagaagaatagcctccaccaggaaggtgtggctgagccccagagccccagaaacctgcgggaagctccaaaggggggcctgccagaggatacacaaccaccctacctcctgcacacgggatcctccaaccagacagtgtggcccaagcagcctggctactttcaccttagccagcagccctgggccacactggggatggtcccaaacatggcctgtgctgctgtcacggtgctaaggggcctggcaagcacggggtctttcttgctggacggaggcacaggtgccagaatctatcttttgccctacagtgtcccggcacagcctagatctatggaccccttcaccgggtgctttatcccccaccccccagaactcctgggaccattgagatgcccaggagatgggggggccctgtgcctgtgtcccgttgctgctatagcagccaccacatctaccagctctgcagggtagccaccgggcacggccttgccaggctgacgtcgaggaaagccagccgtgctgtgggtttccttccctctggctctccacttctgcctccctcttccactgtttttggtttgggtttttgttttgttccgttttgtttttttttgagacagggtcagctgtcttgcccaggctggagttcaggggctattcccaggtgtaaccctagctcactgcaacctccaactgctgggcttaagtgatcctcctgcctcagcctgagtagctgggactacaggtgtgtgctcccacgtctggcaagcctctttcagtataactgtatgggtttttctccatctttttttcgtctttacaatttttgttctcaaggacttgggctgtttgacttgagtcttccagtctggattttgctgataagatggaacacctcgagagtgcatctttgttaacatttagacatgcgtcccctcctcgcttgctcagtggaattacgattgcacttggaaatgtatcgtgttgggtgtgttccttaagctgaacttccgtagatctggcaggacatttaacaccagaacacgaagcctgcttcagaagtgactgaaacggcatctgcctcacagtgcatatttaaaaaatgattttgttgtgtgaataattatgctgccatctacagataagtgagatcagaaacattagtttcatatattgtagtttttagtttctgaatacttattggattctttttcttttttttttgagatggagtttcgctctgttgccaggctggagtgcactggggcttggctcactgctacctccgcctcccaggttcaggcaattctcctgcctcagcctcctgagtagctgggactacaggcacccaccaccacacccagctagtttttgtgtttttagtagagacagggtttcaccatgttggccaggatggtctcgatctcttgaccttgtgatccgcccgtctcagcctcccaaagtgctgggattacaggcgtgagccaccaggcctggctccttttccactttcatggaccctcgtgattgcattggatctccccgggtaatctgggatgttcttcctggcctaaggtcagctgattagcaaccttagttcatctgcagtctccattctctttttgctgaatcacgtcaagtattcacaagttccagggggcaggaggtggacatctttgggggacattattccgcccaccagaaaacccaggagcagccacagccccaagacgaggcagggaaggagtgctgctgtctgccggtgaagatgaactgcttctgaccctcccgagcgaggatattgagaagaaagaatttgccaagatgctagtcacacaccaagtacagaggctatgttggtcggctgcagcaaaaagaccactcgcggcgtggcagctctcactggccctgctgcctcttcaagttgactgcagtccatcacccacggtcattattaatttgtttttgcaaaggccaggcaggtgaatctaatggagatggaaaccaccacacctgcttccctggtctctgatgttggtgttaacctctgcaattcctcaagcaaagcactccttctatcaggctcactgtcttgctggagggaggaagttccacaggctctcacttggttctttctgccgtaacaacccttactcctccggccaaggagccaatgtgagcattcagctggcagctaagaatgtgtatcccaataaacagggcagacctacagacccactggacccactagagatggacttgggccacagtgccttccatgacttcagtaaacagaggggtgtggtgatcttgtcaaagtcctggcgtcaatgtcagtgtccggctacacaccatgttcccgtcctcgaaaagcctctctgtacccctctatgttggtgacacaaccctggcaaatggccacagactcctttggggacagagtaggagcgtaactggtgggagtggttggcatgctttgtattgggagagccgcacgccctagggcttccagcctcctcttcagtttggcagctgtgagtctgaatttcactcaaatctggaaactgggtgagagactgtggcagctgctgtccggctggcagagcctgacgtgtctctgatcatactcactgggtcagcaacaccctactgaccttgtccagaatcccacatcccagttgatatcagggcaatcagtttcctggctgttttccccaatatcaacccgggcttacagaagacagtcaccacagagctcctgccaggagttcactcattcgtgcatttcttccttttttttttctttttgagatggagtctcgctctgtcgcccaggctggagtgcagtggagcgatctcggctcattgcaacctccgcctcctgggttcaagcgattctcttgcctcagcctcccaggtagctgggatagcaggtgtgtgccaccatgcccagctaatttttgtatttttagtagagatggggtttcatcatgttgcccaggctggtctcaaattcctgacctcaggtgatctgccctcagcctcccaaagtgctgggattacaggcttcagccaccacacccagcctcattcatacatttcttattgttgttgtttgagacagggtctttctctgtcacccaggatggagtgcagtgttgtgatcatgcctcagtgcagcgatcatggctcagtgcagcctcaaactcttgggctcaagcagtgctccaacctcagcctcctgagtagctaggactataggcacacagcaccatgccccggctatttttttattttgtagagatggggtctcactatgttgcccaggctagtattgaactcctggcctcaagcaatcctcccacctcggcctcccaaagtgctgggattaaaggcgtgagccaccgtaccttgcccttggtggaatctttagggttttctattcatacatataaaatcatatcattggcaaacagagataattttacttcctcctttccaatttggatgccttagatttcttttccttgcctaactgctctgtctagaactcccagcactatgctgaatagagtggcaagagcaggcatttgccttgttcctaaccttagagaaaaatccttcagccttttaccattgaggatgatgtttgctgttagtttttcataaatgatctatatcaggctgaataaatttctatttctagtttgttgagtgttccttgtttattttggttttggtttctctcactctcttctttttgagcaggggacaggggcacagtctgtcacccaggctggagtgcagtggtgtaatcccagctcactgcagcctcgacctctggagctcaagccatcctcccatctcagcctcccaagtagctgggactacaggtgtgtgccatcatgtctggctaaatttttaattttttgtagagatgggttctcactatgttgtccagactgctcttgaactcctaggctcaggtgatcctcccaccttggtttcccaaagtgttgagatgacaggtgtgagccaccatgcccaggctttgtttggagatgtttgattactgatttaatctccttgctagttatatgtctattcagatttcctatttcttcatgatttagtcttgataagttttgtgtttttaggaatttgtccacttcatctaggtcactcaatttgttggcatataattgttcagagtactctcttatg

SEQ ID NO: 978 - DNA, 6435 bp, Homo sapiens; identical to SEQ ID NO: 977

SEQ ID NO: 979 - DNA, 6435 bp, Homo sapiens; identical to SEQ ID NO: 977

SEQ ID NO: 980 - DNA, 6637 bp, Homo sapiens
gtgtctgctccccaggggccctggctcatggaccagccggcctcaggccagctcagagggcgtccctggaggctacagtggccgtgtgctcccacgccaggcttggccccctgttccaggtcctgccccttgctggagcccgcagcaccgcagctcgggactctggctctgcctatgggcctcactgaccccactcggtggggccaggccacgccagggagtttatagggactccacggcgcggtggctcgcctgggctgagaggctgactaacgcgctgacacggcggcacggggctttacaggccacgggccctgccggcgagactgggagggaggctgagaagctggaggaggcagcgcagcagccagagtgcctgctgtgcgcagcaacgggcgtgcctggtcctgccctgggcggcaccaatgccccccgcccccgccccatcccggctcccccggtcccacagctggtcgagggaaactcaaactgcaggccacagggccaggagctgcatcctggtcgcactgaccctcagggcccagaccctccctggccacagacaacctgagcccagctggccatgggaacccgcagcccatgcactctggagggctccagggcagctagcacgcccacaggagccccgctggggtttggtggagacaaaggacccagggacccggtgggagctagggcagggttcgggccactgcactgcggctggctggagagactgggccctcaaagccctgcgtggcactttgtgaactgatgtggggccccgaggaaagtcctggcggtcatggaggtggggcgggggctcttggtgccatcctggctgggggctggctgtcctgcactgcactgcaacaagggcctgactggatcagagctgcctttgggtctccaggctggaggtgggggtgcagggctagccccaaatgccggcgtcctctgggcttcttgttgggagggtgggctccaggtggcctcctccctagcgtttccccagcccggggctgctgactcacgcccacgcccagggccccatcccagccggctcagccacactggccggactggtttgcctggcgcaaccctgcctgaagcagtgctcctgctcctgttcagtcctagtcccagaagctcaggagcagagggacagccacctgccaggggagtgccgaattggacacacagagaccggaaagggcctgggggagggacgtggcacaaggtgggggacagtgtcaggggtggggcagggccagcaggcggcactgccagcccacagggtccttctagcagaggcaccacctgcccatccttgggcccacaagagcccaggtgccttcctgcgggctggctctcgcctgtgcctccctgaggccccctgtgcagtggagtatgtgctgctggaggagcccgtgctccttaagggaagcccggggagaaccgcccgccgcagaggaaagcgggctggcaggcgagggagcccgcgtcggctgagagcccacaggcccccacagggacacctggtcgccatcacatggacacgctatttttgcactcgaggctattccaggaagtccatccagacagagcacgccttccccagcctcctcttattggcctgcagccctgctctccccacgtctggtgatctgtaaagagggcttgttctgcgtgggtgggacctgctctagatccatcttggaaaatgagctcatgccgttggtgtaaccaccattcctgcccccatgccactctgccccggggcctgctggctgacgtccatggtgcagtcgtgatgtccacgagcctgtctgtgccctcgctgcggccgactctctctaggagcgtccccacaggatgcagaacctccctttgagctcggtgttccctgctcctcacagagccacccccaagcctttcccagctgtccgcatcaccactgtcccgggctcgttcacttcaggccctggagagccagcccagccctcactggtgtccggagtcagtgatacacagcgctcaagtgactcttcccacccacaggaagtgggtgatgaggtgccccccgggggcttcccttgctgctgcccgccaggatctccctgcttgggactacagcatgcgggggaggtcaggctggagttggtgtgggagcctttcccagcctttcctctgcattggtgccctccccaggaggcatctgagctgcaaaaggggcgaatgcgatgtagacacttgggccccgggactcgcctgtgtcatctgggctgggccccacaaacaccacaaacaccttttccaccacgcaatagatggctgctgggctgcccaggggtgtgatgtggagctgggaaacccagcctgggaaggcagcattccaggagctgctttccaaaagaagaatagcctccaccaggaaggtgtggctgagccccagagccccagaaacctgcgggaagctccaaaggggggcctgccagaggatacacaaccaccctacctcctgcacacgggatcctccaaccagacagtgtggcccaagcagcctggctactttcaccttagccagcagccctgggccacactggggatggtcccaaacatggcctgtgctgctgtcacggtgctaaggggcctggcaagcacggggtctttcttgctggacggaggcacaggtgccagaatctatcttttgccctacagtgtcccggcacagcctagatctatggaccccttcaccgggtgctttatcccccaccccccagaactcctgggaccattgagatgcccaggagatgggggggccctgtgcctgtgtcccgttgctgctatagcagccaccacatctaccagctctgcagggtagccaccgggcacggccttgccaggctgacgtcgaggaaagccagccgtgctgtgggtttccttccctctggctctccacttctgcctccctcttccactgtttttggtttgggtttttgttttgttccgttttgtttttttttgagacagggtcagctgtcttgcccaggctggagttcaggggctattcccaggtgtaaccctagctcactgcaacctccaactgctgggcttaagtgatcctcctgcctcagcctgagtagctgggactacaggtgtgtgctcccacgtctggcaagcctctttcagtataactgtatgggtttttctccatctttttttcgtctttacaatttttgttctcaaggacttgggctgtttgacttgagtcttccagtctggattttgctgataagatggaacacctcgagagtgcatctttgttaacatttagacatgcgtcccctcctcgcttgctcagtggaattacgattgcacttggaaatgtatcgtgttgggtgtgttccttaagctgaacttccgtagatctggcaggacatttaacaccagaacacgaagcctgcttcagaagtgactgaaacggcatctgcctcacagtgcatatttaaaaaatgattttgttgtgtgaataattatgctgccatctacagataagtgagatcagaaacattagtttcatatattgtagtttttagtttctgaatacttattggattctttttcttttttttttgagatggagtttcgctctgttgccaggctggagtgcactggggcttggctcactgctacctccgcctcccaggttcaggcaattctcctgcctcagcctcctgagtagctgggactacaggcacccaccaccacacccagctagtttttgtgtttttagtagagacagggtttcaccatgttggccaggatggtctcgatctcttgaccttgtgatccgcccgtctcagcctcccaaagtgctgggattacaggcgtgagccaccaggcctggctccttttccactttcatggaccctcgtgattgcattggatctccccgggtaatctgggatgttcttcctggcctaaggtcagctgattagcaaccttagttcatctgcagtctccattctctttttgctgaatcacgtcaagtattcacaagttccagggggcaggaggtggacatctttgggggacattattccgcccaccagaaaacccaggagcagccacagccccaagacgaggcagggaaggagtgctgctgtctgccggtgaagatgaactgcttctgaccctcccgagcgaggatattgagaagaaagaatttgccaagatgctagtcacacaccaagtacagaggctatgttggtcggctgcagcaaaaagaccactcgcggcgtggcagctctcactggccctgctgcctcttcaagttgactgcagtccatcacccacggtcattattaatttgtttttgcaaaggccaggcaggtgaatctaatggagatggaaaccaccacacctgcttccctggtctctgatgttggtgttaacctctgcaattcctcaagcaaagcactccttctatcaggctcactgtcttgctggagggaggaagttccacaggctctcacttggttctttctgccgtaacaacccttactcctccggccaaggagccaatgtgagcattcagctggcagctaagaatgtgtatcccaataaacagggcagacctacagacccactggacccactagagatggacttgggccacagtgccttccatgacttcagtaaacagaggggtgtggtgatcttgtcaaagtcctggcgtcaatgtcagtgtccggctacacaccatgttcccgtcctcgaaaagcctctctgtacccctctatgttggtgacacaaccctggcaaatggccacagactcctttggggacagagtaggagcgtaactggtgggagtggttggcatgctttgtattgggagagccgcacgccctagggcttccagcctcctcttcagtttggcagctgtgagtctgaatttcactcaaatctggaaactgggtgagagactgtggcagctgctgtccggctggcagagcctgacgtgtctctgatcatactcactgggtcagcaacaccctactgaccttgtccagaatcccacatcccagttgatatcagggcaatcagtttcctggctgttttccccaatatcaacccgggcttacagaagacagtcaccacagagctcctgccaggagttcactcattcgtgcatttcttccttttttttttctttttgagatggagtctcgctctgtcgcccaggctggagtgcagtggagcgatctcggctcattgcaacctccgcctcctgggttcaagcgattctcttgcctcagcctcccaggtagctgggatagcaggtgtgtgccaccatgcccagctaatttttgtatttttagtagagatggggtttcatcatgttgcccaggctggtctcaaattcctgacctcaggtgatctgccctcagcctcccaaagtgctgggattacaggcttcagccaccacacccagcctcattcatacatttcttattgttgttgtttgagacagggtctttctctgtcacccaggatggagtgcagtgttgtgatcatgcctcagtgcagcgatcatggctcagtgcagcctcaaactcttgggctcaagcagtgctccaacctcagcctcctgagtagctaggactataggcacacagcaccatgccccggctatttttttattttgtagagatggggtctcactatgttgcccaggctagtattgaactcctggcctcaagcaatcctcccacctcggcctcccaaagtgctgggattaaaggcgtgagccaccgtaccttgcccttggtggaatctttagggttttctattcatacatataaaatcatatcattggcaaacagagataattttacttcctcctttccaatttggatgccttagatttcttttccttgcctaactgctctgtctagaactcccagcactatgctgaatagagtggcaagagcaggcatttgccttgttcctaaccttagagaaaaatccttcagccttttaccattgaggatgatgtttgctgttagtttttcataaatgatctatatcaggctgaataaatttctatttctagtttgttgagtgttccttgtttattttggttttggtttctctcactctcttctttttgagcaggggacaggggcacagtctgtcacccaggctggagtgcagtggtgtaatcccagctcactgcagcctcgacctctggagctcaagccatcctcccatctcagcctcccaagtagctgggactacaggtgtgtgccatcatgtctggctaaatttttaattttttgtagagatgggttctcactatgttgtccagactgctcttgaactcctaggctcaggtgatcctcccaccttggtttcccaaagtgttgagatgacaggtgtgagccaccatgcccaggctttgtttggagatgtttgattactgatttaatctccttgctagttatatgtctattcagatttcctatttcttcatgatttagtcttgataagttttgtgtttttaggaatttgtccacttcatctaggtcactcaatttgttggcatataattgttcagagtactctcttatg

SEQ ID NO: 981 - DNA, 6637 bp, Homo sapiens; identical to SEQ ID NO: 980

SEQ ID NO: 982 - DNA, 6637 bp, Homo sapiens; identical to SEQ ID NO: 980

SEQ ID NO: 983 - DNA, 3087 bp, Homo sapiens
ggaagcccggggagaaccgcccgccgcagaggaaagcgggctggcaggcgagggagcccgcgtcggctgagagcccacaggcccccacagatggagtttcgctctgttgccaggctggagtgcactggggcttggctcactgctacctccgcctcccaggttcaggcaattctcctgcctcagcctcctgagtagctgggactacaggcacccaccaccacacccagctagtttttgtgtttttagtagagacagggtttcaccatgttggccaggatggtctcgatctcttgaccttgtgatccgcccgtctcagcctcccaaagtgctgggattacaggcgtgagccaccaggcctggctccttttccactttcatggaccctcgtgattgcattggatctccccgggtaatctgggatgttcttcctggcctaaggtcagctgattagcaaccttagttcatctgcagtctccattctctttttgctgaatcacgtcaagtattcacaagttccagggggcaggaggtggacatctttgggggacattattccgcccaccagaaaacccaggagcagccacagccccaagacgaggcagggaaggagtgctgctgtctgccggtgaagatgaactgcttctgaccctcccgagcgaggatattgagaagaaagaatttgccaagatgctagtcacacaccaagtacagaggctatgttggtcggctgcagcaaaaagaccactcgcggcgtggcagctctcactggccctgctgcctcttcaagttgactgcagtccatcacccacggtcattattaatttgtttttgcaaaggccaggcaggtgaatctaatggagatggaaaccaccacacctgcttccctggtctctgatgttggtgttaacctctgcaattcctcaagcaaagcactccttctatcaggctcactgtcttgctggagggaggaagttccacaggctctcacttggttctttctgccgtaacaacccttactcctccggccaaggagccaatgtgagcattcagctggcagctaagaatgtgtatcccaataaacagggcagacctacagacccactggacccactagagatggacttgggccacagtgccttccatgacttcagtaaacagaggggtgtggtgatcttgtcaaagtcctggcgtcaatgtcagtgtccggctacacaccatgttcccgtcctcgaaaagcctctctgtacccctctatgttggtgacacaaccctggcaaatggccacagactcctttggggacagagtaggagcgtaactggtgggagtggttggcatgctttgtattgggagagccgcacgccctagggcttccagcctcctcttcagtttggcagctgtgagtctgaatttcactcaaatctggaaactgggtgagagactgtggcagctgctgtccggctggcagagcctgacgtgtctctgatcatactcactgggtcagcaacaccctactgaccttgtccagaatcccacatcccagttgatatcagggcaatcagtttcctggctgttttccccaatatcaacccgggcttacagaagacagtcaccacagagctcctgccaggagttcactcattcgtgcatttcttccttttttttttctttttgagatggagtctcgctctgtcgcccaggctggagtgcagtggagcgatctcggctcattgcaacctccgcctcctgggttcaagcgattctcttgcctcagcctcccaggtagctgggatagcaggtgtgtgccaccatgcccagctaatttttgtatttttagtagagatggggtttcatcatgttgcccaggctggtctcaaattcctgacctcaggtgatctgccctcagcctcccaaagtgctgggattacaggcttcagccaccacacccagcctcattcatacatttcttattgttgttgtttgagacagggtctttctctgtcacccaggatggagtgcagtgttgtgatcatgcctcagtgcagcgatcatggctcagtgcagcctcaaactcttgggctcaagcagtgctccaacctcagcctcctgagtagctaggactataggcacacagcaccatgccccggctatttttttattttgtagagatggggtctcactatgttgcccaggctagtattgaactcctggcctcaagcaatcctcccacctcggcctcccaaagtgctgggattaaaggcgtgagccaccgtaccttgcccttggtggaatctttagggttttctattcatacatataaaatcatatcattggcaaacagagataattttacttcctcctttccaatttggatgccttagatttcttttccttgcctaactgctctgtctagaactcccagcactatgctgaatagagtggcaagagcaggcatttgccttgttcctaaccttagagaaaaatccttcagccttttaccattgaggatgatgtttgctgttagtttttcataaatgatctatatcaggctgaataaatttctatttctagtttgttgagtgttccttgtttattttggttttggtttctctcactctcttctttttgagcaggggacaggggcacagtctgtcacccaggctggagtgcagtggtgtaatcccagctcactgcagcctcgacctctggagctcaagccatcctcccatctcagcctcccaagtagctgggactacaggtgtgtgccatcatgtctggctaaatttttaattttttgtagagatgggttctcactatgttgtccagactgctcttgaactcctaggctcaggtgatcctcccaccttggtttcccaaagtgttgagatgacaggtgtgagccaccatgcccaggctttgtttggagatgtttgattactgatttaatctccttgctagttatatgtctattcagatttcctatttcttcatgatttagtcttgataagttttgtgtttttaggaatttgtccacttcatctaggtcactcaatttgttggcatataattgttcagagtactctcttatg

SEQ ID NO: 984 - DNA, 3087 bp, Homo sapiens; identical to SEQ ID NO: 983

SEQ ID NO: 985 - DNA, 3087 bp, Homo sapiens; identical to SEQ ID NO: 983

SEQ ID NO: 986 - DNA, 3087 bp, Homo sapiens; identical to SEQ ID NO: 983

SEQ ID NO: 987 - DNA, 3087 bp, Homo sapiens; identical to SEQ ID NO: 983

SEQ ID NO: 988 - DNA, 3087 bp, Homo sapiens; identical to SEQ ID NO: 983

SEQ ID NO: 989 - DNA, 3087 bp, Homo sapiens; identical to SEQ ID NO: 983

SEQ ID NO: 990 - DNA, 3087 bp, Homo sapiens; identical to SEQ ID NO: 983

SEQ ID NO: 991 - DNA, 7255 bp, Homo sapiens
cgggcctgcgggacaagagcgacatgggcagctcgggcgggacggcgccccgcgggccacacccggcctgcccgccgccccccggggcccagtgctggggaccattaagtgtcttaaacacctgagggaagagaaggaaaaaaaaaaaaaggagggcaagaaggaagaggagggagggagaggagggcaagacagggaacggggtaaaaggaaaaagaaaacggagaaggaaaaagacacagaaagaaaaaagaatctggcatctatccccatcgggaaatggcattcactaacgaacacgggtgcaaatgatcccaaaatgacggtgacttaatacaattgattaaggaaactactgccagcttttaatgtagctctgcaatgggtttctttctttttctttttttaattacaggtgcattgagagttcagaaaagaaagggagtcacccaacagtcagatgcaatttgggtatggtcctaaaatcacatcttgcaaattgcacctcaagcccttttaggacagacctctatcccaatctgaagcccttttaggacagacctctatcgcaatctggaagagccctgctgtcagaacccatgctttacaaacagagcaacgagtttatcagtcttctgatgtgaactacaaggagcacacactttttcttttaaggcctataaagcatatttcaggtttaatcagtgaagtctgggaacttaaattttttcttactacatattagaaaacacttcttaaaacattcattgttagccaaaaaaaatctgctcattccacctaataaaaattggcaaatattaggattcaagggagcattatcccatgttaccagaataaaacaatatgtaatctgaaagcttgtcaaagtgcattgattaagttaatttaaaataattttccgcattgaacttcaggagtttaagttaattactaggtacagacttaaatttttaagtgttccatttcttctcctagatgaattttcagttgccttaaaattataattttagtgatgctaccagatgagttaaatttttttaaaagaatctcagtaagcagatgttaaagtccagagcatttttccaattttttctaaatcctttctaagaaaaaatagctattaaatggtaacaaaaataatagtctacatacttcagagcgatttaataattaaccatacaacgacatacattatgaaaaactgaacacatttattcaatttccaacaatcaccaattagaaatgggcttaaatgacaatacaaagaaagctataagcaaacattttgacagggggatgtgaagaattagaacaaactgcttaggaaactacagtgtgtgcctgtgtttgtgtcgtgtgtgtgtgtgtgtgtgtgtgtgtgtgtgtctgtgatgttatcgttcttttcccctccttctaaaattaggtaaaacatttcctaaagatacagagcaaggtaagatttcttcttcaggtaatttccagcagtggttctcggggttgatgagaaaatcttaggaggaaaatgcacttcattttatttttaattttaggtattgtagatgtacctccataattaagaagttttttcatctaaatactttttttcctgtataaaaggtcctttatgtaatgcataccttttataatacgatacatttagagttcctttcatccatatataagaaaccaatttgtaaatattaagtctcagggttactatgcattggagtaagttatcaggggaagttttagaatatttttccctggagagctttaaaacaaggtacatttttcatttgggttgctctaggtgtgatccagtcaagtcagaggagatacagatttctaacattcattttaattccctatgattctatgactctccttaagaagctcaagaagctggtagaattaaacatatttgaagccttgctataagcatgctaaatcaggaatttaatacatttaggtcctctaaaagcaaccatctttaggtcttactgataatatcggaagaattactttaaatttagttctcaaagtgtttttcctcccagttcaaataattcatcaacaaaagccgtaacactgcaatcatgttatcatttcacttgtactggcactgtcttctttagcattattgcctataaatacccatgcagaagattatgaagactccttgaggtatagtcaagtcactattttaaaaactacatttaatcaaaaagaggtacccaaagcatatctttcatctctggtccagaatctagtctgtgactccaaactagatctgatatatgcatggaccgccttcttcagtcactaaatagaaagatattctaattttgttgattcacctgtaacactgaaagacagagagagattcaaacatctacttacatattccagtctccaatttaaaagtactgcaacttgctgtgcactaaacaggtacctttaaacaccctgtatcttcccagaaaaaatgttctttcacctcagctgttatcacctgctagttgtgtgagcctgagcaagttactcaaccaatctgtggctcagtgtcctcatctatagaatggggagagtaacaatagccacctcatagggcagcggtgaagattcagtgagataacagtgtctacctgttcaaccctcggcttttgtcgttttattgccaaggacagggagataaagaagcctaattgactcagctttatagaaaaaccacatggcaaaagaaaggtctttcaggaaattcggtaccatattagctggcaactttgggagtactctttttctatagcaatttctaagtgtttcaacagtttaacacaactcctcagcacagatactcagatgagtccgcctgccatgtgctccctggagtctgctaccagagctacttagagcaaactccacttcctagctaaacaccacaagttcatttaccgtgtgggtctatttcctcttccctccgacagattgtataaaaatgactacttaacagaggccggggaactgaacacagcttgctgcaattagccttgcccaaagtctacctacccattcattaggttttatgcctgtctgtccctcaggcggcttacgggttcgtttgcctggctggctttgctctctatcgacagaaatcgtctcctctacactagacaccggtggcctgctacttgacaagacttttccctggtatcttcaaatggaagacaaatcacattctttagcttatctcccactccctctccaacgtaaacaatttaggcttcattgtcagaggtacaaaatgccatctgctttcccttcagtcctcattttaggagtcaaagtagaaacaaagtagaaactctggccctccagaagggagtcccagcgcagctaagcggggagggggcagtctttattgaatgcatccctaggcgtgatttgatgcaatagggtaacaatgtattaaaatacccaagtctcacaggcacagaacttcaaagcattcagtgctcccacttagtcttccggcatacaggacattcatgcaaataaaagatctatgcattcagtaagaatttaaggggtttccacaggttggaaaaaacaaacgcaataaaacatttaaattgagcatataaaatttcagatatcaaaaaaaacactttattttctaccataaggtctctccctcacccctcaaaaaccccaaattttttcagttcccatttttctttttgtttgaatctctgaaaggaaaagtgaatcaaaatgaaaagaaaaatgatgggttagatttgagcggtgcccacagcaggcaagggcacattccatcgtaagagtggctgacattttgtaggggaaaccactgcagagttatgtgttccatgggcaatgcctcgactccaatcataattctttggtggtggctgggatgatgtcacttttggtgaattataagtttggagcagctttgaggcaggccaacccagccaaaaagattctcttcacacatgaataacaccaggaaatggaacagaagcaaaatgggaacacaactacctctacgtaagtgaataatatcctgaaatattagcaggggtgtttaaagtggggacaagttcagcaatgctgtcaaatggcagtgccctctcagtgacagaaatgggctcattctatttgaaggagatatcttctttcctccttcattcacgtctcctttccactcttccataaaaccctacctgcccaaatattgtcatttctaatgaagctccgactattgaaaatttaaaaagacatgagcagtgagtaataaagtgaattccctttaatgacaggcacctgatgacgaaagatgtaggtaccggagccaggttaaaaaaaaaaaaaaaatagagccctctcctgaaaatgatccagaaaaggcactcaggattgggttgattaggacatgaagcatttattgtgtacaggtatccagataaatggaacttcatcctttaaattttactactgtgttcagttacattattttaaccttggatgaaaaaggtttctcaaacaaatcattctgcttcctacattcttaactgatatcttcgaatcttttattactgagtctagctcgttcttaaaaataccaatgcttggtgatgtctgtgacaagatgatatcccaggaccaactgtgaggtatagcagatcatacccagaacacatcatcccagactactaccttttgggagttcaagttctgatccctcctctccatcagcctttcatgtagctggtagttaccagctggcctctacttgaaattctcctagttaatactcttcacatactgagacatgggatataaagattaccaattttgttgatattgtgtctcagagtaagagggaaaaggatctaagtaaggtgtgcagatactgtctctttacacacagaagtacaatgcttgcatcttggtacacagactttgtgataggtttttttccttgtcatgagcctttttgccatgaaggagccagtatgggaaagtggttaagaacatgagatcttaagtcaaattcctggggtctgaatcccgactctccatcattagttgtgtgacacatgcaaaggacttatcactgagaatggcacatgagtaggccagcaggcactcagggaggataagccacacacacatatacatacgtgcttttttcttctatctggctgcattctcaagagctggagttttgcagttttaaaacctctaaatacttttaggattcaaactgccattttctgcatagtttcttgtataacctttcctgttcccaaatctcagttctctatgatcctccacctaccaaatgcctccatggtagccacacagaaattctggagatgaaatgatactttcttgcccttttaaaacccactgccatggtctgaaagtttatggtcccctcaaaattcatatgttaaaatcctaattcccagggagatggtattagaaggtggggtctttgggaggtgactatttcatgagagtagagtcctcataattgggattcatgcccttgtaaaagaggctccagagagctgccttgtctcttctgccatgtgaggacacagtgagaaggaagccatctatgaatcaggaagcaggccctcaccagacactgaatctgctggtgttttgaggttggaattcccagcattcagagctgtaagaaataaatttgctgtttttaagccacccagtcaatgacctttcattacagcagctcagacttactaagacatccattcttaaggctataacaattaataagatgaggatatctcttaggtaggcctactcttggagctgcctctaccagaaaataaacgtatacaaactcaataggcagaatattaatgaaaaaatactaatctgaactctctcccatggtataaggcccaaaacccaggaacagtaccaatatcccaaactagctgtttgcaacaacctgcatgtcagaacttgcctaaatgaatggaaaccactcagaggaaatggtatcaacgtcaaggaagtacctcattccctagaatccaaagttttcattagagtagacccatacaatctctgcttttccagttctttaacaaaacgcttcctagagaaaacaaccttcatggaagatcacttcacagtcccctgcacctctgaagtctatcaatgggatcaagacagaagaccaagaggccatgcaaaggattgtatcatttctacccattgtataatgtcatagcttcagacttcatcccaaggtgtataagaaataggccatgttgaatctgttagtctattatgaacaaatgctattgatgtttctgtcatgcagtgcctcttacaataatgatgatgataataatttaaaaaataatctcacctgggaaatcaactctatactctcatgctagaaatggctttttctgagaaactggtaaggaacttccttccaaagggcgagacttagatacaggactttgtctccttttggctctgattgtcaagaaactcaagtcatctttgaagcaaatacagcaactatgagaacttttgcagccctactttcttgcctcaatttcttacttttttttctattttcccttgttgctgattttgctactcataattattttacaacaggcatgcttcttgtaagcctctccagatgttcttcataacaaaaagggatagaaataaacaaatcaacaaattataaaatggctctagtggggctgatctgagcagtgagttctggggatgaaatgcactaagtccagaggttcttaaccttgtgtgtgtggatgggcttccaagaaaccttgaaccgcttcaaagagaacgcaaaatcacaggtgctttttccctgggtctccagcttgcacaaccaccttttaaggttaagaaacactgccctaggtctcaacagcaggggaagaccaagaatcttggccatctaagtggagcaaggatagagagccagtgaggtataacaaaaggctacgtcagccccgggcttttaacaacccggtgttttggtgagcagtctttgttatccgagttggaccatggcattattcatttggttgcgtattaacctaccagatggtctgttgtagttaacaagggccggctgctgttgttgctgcgtctgtggttgcggcggctgctgctgcggctg

SEQ ID NO: 992 - DNA, 7255 bp, Homo sapiens; identical to SEQ ID NO: 991

SEQ ID NO: 993 - DNA, 7255 bp, Homo sapiens; identical to SEQ ID NO: 991

SEQ ID NO: 994 - DNA, 7255 bp, Homo sapiens; identical to SEQ ID NO: 991

SEQ ID NO: 995 - DNA, 7255 bp, Homo sapiens; identical to SEQ ID NO: 991

SEQ ID NO: 996 - DNA, 7255 bp, Homo sapiens; identical to SEQ ID NO: 991

SEQ ID NO: 997 - DNA, 7255 bp, Homo sapiens; identical to SEQ ID NO: 991

SEQ ID NO: 998 - DNA, 4172 bp, Homo sapiens
ttttgtacgagtcattcaaataatagacgcaatctaggtaacttcaagagaagatgggaaggggaaggggcaaagcatggaaggcaaatctaaagattatgggcggggcagagaaaggttcgcacttagtacgcatgcgcataccaggcgcgacaggtgggcggacacagaaggcgacgcctagggctgtgttgtcccggaagtgccttctctcctcccgggtctgcgcggacgcggcctccttacctcatttgtcctcgcccctccccgtccctctacgcgttttggtccctgtttggtgctttctgtttgcagctacggcagtgagtatatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcacctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagatctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactgtgtgtgtgtgtgtgtgtgtgtgtgtgtgtgtgtgcatacagacacacatatttctgaaatgtaaatattctcttcttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaaccttctgtccagtctccatcctgttcctgctcttccccttatgggtaaccattaagagaaaattggtggttggtccttacatttaaaaatatatataatcaaaaaactgtat

SEQ ID NO: 999 - DNA, 4670 bp, Homo sapiens
ttttgtacgagtcattcaaataatagacgcaatctaggtaacttcaagagaagatgggaaggggaaggggcaaagcatggaaggcaaatctaaagattatgggcggggcagagaaaggttcgcacttagtacgcatgcgcataccaggcgcgacaggtgggcggacacagaaggcgacgcctagggctgtgttgtcccggaagtgccttctctcctcccgggtctgcgcggacgcggcctccttacctcatttgtcctcgcccctccccgtccctctacgcgttttggtccctgtttggtgctttctgtttgcagctacggcagtgagtatgtatgtgacggaccccgagtcacccgcggcctgggacccctgcctaccctccgtctcgccagccgagctgtggaactagcgcgtgccccctcgccgacctcggcgtctccggtccgcccctcacttgtggtggggcgcagctcctggtccctcagctgcgcgccgccccacgcggccgggctgcgggtctagggggtccgcatctccctggctttccaagggctaaggtcgtgattctagggcggctgggcgtccagggcctcggtgggggtggcgtgtctgccctttttatctccccgcaaggcccccagtcttctagggaagccagtcagtgaagcgcggaggtccgggcgcgccgagagagagtccagtctttgaggaccgagtagtcctgggccacctcccgcctctgctgtcagaagcagcagctgccgccgtggaatccaaaatttcgggagctgtgaccctttcctcatgtaaaacgagtagtcttggacgatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcacctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagatctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactgtgtgtgtgtgtgtgtgtgtgtgtgtgtgtgtgtgcatacagacacacatatttctgaaatgtaaatattctcttcttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaaccttctgtccagtctccatcctgttcctgctcttccccttatgggtaaccattaagagaaaattggtggttggtccttacatttaaaaatatatataatcaaaaaactgtat

SEQ ID NO: 1000 - DNA, 1890 bp, Homo sapiens
tacttgctgctgtcagattcaaacaaacaaaaattactcagaaaaacaaagctttattcagagccatgttgttatgggttgaattgcatctccctaaaattcatatgtttaagtcctagcccccagtacctcagaatgtgaccctatttgggaatgagtttgttgcagacataattagttaagatgaggtcatagtggaatagggtgtgtcctacttcggtatgactggtgttcttataaaaaggggaagtttggacatagagacacaaatacacaaggaaagctccatggaagataaaggcagagatttacaagccaaggaatgtcaaagacggccagcacaccaccagaagctagcagagaggtatggaacagattcttcttcacaacctcagagggaaaaccctgctgatacctggatttcaaactcctggcctccagaacgacaaagtcttgcttgctctgtcgctcaggatggagtgtagtggtatgatcttagctcactacaacctctgcctcccaggttcaagtgattctcctgccttacgctcccaagtaactgggactacaggcacacaccaccacacccagctaatttttgtattttttgtagagacggggttttaccacgttagccgggctggtcttgaactcctgacctcaggtgatccacccgcctcgatcgcccattattaacaatcaaatggctgttcttcatggtactggtacaaaaacagatatatacaccaatggaacagaacagaggcctcagaaacaacaccacacatctacaaccatctgatctttgacaaacctgacaaaaacaagcaatgaagaaaggattccctatttaataaatggtgttgggaaaactggctagccatatgcagaaaactgaaactggaccccttccttacaccttatacaaaaattaactcaagatggactaaagatttaaacataagacctaaaacaataaaaaccctagaagaaaacctaggcattaccattcaggacatagacatgggcaaagacttaatgactaaaacaccaaaagcaatggcaacaaaagccaaaactgacaaatgagatctaattaaactaaagagctcctgcatagcaaaagaaactatcatcagagtgaacaggcaacctacagaatggaagaaaatttttgcaatctatccatctaacaaagggctaatatccagaatctacaaggaacttaaacaaatttacaagaaaaaacaaccccatcaaaaagtgggcaaaggatatgaacagacacttttcaaaagaagacatttatgcagccaacaaacatgaaaaaaagctcatcatcacgtcattagagaaatgcaaatcaaaaccacaatgagataccatctcacgccagttagaatggcgatcattaaaatgtcaggaaacaacagatgctggagaggatgtggagaaataggaatgcttttacactgctggtgggactgtaaactagttcaaccattgtggaagagagtgtggcagttcctcaaggatctagaactagaaataccatttgacccagaaatcccattactgggtatataccataaggattataaacgattctactataaagacacacgcacaagtatgtttattgcagcactattcacaatagcaaataattggaaccaaccgaaatgcccatcaatgatagactagataaagaaaatgtggtacatatacaccatggaatactatgtagccacaaaaaagagtgagtttatgtcctttgcagggacattgatgaagctggaagccatcattctcagcaaactaacacaagaacagaaaaccaaacactgcatgttctcactcgtaagtgggaattgaataatgagaacatat

SEQ ID NO: 1001 - DNA, 1890 bp, Homo sapiens; identical to SEQ ID NO: 1000

SEQ ID NO: 1002 - DNA, 1890 bp, Homo sapiens; identical to SEQ ID NO: 1000

SEQ ID NO: 1003 - DNA, 1112 bp, Homo sapiens
aatgtgaccctatttgggaatgagtttgttgcagacataattagttaagatgaggtcatagtggaatagggtgtgtcctacttcggtatgactggtgttcttataaaaaggggaagtttggacatagagacacaaatacacaaggaaagctccatggaagataaaggcagagatttacaagccaaggaatgtcaaagacggccagcacaccaccagaagctagcagagaggtatggaacagattcttcttcacaacctcagagggaaaaccctgctgatacctggatttcaaactcctggcctccagaacgaagtccctggagagaggacgtgatgtctgaagctatggcagccatcttgtaactatgaggccacaaacaagaaaagcaaaaaccagagtgaagcatggcagagcagaaagatggaaagaacctggatacataagagtgtcactgtgcagctgtacccaccctagactgcatatacctggactttaagtaaatgacaaatatcctttattctatctcaagccattgcttcttcatcttttttgtgtcatgacaatcacagtgggcggtaatatttgtactgccctctggggaacacagaggagactgctggcacctgaggtgaactatgctgggggcttcagctgccccaggactcctccctaccttgaagcctgaggggatacatatctctctgcacatctctttgtggctcatcaatgggcctcaccatacacgttgaaaagttctagtttaagccatacttacctgttacttggctgaatgcacttctaagtaaaacttggactcaatgctgcttgtcaatggaaagtgatgagatttataagatatcatacattctctagcaacatatgaatatgcaaaaaatactgatcttagcccaaatcacatcatatgattctactgacagaactatttgctatttaactcgtgttctttcttgtcagtaatggggccacttcctgattaactacaggcacatttcatgagatccaaacatagaaatttttctttctttttttttctgagacagagtctcctcagtcgcccaggctggagtgcagtggcacgattttggctgat

SEQ ID NO: 1004 - DNA, 1112 bp, Homo sapiens; identical to SEQ ID NO: 1003

SEQ ID NO: 1005 - DNA, 1112 bp, Homo sapiens; identical to SEQ ID NO: 1003

SEQ ID NO: 1006 - DNA, 1112 bp, Homo sapiens; identical to SEQ ID NO: 1003

SEQ ID NO: 1007 - DNA, 15070 bp, Homo sapiens
tacttgctgctgtcagattcaaacaaacaaaaattactcagaaaaacaaagctttattcagagccatgttgttatgggttgaattgcatctccctaaaattcatatgtttaagtcctagcccccagtacctcagaatgtgaccctatttgggaatgagtttgttgcagacataattagttaagatgaggtcatagtggaatagggtgtgtcctacttcggtatgactggtgttcttataaaaaggggaagtttggacatagagacacaaatacacaaggaaagctccatggaagataaaggcagagatttacaagccaaggaatgtcaaagacggccagcacaccaccagaagctagcagagaggtatggaacagattcttcttcacaacctcagagggaaaaccctgctgatacctggatttcaaactcctggcctccagaacgaagtccctggagagaggacgtgatgtctgaagctatggcagccatcttgtaactatgaggccacaaacaagaaaagcaaaaaccagagtgaagcatggcagagcagaaagatggaaagaacctggatacataagagtgtcactgtgcagctgtacccaccctagactgcatatacctggactttaacatcttgtttggacttgtttgtgagcaccaaggagacacctctggggacttacagatctacttggacagcacttgaccatggacctgccccccagcagatggggcaagagccagtgaaatttgggtatttgactgcaaccctgtttgttcccacatgtagaggagatctggtgcaactccagttacttggagcagtataacagcacagccactgctgtcgtatcaacatttttcgctagtcctctctcatgtggggcttgtctatggggcatgttggcattgggaagtcctcatttcctgatttactgtctcatgatgagataccaatcaaagctaagatacaaagaactctttgaaaaatagccttttcaacttgtccacacacaatcagaaacatactgattttggattaactcattattaatgattttgtctattttgaaagaggctgccctgaacaaggagtcaggaattgtaggtcttagctccacttttgctattaagttatgctgcaaaccttagaatcttcgctgagcagttctctgggcctctcttaatctgtagacgaagaaacagaggcagatgaaacacatctcatctaattttgcagacacgctcaaccctctacactacaataaagggttaaaaaaggacataaacctataaagaggggagaagattggaagaagctaagagagacaaaatttaggagtctgaaaggcatatgaacaggtagtaatcaatttagcaaacttgagaggaaaatcctgagctaccactgggaaaagcaaagaaatatatagccaggcaaaaacctctccccattccaacagaagactggaggattttattttttttctccctgcggaaaacacagaacaggatgtgtggacccagggacaccagaagcaattgaggtaaaagaaagagaggaagtaaatatgtatatactagatgctaagacacctgttcctgccagatgtcccagaaggctgacagccaggcctttctcctccaagcaagaaactggaagcatctcctatagggagtctgaccagctcaatagcttgctggtcaacaagctctgctcaagtgcttaagtttccagtcagggatttttttttttttttttttttttttaagacagagtcttgctctgttgcccaggctggagtacaatggtgcaataacagctcactgcagcctcaaccacccaggctcaagccatctgagcctctgagtagctgggactacaggtgtgtcactgcacttggctaattttaattttttttgtagggatggggtctcactagtattgcccaggctggtctcgaactcctgggctccaacagtcctcctacctcggcctccaaatatgctgggattataggtgtgaaccaccacacctggcctctaatcagttttctagtctcccactcaagccttagttgagcagacaaatgaagatttccaaaaatctgaggaaaacctccagtatagaacatgtagactacaaagagaaaaaggcagcctggatgaaaaccgagactaaaaagggagaagaaacaaaattcagggcaaaacaaaaaacataatcctaatatcttcaggaaaaaagagaaattacaatcatgaaaaaaggaaagattgctaaaaaataaaatctcagcgaacaaaaaaagaattcttataaaacatggtaatggaaattaaaaactcagtggaaggattaggagatgaagttgaggaaatctctcagaaactaggacagaaacataaatagatgggactgaagacagaaaagtagagaaaattggaagacaaatccaggatattctgtatgcataaaaggaattacaaaaaggaaaaagaaaatagagaggaggaaataagaaaatagtttagaaaatttccccaaactcaaaacatgagtttgcaggttgaaaaggtcccctgagtgcttagcatgctggctgaaaatagacctgcaccaaggcctagcatcatgaaatactgagactctgagagaaaatcaaagagtttacaggtttctgcaataataataataataataggaagaaagaaagaaaggaaggaagaaaggaaggaaggaaggaaggcaggcaggcaggcaggcagacaggcagacaggcaggcaaagaaagcaagccatttacagaagatcagaaatcagaacagcactggatttctcaatggtaattggaaactagaagacaatggagccaagccttcaccatgttgaaaaaaaaaatccaaaatatttgcaatctagaattctatactagttaatctatcaatcaagtgttagggttagaataaagacttaagacatgcaagatctcaaatattttgcctgcaatgaatatttttcatactggaggattttcttctggaaaatgtgttccaccaaaatgagggagtaaaccaagaaagaggaagaagcaaagaggaagatgtaggagatgacaaacaacggaactgatacagacaagaggttactagaatccccagaatgatggagcagagaggccccaaagtaacatttgtacatcaggtcctagagggcaaccagttcagtccaggctggtcagaagtgtctggcggaaacttctgcaagacaataaaaggaacagaacctcatgcacttaaatggtttgagaagaaatgaagacactggtggaaagcttagggttctattaaggaaaaatacacagaaaactaagcaaaccgaagaacaaggcagtcatttattacaataaaaacaaaaagtcacacaggaaaggaaactgaaacatagtatatgacactattcacaaagccataataaaacactcaatatcgatcggactacagtcaagatgtaactatacagggaaactggaagggtgtaggaggagggggtgggaacagtacacatacgtggtatgtgtcgggtggagaaaagacagctaaatcttcgtcttctatagtgggcagttattagctaatgcctacacccaatagatcaagcaataacaatataagcatgttatttagaaaaaccaaagtaattgccaaaggaatcagctcaaagagttgaaggtgattgcacatgaagacgtagggggaggtggactacggcttgctctttttcttaacacatgttacacgactatttgttaaactctgggcatagagttttgttacaaaaataatttataaattttaaaatcaatcaataccttttttaataaataaaagggctggatgacatgatggccaaagttccctctcatctccaaagctccgtgattctttcaggatgagttttaccacttaggttggaaaggcaggagggtgaacagggaaaaggcgaaggctcgaccggttccctaaatgagctttgacctggccttcgaatacctggcctctctcctgtcacaactcagtgaccacacagaaagcagcaggtgagggtggttggaattaggaggacaccaactgaaatgcactcatacataaataaaagacaaaaaatcttctcccagacaaagtgcttagtctgaaccattcttccagtgtgatgagaagcaatgaaagaaaagacagagaaactctaccattatttttttccccatgtagccttcaggatgaaatttgcattatagccaaatccttcattttgaaaacaaatctggtcatttttaagttatttgtgaccttccacacactaatttttaatagggctggctggaaaaataatgagctccattacttcattacacatgtcacctttattactttatccttgaaaacaggttattaaatgattccattttagattaatattattctgaatggagagtttaacattgtctcctagttccctccttacacttacctaattctcctgcacccataactatcatgaactaaatgcaaaggcaggttgtggtagaggcgtttggtctgtctgtggggaggctgggccagcttggtgctgtgaagtgaatgagtcctcagcagcaggtttatgttagtggacttccccagtgaaattccttccctcccaaatcaacaagtcatttaaattacaggagataaggctcactactgtggtgatgactccacaggtaacagaaggattaaacagaggatgtcgggaccaactttctacttgccttggaagaaattgtttgttactcttcctgtatgtttgaagcatatcagagaaacaaaaatgaatcttgggattcttgcagaccccccagctagaggacctctgggtggaggagacatggccagaactggtaacatgaacctggaagttcacctgttacagatcccaggcccacacagggaacactactttgtacacaacacaagagctaggctcagaaggcaaatggaaatacagtggttgggccaaagggaaacgtctcgaagagaggccatggcagggaaggcagctgaatgggtatggacaagctcctgggaagggtgctgccctgtgtgaggctgctggccaggggctctctagggtgagacgaaatttgcataaggccagcttcacccaagagtgcaactgtcacgtggacaaagcaaacagcagagtgaaatggtcagggtggagagggggactctcaaggctcagaaggaccaaactgacctttaagcaaagagggggagtcagtggaggccaaggaatctgaaagagaattaccctgcttgactacagaaccaaggatctctgtagactcagggaggtcacgaatagctgctgggcagaaatgtatgttggcttcaggtcagaggaaccacactgggaagcaggtttggggctggctgaagcatttcccagaggtgttgctaacctaaaatacctttgttaaatgaagtttagcctaaagctgcctccttacatatttaagtttggcctaaaggtttttctgtacatcgataactatacaacaagcggaagtgtaaaccaaccatagtttacatttgtgccaaccactgagtcttggccaatcagatgtagccaactgttcggaccgtgttcaaataaggcaaacgccgagctctgaccaagccagtagtttctgtgcctcacttcggttttctgcacgccactttccttttgccgtccataaatcttcttccaccacgtgtcggcgctggagtctctctgaatctgctatatgattctgggggctgcccgattcacatattgttcactgctcaagtaaactcctttcaatttaattcagctgaactttttcttttaacacctttaaggcaaaaagtcacttttgcttagggcctgtccaggcatgtctgaagtatgagaaaggaactgaggtcctgttctccttactagaatctgaaaacatatccactttgctatggttttatatttctggcattacatgttatgtcctcttaatttcttcagagagtccagctgtgtctcagctgaaccacagacaggtgctgtttcactactcagaaagaacagagaggggagaagagtttatttccaaagaacttttatatcctagtgtgggtaagaatttcttaaggagcttgccaaaatgcagacttcagggctccatttctagaggtaggtaccctgatgtaggagctagtcacactgagaagcatttctctagaggctccacgaaggagggcagagaattgaagagtgtctacaaaggtacatccactaccagcaaaccattcttccagagacatagcactagtgttttaagtcaagggaaataaagatgtagtgttttagttccagaattaagaggcaaagaatggataaagaagtctttttttttttgtcagttaaaatattcaaaaattggccaacagttttcccactttttttggcaatatgatttatccataaactaaatcgatttaaaaatcttagtaacacacaaaaagtacccagaaatattatctcacatgaattcctcaaaaaatgtgaatgttctttgaattaatgctgaatcctaaattattcttcatataatgtcagatatctgaaaaattcacttcaatttcctgccctggcagaaatatatgagggatcatttgaaaagctaatcacttcagaagtaattctataatttgtcaaaaaggaaaaaagacatctggcaaaatccaggtgcagactaatgtgatgtaaatccatgttttttcttctattttttttttttctgggggtggggaggaaaaactaaactaacaggcatattataaaacttctgcaggttcctttttttttttgaggcaaggtctcgcctctgttgcccaggctggagtgcagtggcatgatcacagctcactgaaacctggaactcctggattcaagcaatcctcccatcttagcctcccaagtagctgggactacaggcacgtgccaccatgctcagatgtgttttttgttgttgttgctgttgttgttgtagaaatgaggtcttgctaagctgcccaggttggtctcgaactcctgggctcaagagatcttcctgcctcacctcccacagtgctgggattagaggcatgagccatcactcgcagccaggttccaactttttcagcatgtgcctcagccacaactggagagagatgtgacaccactcaggttcactggtaatgctataatggttttgatttttaaaatggaatatccttctttcaagagactgaagaataaggaaggtttttgcttctctaaacatgtggtatcatttgcttgatgacttcatttcttgacacttgggaaaaggtgactaaatcctttctttactaagaatgaaagaatgtgaccacattttcccctcattctgtgtttgctccagactaagaaagattcagataagatgttgcaggggtggtgggttcacaaatgatgtattggtaataaagcagaaatgttttgtaagggcatgggtgatggctatctgctcccaaactgtgtcacctgccttatcagagggagtctcacttgggttcctcaagcttacaagcctctttgaggaattctcaaactaaagatctatcccatgtgtctagaattagctaagacatttctatgagtatttacaaccagcacagtaccagggaatgcattactgattgtcagacagacttattggtaaatactggagtctctaattgcacagatcattaaaaaatttatggctactttacatagtactattacaatggcatgagaataaattggttccatgattacttctataaaagcctaaattgattcctgttcttgcactcacactacctttgtaaagctttgaccctttcctctctctctcttttaaaaaagatcctgtgtctatctagcttttgctccatgtgttgtggttgtttttatcctatctcaactctactttgcaatgctggggcccagagttgcaaacgatatcccataggcctcttgactaggtcctgtcagtcaaggcattgcaggagttggatgagaaggtggcaggaggacagaagctgctggctttctgctctcatttatctttcttccatttcagggcagtgtctctggaggtggctatgttcttgcactatcccagctcttcaggtagcatcctccgccactgtcccttctccaaggcggcagcaggtatcgtggcagagctcatggtgggagctgcctcctgcagttatttacctgagtttctggaatttcccccttcagtcttccagcctccccacattctgtaaccaattccctttgaaattccaagtgtgttttccatttcctgaaaggactctaacaaagcactccatgatggctttttgtcaaaaacatcatgccctttacagtgagacttatgcggcagctgcaaggtattagtgtctcaaatcacttggttattttatttcaacaaatgttttatggggcttactatgtgccacaaggtataaatgctttctaattgttatttcatttaatctttataacaactctgggggcagtagtatagtaattcacactttacaaatgaggaaactgaggcacatgacgagcaagtaacttgcccaatgttagatcactagaagtggcagtttgagagctaatgtcctaagggatgatttagcaagacgcatgagcatctttacccaccaccatctgaggtggtgggggtaggaaggtctgtttgcaaggcaggagtcagcagattaagaaacataaaagaacaggctgggcgtggtggctcatgcctgtaatcccagcacttttggaggctgaggcgggcagaccaagaggtcaggagatcgagaccatcctggctaacacgttgaaaccccaaaccccgtctctactaaaaaaaaattagccgggcgtggtggcacgcacctgtagtcccagctactcgggaggctgaggtaggggaattgcttgaacccgggaggtggaggttgcagtgaactgagatcacgccactgtactccagcctgggtgacagagactctgtctcaaaaaaaaaacaaaaaacaaaaaaccataaaagaacaaagagtctggagaggtcgtcttcaatgtttagcatcaacgagtgcatcatcctactaggggctgtgtagccctagactggtgtctaggtatggcaggtagctgcaaagttcacagcaggtaacacagttgtgctgtctttcccttgagattagggttaggggaatggaatcactaggaagtttttgcaactagctgttctcctttcattttgtaaatattaaagattcctgctgaccttgctgtatcaacagaagatataggattttctaaacccagcaggaacatatctaataaaagtcttttctcgatgattacgtagtgatttggagtccacctggagagttggaaataacaacttgaggaaatagctattttaggtttcttataaatttaaattaatgttaaatttttaaagtgtttgaacattctgtctctaacatctttgaagatgaaaatcctcactcaaaatcccatggaaaaagaaaaggcaaaaagatgaagacgagaacttgtatggatgtcaccaaatttccattaaaagcatcatctaaaacttatcatctgaaactgtatattctatatcagtgctgtagctggaagtcatgcctccactttttagccatgtggtcttgagaaagttacctcatgttgctaagcatcaatttcctcatgtgtaagatggagaccgtaaatataataactttacagaattgctgtgagaattaaatcacttgatatgtataaagggcttaacatggcccttaataaggtccaataattagctgctattgtattcgattattattggtggtttgaagtaggactaatattatgatagaaaagttgcctttgcaatgctgtttttaataagcaaaattcaccaatagctggtagaacaaatactataggtagacattaacgtaagcccattggctgggtgcggtggctcacacctgtaatccctgcactttgggaggctgagcagggtggatcacttgaggtcaggagttcgagaccagcctggccaacatggtgaaactccgcctctactaaaaatacaataactagccaggagtggtggcgggtgcctgtaatcccagctactcaggaggctgtggcaggggaatcacttgtaccctggaggcggagcttacagtgagctgagatggcaccactgcactccagcctgggccacagcgcgagactctctcaaaaaaacccaaaaaaccaaaacccaaaaaccaaaacataagcccacaactttgcctgctagaaatattttagttattaagcagcaaaaaaaaaaaaaaggtctcaaacacaggaccagaactcatgttaggaaaaaaaccaaccaaccaaccttgtatgtttttggaggctatgatgcaggagtggtacagtggaaaagacaagaggcttagaccctagagacctgtgttcaactgaagtcctactaacacgctcggatataccatgtaaggtttctgcatttccattttctgatattttagacaaatctaaagaaagatctctaaccactgggatggctctacttgcatgtctataaaccttagtggtaagcaatttgtggggaagggcttctggttagagtgtttccacccctgttctaggtttatgacactgtaatggcaggaagaagagggcacaagactgttagatctgatggattagcctctgagatctagaatgttggactcatcatttagggagcctttgccaattttccctctacgtgtaaatgaccagtggctttttctctgacatttttgcccttctcacaatactgcaaatgtctgcagggtgagcccaactgttagaaatagccaccaaccaaacctgagactggatagagtggtgacactggtaagacatctttgatggggaaagcataggtgcactggaatgaagtgtgactttcaattccttatgcataaccagagctttggctttgctaccaactacgcaggaaatcatgaaaatattcataagtgtaacctatttctacaacattaaatgaaattgttcttaactttgaggtaaaacacatttgcctctatatttcttagtgctcaatttatacctctttttaaaagaacagacttcttactagtaaataaaaatgcaagtatcaaaaattcagaacttaaatgttgctagttaactaggaagcaatgcccatgacagtttctctttattcctatgatctgcatgctctaacacaagactgcacagtgcaacttgtgaaaatatgtactcccaatcagtaggttagatacatacttttaagatgatactatttttttttctttccttcctagccaatttttggagtacattaaaaaaagaatgggttgctatcagagtttttgaagttacaaagaataatcctttaaaaaaaggaataattctaagagacagcagtttcccactgcagtatataatttaggtgtggaggcatccaggcactaatcaataccttgccaacttaaggattctaaaaagactgacagaatgacaactgctagttgaagtatttgcagcttattttagcacagatacatataacataatgtcaaaatcggaaaacagaccactttgcctgaacagaaaaatgattcataaagagaaaaatctcacatgtaaattataacatcaatattcaacatattttctttttctttcttttttttttcttttcaatgcattttctttccaggctctctggattaggttttgaaactcagttggccagatgagatttagagtagtgtctatttattgccacataggactaggtgggctctaaaggaaaaaatgatagaaacaaaaatatgacaattttttcttttgttttggtttgttggtgaagtttgccagttgaataatgagggttgggcacagtgggtcagggaaatagggatattgactcctgggagttctcaaactgttgtctttaagatttttttagcaccttcatgcctcttttccttatgatttccctaagtctgtgattaagacccgaggcccttctgtcagcttcttgtacacatcaaggctaaaagcagacatacctacaggagcaggcaggtgacagcacagatgaatgaggaagagggtggtcacctggggtggtctcaggttttcccctccagctgataaatgccaggaggaaacagagccaaaattatatggtgacgaagacactgatattgcaaaagaatctgggtattttagcgaagttgtttggtttttaaagggtggctcattgaaacaacattctaggctcactgaaatgcgtttgtctgggttgcatctcattggcaggcaccaacttgactgtgggtcctgctacagtgctgctggtggctcagtttggtggcatgttccaggatggatttcctggtgccagcctggagcccatgcccactgcctttccacagactttgtaggcacccaattccctagattaaattcctttctggttaagattaagtggtttcttgttcttgcaagtgaaccttgattgatagtgaaatataagatatcaaattgcattttggagatacagtgccaaagaagattaaaacaatgcacttgttttaaataaatatttaaaagaaaggaaaaatatcatagataactttttattttccccctccaaatctatatgctagtcagtatcggtgtaaataaaagcatcaagaatgacagcacagctctgggagcatgcggaggtggaacatgcagaggtagcttccaggatggccaggaacgattgggagtcaggaggaggccctgccaggccccgggaaaaccttatgaatacccaagagtctaacacccctggtcaagagactggatacttaccaccaccaccaccaccaccaccactgctaccaaaacacaaaacaaaacaaaacccttttattgttggctgaaaatctcacgaaatgattgaagagcacatccgattatatgccccaataattatcatgacagcaaacggtaagaaatcaccatggcttcacatgagaattgtttttgaccttgctaagaacttcctgcaaccttccagctatcttttgagctgctatttatatttgagagcaaaagaactttatatagacccatgtgttcagctgcaccaaacagacaggaaaggccgttgcttgactaatttacataccaggtttaaacatttgacattactactaagtattacacattaatttaagtcattttaaatttctccaatccaaggaaactgaccaaatcaaataactttgtatagtttagatgagttaaataatttttaatagagccttatttgttggcccttagagcagaacagtgcaaactcaggcccagctaagatttgcggctcaccttgctacccacttgatctacttttctggacctagactggccgcctaacctcctgcctacctaatcttgtatctagctgagggaggaggaaacagcaacaaaaaagaattcctatagcaggtccgactagcaaactttaacttaccaaaagactaagctagactctatggatatccatatattaaaaataaatctaccttattgattcctcttcctggaaatcaactgaactgctagcctggagatggaaaatgacttaaagcgtaaggaattcttcacctgcataaatctgatcttgattattgagagctaggtttcaacaagaactagtctaacatttaacagataattgttattttacttattttttaaaatttgtttctatttttataacacttcatagaacttataaaacagtgcttatataaaaattcacacaaagttgctagagagcatacaatttccaaaaatcttataggttacatgagatattttgattacaggcatgcaatgaataataatcatatcagggcaaatggagtatcctgccttctgcttctgatgttgtgtctccttctctgattctcacctttcttctgtcttccccttacaagaaccctgtgattatattgggcctatctggataattcaggataatcatcccatttcaggatctttaatttaatcccatttgtaaagtcccttttgccatataaggtaacatattcacaggttacaggaattaggatgtggatagctttgggggagcaattattctgtttaccatagtcactaagatcacacataccaaaagagaatattacaatatctttgcagctacctgtgtaatattaactaagagtgctcactctgaagaaacccattcctaaaaaatttactaaaataaaaatgatgaaagatttgtcttcttccattgagccaagtatataatttctacatgacataatgatcaactgtaaagaaaaatcatgagggttttccctccaatgttcttttgccacagtaaaaatcaagcatgttctctctccgacctatgaggcagatgacaggcacatcctggttgttagagacgtgtcctcattcagagatactggttcaggcctgatgttgatgtggtaacagcctgatgggttatttgactgcactaagtattacctgtttgaatagagtgtaggcctgtcgtgtggatagtgctcattgacgtataaggaagaagatgaaattgtggttgccaaggaagcagcttcaaacagtgatggagtgctagggaccaggtctggcctgtgtcgggatcccagggctaggaacgaaagcaacacacacattcatgaatctcaaggataaatgcagctttagtatctataataattgaaatgagtcaaaagcattcattttacctatcaggctgcaaattcaattatgaattaactgcacttttt

SEQ ID NO: 1008 - DNA, 15070 bp, Homo sapiens; identical to SEQ ID NO: 1007

SEQ ID NO: 1009 - DNA, 15070 bp, Homo sapiens; identical to SEQ ID NO: 1007

SEQ ID NO: 1010 - DNA, 15070 bp, Homo sapiens; identical to SEQ ID NO: 1007

SEQ ID NO: 1011 - DNA, 2191 bp, Homo sapiens
ctgctgtcttgcagtttgatctcagactgctgtgctagcaatcagcgagactccgtggttgtaggaccctccgagccaggtgccggatataatctcgtggtgcgccgttttttaagccagtcggaaaagcgcagtattcgggtgggagtggcctgattttccaggtgttgtctgtcacccctttctctgactaggaaagggaactccctgaccccttgctcttcccgagtgaggcaatgcctcgccctgcttcagctcgcgcacggtgcgcgcacccactgacctgcgcccactgtctggcactccctagtgagatgaacccggtacctcagatggaaatgcagaaatcacccgtcttctgcgtcgctcacgctgggagctgtagaccggagcttattcggccatcttggctcctccgttccctctatgagtccaaccaggatggcgacttgactggattttacagtttcattgacacgcatgagctctatcaaacttctgggagtttttctgaaatgtttacatggaaggcacctggagcccattgaatttccctcttcaaatgcttaagttttcttctgtcttggtggctactgcctccttctcactttctgccttaggtcaagataaatgagtttttccccaagaaagccatatggatctctgaggttttgaactctaaccaatgctatctcgttgattgcctttggatttcagggtcttattttacgtcaacctcagcctctctcttctgcagttccatatccacatgagctacaagagtcccatgtaggtcccttcctctgctaatagctgcctcattgtactgcttctgtattcacttcagagatagaggatcaaatggtagaaacttttggcaaacttttgaccagagaatggcttacatgggaattaattatgcacttgttcgttttactctatagaacaatcccatctgtattggatctgtatgttccatctcccatgtgaaagaagcaccctacaaagataacttcagtctgggcacagtggctcacacctgtaatcccagaactttgggagcctgagtggggaggatcttttgagcccaggagttcgagactagtctgggcaacaaagagagaccctgtttctaaaacaaaaataaaaacaaagatatcttccgagcctgttcagtctttggtcctggtttagatataggtatatagagagagctatttgagtaatcaattcccaatatggtatgatttgagcatttggagaggtcttctttacatatcatagtacttagattattaccaataaatatttttcttttggggttaacattacagtaataatatattttgaatctaaaatttggatggagacacaggacacagaatatataatgctcaaaaaatgtaatgctcaatgaatgtctctatcatattcttttttgttgttgttgttgttatatagatgaggccttcctatattgtccaggctggtctcaaacacccagctttgcctccttatgtgccaggaaaacaggcctgagccaccaagactctcaatatattattaaaatataaacaaattacttgaagtggtacccctcaaaataatgtcattttcactttaatgtaaattagtcttactataaaatcactttcctgctttcaacaagttgcaatgtaagacgggacattttctgaaatggagagaagataaacatgaagtaagaagctttgtccccagcaggcttttcctggcagaaaatatggacatctgggtggtgtcatagtcaggaggccaggaggaaggatttgccaaaatgggtaaactgggcagtgcatgaaaactggtgcctttgctcctatgggccatcatcctgttgatagtgaggtaccaagagaagtgctgatggtaaagccctgtgtcctccccatccatgatcttggccgaaagcattaacctccgaagagtctcggtgcttttagagacttcctggtctgaagtgactgcctgttgtggacaaaagctgaaaacaaacaacataaaaacaaactaaaaaggtcagttactcaaggatctagacaactagccaacacctccacaaacaaatgggagcttaatagactttgcaaaattactttttatccagttgtttttttttgcttatttaataaagttgaaaatacaatgcagt

SEQ ID NO: 1012 - DNA, 2191 bp, Homo sapiens; identical to SEQ ID NO: 1011

SEQ ID NO: 1013 - DNA, 1292 bp, Homo sapiens
gggggagggggatccctgctttagttgaaaggaggtgagtccttatataaatagaaactaacaagaggaatcttcagaaagtgggaaagccagtgaagctcgacaaatgacctcggggaaaacgtcagcattcctcaaaacccctcccagcacagtagtgcactcccagctccctgagggcctggctctaagtctgaggaaacacactctctctcgaacttgaacttgccagagagaactcaggcactgactgtgacgacgcgggtggggagagactgtgcacctacacgtgtcacttcacaaaggcctccaggggcttatgatcaggcaaaggagacaccaggaaagaggagcagagtggctagggcagtgcactgcagatgcatggacgaaagctcgcagcgacacaggtatggggtgtctaatcagggatgagtgtgagcagcagaatgaggagcatgctttcccagaggaagagaggaagccactggagagatgaaggatgccatggacaggaggtggtgtctctggagccgccgagcagcagcctcattgctcagaagatgaagatgctgacgaagacccagacaggaaaaaaggaagaaaaagcatcctgattgttccattagcaaagccacagtcccggagagcaaggggaggggcacagcaggcagccgcacccatgggatgcatctgcagcttgtgagcaatgcatgaaagatgaatcacacagcagcaatgccttcagcttccgtgtgctatggctcactcagcaccagctctgcaggctgcctaagccagaagtcagtctctgcctttagacttgctcacttcttttaggaacggagatatcctctgatcccttgtcctacaacctcgattaatatctttccaacagccatctgccaaactcaagaagaccctggaacaacctaattggaaaagtttccatcttatcccttggaaaactatagaaaagtagtgtcacacaaatgtttaatttctgatttctacaatttcagataccagagtttatctgttaccatgacaactaacagctttataaatgttttctagcctctgctattttctggaacttatctacatttcagtatttgcttaataattttgagctgacactagcaacataattgtgtctggattgtgtatgtgtatgtcttgtgtgtgttggcagggggtgggtataacctatgtcagtgtttttcaatgtgagcaaattttaataaacttttatatttaatgtgaacattaactgtcacattccctctgcc

SEQ ID NO: 1014 - DNA, 1292 bp, Homo sapiens; identical to SEQ ID NO: 1013

SEQ ID NO: 1015 - DNA, 1292 bp, Homo sapiens; identical to SEQ ID NO: 1013

SEQ ID NO: 1016 - DNA, 8539 bp, Homo sapiens
gttcactcacagacagcaaaccaaggggttgtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagagacggagtctcactgtgtcgcccaggctggagtacagtggcatgatctcggctcactgcaacctccacctcccgggttcaagtgattctcctgcctcagcctcccacgtagctgggattacaggtacatgctgccacgtccggctaatgttttgtatttttagtagagacagaatggtctcgatctcctgaccttgtgattcacctgcctcggcctcccaaagtgctgggattaccagcatgagccaccacacccagcctgcaatttattttttaatagatatccatcctagcgttttccaggacctgaaagctttcatgaaaaaataaatgtattaaatatcttctatgtttgaggagctgtaatagatttggggaatatagaaatgttgcaaatgcttaattttcagtctagtatcctgtaaaatgttgtgtttctggtaatgcttgggagattttatcattttggaaatgcttttgcttaattagattcgctagtgttctaggagccaaggattcacagactgcacttttaaagggatgatattttcacatttccttagtacagttcttttagtaacaatatttatataaaaattattatgacgtgtgagtcataatatttgttttaattctcaaattacctggtaaccactgttaatagtttggtatataaacactaagagagccagtaagtaatttgttgtatttacatttgtacttttctctgtgctattacacacacttacacacacacacacatacacatctcacatgtacataaataggttaaaatttatatcctttcttccaaggaaaatgagattatcctatagacaggtgtctgaaacttgcttattcacctgtgagtacatcacaagtatctcttcaaattaatacatgaatatctaactcactatttttaatagctgcaaaatatttctcagtatgggaagagcataatttattcaatgatctcgctactgatggacattcacatttaaattttgtctgtttttttttaacccctataaacgaaactacaataaacattcatgtgtgcacacacatacatggtatatttttgtggatagcctctgtagctgactcttcaacatccactcccagataaacagtcaaagccaaggataattctatccctttgttaacgattggtgataaatggacaaatgtccatgataaatggacccagttctggacagtgaatgtgaggggaagttgatcatggaagttgtgagatatgattcataaaactgcttcaaggccgggcgcggtggctcacgcctgtaatctcagcgctttgggaggccaaggtgggcagatcacgaggtcaggagatcaagaacatcctggctaacacggtgaagccagtctctactaaaattacaaaaaattagctgggtgtgatggcccatgcctgtaatctcagctacttgggaggctgaggcaggagaatagcttgaacctggaggcagaggttgcagtgaaccaagatcgcgccactgcactccactccaacctgggcaacagagcaagactctgtctcaaaacaaaacaaaacaaaaaaaaacacctgcttcaaacaccatgttccaactcaaagataaaaatgacaaggagggtaaagaaaagagaaagagccgggatactcaatgacattttggcacactgaattaaccaaccttagcgtctactctgttttctgggcttcctttcaggtgagagatacatttcttactatttaagccaatttagtttttctgtttgttatagcaaagaacacatcctatcagacatacctcatgtatagttttatttctgtgacaaaaatttccaaaagagggtttgctgtatttttactgtatttgagtctgacagattacaatccaaaaatactgtaacaatgcatacttctatcagcaatggtatataggaatgcctattttccccatactttcacaaggaaaggaaagtatcaactatatgaattgtaattcagtttcaagtaataggtaactaacccaaaggggcttaaatttaaaagggaggttatttggctcatataactgaacagtccaagagtagatgtgtattcagatagggcttggttcacaatatatgtgaatcaatccatggaacagaagaattaatgcaggacaaggaaaaagaaatatataaatatataaaaatatatataatataaaatatataaatatataaatatatatgtgcacatgtgacaccactattttaaatttttcccaatatatgaaaaatatggcattttactagcatttttctaagcaaagttagtcgaagtgagatttgaatacaaatcaaatgactcagaaattcttttacctataccctgtattatatccttcacatcagctccatttgaaatcctgaactatagaaagccatgaaagaaataaaatactgtctagcagttctatgaagattacaaaagatttagaaattctgcctgggaaaacttagtgatatgctaaatttttacagcctataaaataatgtatcttctcaagaacaattaagggtttaattgttgccttttgttgaggaagaatcatggaaagatattgagtagcaggcagaggaaaggaatcaaattagagccagaaggaatcagtttagtcacaaaaattctgtttctcaacagaaaaggtcccacacagggctgggtgtagtaggtctgtgttgcttgtctgccctgcaccctcctccggttcacatggtcctgatggaattgtgaaagattgcctcatcatcctcaactcgagagccatcatgtgacccaggccaaccaatcaatatgccccatccctctggtcatagtgaatggttctaagatgggcatgtgacataagtggagcccattagaatcctccttaggacttttctgccagagtaattagaagagaatatctcttttccattggggttgatagcctgtcatcttcatgaagccagctgtagccctgaatttccaattcgtgtggtcaacaaatttcttattttgccagggttgctttgttcagttttctgttctccaacaaaatgtttttaagcaatattgtgggtcactcacaagtctgttgttgctccttcttctgaggctattaatatgagagaacttatgtgcagaaggaggatggtcaaatgacacctctagaggttggttgcatctcatcagggatctgtctgatggtggatgtaatggaaataaaagagaatgcagggctggtgtgattctcacttcaaattcccagaaactcattcattgaccccacattctttaaatacgatttcagaactcataggtgagacatatttaagtgatttacaatacataatgaataaagctataatctttttttcctttgagaaaaaaaagaaaagaaaagttgattcctatttacaattattcacacaaaccagattctggaccaagtgtcaactgctgtgtgattagccaaaagagtacttcttaaacagtcctttctaaaactcagctagtcaagccaatttatccatcaggatgtgagttggaagccaggctatgatggttagaaccatagccaaattaaagcctttctgagagcctttgtaacttggggtttgaagggaacagaaggagctgaactgagctctaacccgaaggtgtttagattctatggagaaggagaataacgtcagactatgataagaatggccaccatttgtggagctgcttctacaggctaggtacactgcacgttttatcccatttaatcctcacaacgattttgtaaaggaggcatagttaacccatgagtattcacatggggaaactgaggctcacagaaatcaaggtttgtccagagttacataactggtacatgaaggatctaggcgtcatgttcagttctagcttgtccaaggtctgtgctttgggtctcttccctaaactccatgtttttctcacagcgttatgtggccatctacagctgagtttattaagttttgacttaaggcattccttccggaactagatttctagccaagacctctgaaggaatcagattgcatccacagttactacagtatttcttggtcttctcttccagaagggtgttcttctagaggaactgtttactgacttgaaatgctgttataaaatctcagttcaaaggttgtgtatctcccaggaaacaaatggcttttttattcttcgccactagcttaacactgcattatagctgctcataacaagtcatggtatgctaatttatgagtcacatgacacagtcaattcatattatagacattgccctgattatatgtctccttaactgaaatgtttacatagttgtgatggaatcaattttattaattttacagcattcacaggtttctcctcttcccaagactgccagagagatcctgtaattacctgcccggtttttcttcttaggagacatgagaaaagaatagaattcctccaattattttctgcttgtttgtgcctctgtaaatttgactcttctcagagatgaaaccacctgggacacagcttctttagagttgcacagtgacacctgcaaatagttagcagtgcaccaggtacagaagcacacacacctggtggcagggcaagatggggtgattcctggagccagatcatccctgatgtgttccttgcagtgttatcagggggattacaggaaataacatacacaaaaaactgtttcttaactgcaaagcactgtgcaaacgtgagctgttaagccaggtggtgtgtgcaatggagatcaccttttgccggggggtaatcatttcagtttacataacacttatcactccaggagccccaagcccttgtgaatattatcctgagaaatatcacttgaaatgaaatgcgcatgcataaacagagtctagcaaatggaggcaccaattatgatgacaatgacgaaggtcttaaatgagaacataaacattttgacatgtcagctcccaaggatgttgccactgtagtcacaacaccttctgagggaaaatcaattctcaacgttaatgtttcccatgagtgttgactcctcgggggatgggggaggaagagggaaacaaaagtggaaaaacattttaaaatatgaattttattttccatagcagtatatcagaaaactcaaatataactccacaactttttcaagagtttctttttgttttccaatggtaacgggagagaaaataagctgtcattatcggaatgatcaaacacagagagaaaagaggcagaggtgagaagatggagaagatgaatacatttgctttcagcaaaccaatggaagtccatttgcatgatctgaaaaggaaaatgagaagctaatttttctatacaaggcagaatttaagaaatacaattcctaaggactccagtggatacagctctggttcctggacttcgtgttttggcttggtctttctgctttttcaattttgtcactggtaagactggccccacctcacccatgaggagcacattttcaaggttaaaatgctgagttaattagagaaagtggtgttattaactgaatggcaatagagaagcagcagcaattgagggaaaggagatgataagttgttttggggcatggtgaatttgagatatcttgcagaacattcagatcaaggttcttatgacccctgaagttgtcacgtgttaaccagaaaacagatctgccaggtgcggtggttcacacctgtaatcccaacacattgggaggtcgaggcgggaagatcacttgaggccagaagttcaagaccagcctggccaacatggcaaaaccttgtctctactaaaaatgcaaaaaattagcctggtgtggtggcaggtgcctgtaatcccagctacttgggaggctgaggcatgataatcatttgaacctgggaggcaaaggttgcagtgagccaagattgcaccactgctctccagcctgggcaacagagtaagagtctgcctcaaaaaataaaataaaataaaataaaataaaataaaataaaataaaataaaataaaataaaggaaaagaaaactgggatctgagctagggcatcaatcaagtttagtctggtagatttgattagaggataaaattaaagtcttaatcttttataaaaccatcaagggataaggtaaagagttttttctaaaaaaaaaaaaaaaaaaggctgtttcagtcaggccacagctagattatgctacagtaacaaacaaccccaaaatctcagtgacttaatacatgacagttttatttctcatccattctttatgtcaagagctgactatgagttctgctcagcatcatctcgccctgggatttgagctgatgagcaaaccacccacctggaacattgctagtttctacagcagaaaaaaaggaggatctcacgctggcaattagatattctagcccagatatgacagacattatcttgctcatatatcaaaggccaggagtcatcacatagccccactcaaccaccaaggaggcaggaaatatcatccaaccatgagtctggaaaaaggcgtgctgccatcagtgagccatgttaataactactttaaggcccagggcagaattcgtataaacatgctgcttcagagatgtaagaactaagagttagcatagaaagaagttaatgaaagaaccatcagacataggaggaggaccaaaaaagcaagagtcatggatgaccaggaggaagaagagacagtgaagaaagatgcaagtgatcaatgcagtagtttctgataggaaggtgcaccatgcacagttaagacagacagatttaagaaggccaaccagctgtctcacaaggggagcttcaaaatggcactcatctccttgatggatttctcaggatcgcagtttccttgcctcagcccaaccctaacaccacatctaaccttagttattatgatgcacacgtggggttgcctgttgccactgaacattctaaatgtctaatccaaactctcttgctctggtgtcattcttattaagcaaactactgtttatggtttggcttcccttgaatatctatcttcggtaagagaaaatgttagtcatacagacttagagcatttcagaccacatgacaactccactattaattggattccagagaggctttcaaaggaagtcgtggaatcttctgtggcaataacaaccattcacattcactcccggagatgtagactttcttgtggccttacagattgatcacagccatcaaaggaggaatgaacacgtttcctgaggcactctatttacatactcagggtttttcatcaatcatgtaaaagagagttacattttcaggtcaaagtgactcatcaagccagaggggtgagtcatggaagacatatgacgctttccagtttaacctgctgtgcgactatgaacacctgtaacagtcatcttgccataaatctctccctgacctttctgtgacaagagaaactgctaccaaatcctgaatcctacctgtatagtaagaaatgatttcagtgtttattgcagaaatcttctatttggagaatttaaatttaaatcaaattcagaggcaaattcatatcttactttagaagtaaagcaaatcattggaaaaagcactgggggagagagattgagatagagaaagagagagattctctttcaatcagcaattctgtgtctattagtttttcttgaaataagcaagtcttgaaagatgtatgtactgggtgtttattgcagtagattgaatattacgaaaatattgaaaattatccaaaaatctaaggctatgaaacttaattatggaatattcatacaatgaaatattatgaagtcttgaagaatgataggaaattgtgatatattgttttaaaagttgtatcttcaataaatagtgaaaagaggaagatatcagaaaaacctacagattaaaagagacttatgaaacttttttttt

SEQ ID NO: 1017 - DNA, 8539 bp, Homo sapiens; identical to SEQ ID NO: 1016

SEQ ID NO: 1018 - DNA, 6408 bp, Homo sapiens
tcggtcactgcacatctgttattcagttcactcacagacagcaaaccaaggggttgtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagagaaaataagctgtcattatcggaatgatcaaacacagagagaaaagaggcagaggtgagaagatggagaagatgaatacatttgctttcagcaaaccaatggaagtccatttgcatgatctgaaaaggaaaatgagaagctaatttttctatacaaggcagaatttaagaaatacaattcctaaggactccagtggatacagctctggttcctggacttcgtgttttggcttggtctttctgctttttcaattttgtcactggagctacccgcaggaggggcatctttctccagaggcaaagcctgccttgttctggtgttgcctgaggctgatgggcaagttggtcaaatcccaaagtttagttgataagaactgcacttgcttgaagatagaagctatgctttcccaagtagcattgatcaataaggagctacctgcaggtagcaggtatgttggcctccatctgctgactgcttggctttatttctcaattggctcaaaaattgaatggagaaaaggagtgctctttattggcccccttagaaactccacagtggtcctctcccatcagcctttgttcctgaggtcccagaatgccttgtggccgtgcccatatttcttggcacacataagctctttctgtctttcttttttttcttgagacagagtctcactgtcaccaggctggagtgcagtggcacaatctcagctcactgcaacctccgcctcccgggctcaagcggttcacctgcctcagcctcccaagtagctgggactacaggcacgtgccaccacacccagctaattttggtatttttagtagagacggggtttcaccatgttggccaggatggtctcgatctcttgacttgtgatccgtccacctcagcctcccaaagtgctgggattacatgcatgagccaccatgctcagccattagccctttttaaaagaagaaaaaccgactggcaaatttattttattctaatccctttattctcaatatgtacatgtaataatcataacgtttacacaattgagccccttttatatgttagatattgtacatacaaatagcaaatagaccttggaaaacaagtgttattatcactttacagatgaggaaattatgtcctaacgtgtttaagtaacttgctcggggtcacaaagtgactgagccagttgtcggatgccaaggcccttgctctttccattacaatttccctcccttccctttatctttcctccacccccattcttccaatcttcctttctcttctctctcttgccctctcttctgccgagccctgtatgactaccattcctcattgccacattttctagccctttaacatgtcagaaaattgaagaagcatttgaaacctcagatatttcagtatatttaaaaatatctacaaaatcttaccccagcagctgggcccctaagaagcctggcagcaagcagtaggaaaactgtggctgtgtttttaatatcctcctcaggtttctcaggaggaatgtccagcatcccattcgaggtcctgggggagaaggtcacaaagaaaccagtacatacagagagagaggccacaggacttcatcaagctggggtctgcccaggcatgacctgggagctgggccctgtgtgaaaaatgcagcctttcctcagatggaatgtgtgcccgtcacctctgaatcaaggtttctttccctggggtcaatagttgtgtaaatagctcagggactgagcaaacagtttagcaattacttggggaatgactgagagaagaagaaaatatgtacatatcatgcattctcaatcaggtagtattgcccccaatggggtgaaaattggttcttgagaactcaaaaaaatacacagtatatctatgatattaaaatttcatagaggggttgattaagaaaaacatgtcttaaccggctccttaggagagcaatgatttttttaatggttgaaaaacatagatgaatataaagaacttaacatagcatgtgacacatagtaggtattcaatacatgagaaatgtagttgctattatagtcattagtcgttattatgattgttctacaaactcattagagaaatcatccagacccatcatagttagggcagagaaggttgtgctgtgccaagttcacagatgaagctagcttttggcggattttgcctgagctagaggtcagaactgcccagggttctagaaaacagaaagattcttgcacactgctgggatgagcagaaacatttgtgtacacagtgttaaaataaaatttaaaaagtggggcatggcatgaatgtttaggctgtgttcagactttcacaatgcctgctatcatcctctggggaaaggacatgattaaggcatgaatgtagggttggggaaaatgctgggcaacttctcatacatgctgcatgtgctctgcaggtttgtaaaaacctaaatatctaatgaatattgtttttgtttttggtttttttttttttttttttaggcagagtcttgctctgtcaccaggctggagtgcagtggcacaatcttggctcactacaacctccccttgccgggttcaagcgattttcctgcctcagcctcccgagtagctgggactacaggcgcccaccaccacgtctggctaatttttagtattttagtagagatggggtttcagcatgttggcaaggatggtctccatctcctgacctcatgatccgcccgccttggcctcccaaagtgctgggattacaggcgtgagccaccgtgcctggcccccaatgattattcttaaaacctatgtttgtatgactctcagtgtacaaatgtacacttatttaagtgtaaattaattaagtgtaattaaataaattttaaaatgtaaattatcaacaattgtggaaagcagtgtagtgattcctcaaagaactaaaaacagaactaccattcgacccagcaatcccactcctgggtatatacccaaaggactgtaaatcgttttaccataaagacacatgcatgtgtatgttcattgcagcactattcacaagagcaaagaatcaacctaaatgcccatcagcagtactctggataaagaaaatgtggtgtatacacaccatggaatgctatgcagccataaaaaagaacgagatcatgttctttgcaggaacatagatgaaactggaggccactagccttagcaaaataatgaaggaacagaaaaccaaacaccacatgttctcacttatgagtgggagctaaacaataggaacacatggacatgtagaggggaacagcaagtactggggtttacttgagggtagaggaggggagaagggagaggttcagggaaaaaaaaaatgttgggtactgggcttagtacctgattgacaaagtaatctgtacaccaaacccccaactcaggagtttacctatataacaaacctgcacatgtacccctaaacctaaaataaaagttaaaatattttttaaaaagtggtttcccatataatatcttatgaaatcatcataataaccctgcaaattcagtattagatccctacctgaaggatgaggaagcagaggctcagagtcctctcagttatttgttctttttagctacccagtagtaagtatcagagcaagctttatttctaccgtactccaccacctctttaaaatccctttcccacagaggaggaggacataggaaatgctaaagctatggagcaaaagccacatattgggacttggggactccctggtaagggatacgatagtgcctgtaagtggacataaccaaaccatgtaagaagtgggtattatgttcatggagtatgaatctagcatatggcagaacctactgaggctggtcaaagtcatctactgccaagttatagggaaatgaaaacccattaaaatagaatatggaagcatcacaaggtgctgtgaagctcaggacataaaagacttaggagcacattgagaataaaaatataatatgaaaaatcaatgactaggtacacagttggtgctggagtttattttaaggccatagcttcaaatgtaggaatgatggctatttggctaagagtggagagaatttttcaaagactgaaaagaatgtgtttagtcagagactaactcatctggccagaagggctgtaaatggaaaacagatgggaaaggagaaaaaaacacctagataaaactgaaacgggtttccatggatgatattaaggagggcctgggaagaatttcaacagtgagggaggtgccgcatagttcaatgagaaaacagctgggaaggacatcagaaacaaaacataggcagcagatgtccagatatcatgcacagaacatgagcaacgtggtaaccttgagattacagcacagggtgacaaacaagacctcacagataccactgagagttggcgggctggaacagatccatgggaacatagtgatagaagggtgtgctgtgtacaaaagacctgttgagaggaggagaagctgcactgtaggctgtgataacaatagattgagaggaatctctgaacacttggatgaagatgaaaggacagaggaacacaagtgacgtttttgtggaagcacagctgagccacatggaggaaagccacaaaattggcacagtacccacaattaatgaggataagattcaggatacttcattcagataaaagcagaggttttcacttgcctctctaacaattttatgtcctagaaggtagaggaaggaataaaaacaactgtgctctgactgattccaatccttaggaagaagccacctggcaaagtggaaaggatgagaactagagaatgtgcctgtcatcttcaggggagagcctgatggagctagaacaaaggtggatacaggacttcaggaagttagactccaaaatattttaagaaaatatggcggccaggcgtggtggctcacgcctgtaatcctagtactttgggaggctgaggcgggcggatcacaaagtcaggagatcgagaccatcctgactaacctggtgaaaccctgtctctactaaaaaaaagaaaaagaaaaagaaaatatggcataattccacaagtttctagaaaaggaaacagtatcaacaagcactcaaaagcatggctttggataattccaatgagaagacaagagagaaggggagactctcaaagaaactagtgatggcagagccctttaagcaaggacgtagaatggatgttcaaaaagatggaggtgtgatccagagaacatgcctttcactgtgaaaaccagcaccttcaaggccaggcgcagtggcttgcgcctataatcccagcatattgggaggccgaggtgggtggatcacctgaggtcaggagttcaagaccaacctgaccaacatggtctactaaaaatacaaaaattagcccggcatggtggcgggcgcctataatcccaggtactcgggaggctgagacatgagaatagcttgaaccagggaggcggaggttgcagtgagacgagatcacaccattgcactccagcctgggcaacagagcaagactccatctcaaaaacaaacaaacaaacaaacaaaaacaccacacaaaaccagcaccttccacagtgtctagcatacgttagtcaccaaaacaggtttgctaaatgaacaaatgaatgaatggcattttatgtgtcagtaaatatgcttcaaaatcatgatgtatgatgagtaagcaactctatcaaataaatataacgtaatttgctgtgagcacataatttgctgtgttctagtattgaacagttggactatttccatattttaatttttactattatgtttgaggatgatatataaatctt

SEQ ID NO: 1019 - DNA, 1265 bp, Homo sapiens
tcggtcactgcacatctgttattcagttcactcacagacagcaaaccaaggggttgtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagcagtatatcagaaaactcaaatataactccacaactttttcaagagtttctttttgttttccaatggtaacgggagagaaaataagctgtcattatcggaatgatcaaacacagagagaaaagaggcagaggtgtgatccagagaacatgcctttcactgtgaaaaccagcaccttcaaggccaggcgcagtggcttgcgcctataatcccagcatattgggaggccgaggtgggtggatcacctgaggtcaggagttcaagaccaacctgaccaacatggtctactaaaaatacaaaaattagcccggcatggtggcgggcgcctataatcccaggtactcgggaggctgagacatgagaatagcttgaaccagggaggcggaggttgcagtgagacgagatcacaccattgcactccagcctgggcaacagagcaagactccatctcaaaaacaaacaaacaaacaaacaaaaacaccacacaaaaccagcaccttccacagtgtctagcatacgttagtcaccaaaacaggtttgctaaatgaacaaatgaatgaatggcattttatgtgtcagtaaatatgcttcaaaatcatgatgtatgatgagtaagcaactctatcaaataaatataacgtaatttgctgtgagcacataatttgctgtgttctagtattgaacagttggactatttccatattttaatttttactattatgtttgaggatgatatataaatctt

SEQ ID NO: 1020 - DNA, 1265 bp, Homo sapiens; identical to SEQ ID NO: 1019

SEQ ID NO: 1021 - DNA, 13258 bp, Homo sapiens
gtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagagacggagtctcactgtgtcgcccaggctggagtacagtggcatgatctcggctcactgcaacctccacctcccgggttcaagtgattctcctgcctcagcctcccacgtagctgggattacaggtacatgctgccacgtccggctaatgttttgtatttttagtagagacagaatggtctcgatctcctgaccttgtgattcacctgcctcggcctcccaaagtgctgggattaccagcatgagccaccacacccagcctgcaatttattttttaatagatatccatcctagcgttttccaggacctgaaagctttcatgaaaaaataaatgtattaaatatcttctatgtttgaggagctgtaatagatttggggaatatagaaatgttgcaaatgcttaattttcagtctagtatcctgtaaaatgttgtgtttctggtaatgcttgggagattttatcattttggaaatgcttttgcttaattagattcgctagtgttctaggagccaaggattcacagactgcacttttaaagggatgatattttcacatttccttagtacagttcttttagtaacaatatttatataaaaattattatgacgtgtgagtcataatatttgttttaattctcaaattacctggtaaccactgttaatagtttggtatataaacactaagagagccagtaagtaatttgttgtatttacatttgtacttttctctgtgctattacacacacttacacacacacacacatacacatctcacatgtacataaataggttaaaatttatatcctttcttccaaggaaaatgagattatcctatagacaggtgtctgaaacttgcttattcacctgtgagtacatcacaagtatctcttcaaattaatacatgaatatctaactcactatttttaatagctgcaaaatatttctcagtatgggaagagcataatttattcaatgatctcgctactgatggacattcacatttaaattttgtctgtttttttttaacccctataaacgaaactacaataaacattcatgtgtgcacacacatacatggtatatttttgtggatagcctctgtagctgactcttcaacatccactcccagataaacagtcaaagccaaggataattctatccctttgttaacgattggtgataaatggacaaatgtccatgataaatggacccagttctggacagtgaatgtgaggggaagttgatcatggaagttgtgagatatgattcataaaactgcttcaaggccgggcgcggtggctcacgcctgtaatctcagcgctttgggaggccaaggtgggcagatcacgaggtcaggagatcaagaacatcctggctaacacggtgaagccagtctctactaaaattacaaaaaattagctgggtgtgatggcccatgcctgtaatctcagctacttgggaggctgaggcaggagaatagcttgaacctggaggcagaggttgcagtgaaccaagatcgcgccactgcactccactccaacctgggcaacagagcaagactctgtctcaaaacaaaacaaaacaaaaaaaaacacctgcttcaaacaccatgttccaactcaaagataaaaatgacaaggagggtaaagaaaagagaaagagccgggatactcaatgacattttggcacactgaattaaccaaccttagcgtctactctgttttctgggcttcctttcaggtgagagatacatttcttactatttaagccaatttagtttttctgtttgttatagcaaagaacacatcctatcagacatacctcatgtatagttttatttctgtgacaaaaatttccaaaagagggtttgctgtatttttactgtatttgagtctgacagattacaatccaaaaatactgtaacaatgcatacttctatcagcaatggtatataggaatgcctattttccccatactttcacaaggaaaggaaagtatcaactatatgaattgtaattcagtttcaagtaataggtaactaacccaaaggggcttaaatttaaaagggaggttatttggctcatataactgaacagtccaagagtagatgtgtattcagatagggcttggttcacaatatatgtgaatcaatccatggaacagaagaattaatgcaggacaaggaaaaagaaatatataaatatataaaaatatatataatataaaatatataaatatataaatatatatgtgcacatgtgacaccactattttaaatttttcccaatatatgaaaaatatggcattttactagcatttttctaagcaaagttagtcgaagtgagatttgaatacaaatcaaatgactcagaaattcttttacctataccctgtattatatccttcacatcagctccatttgaaatcctgaactatagaaagccatgaaagaaataaaatactgtctagcagttctatgaagattacaaaagatttagaaattctgcctgggaaaacttagtgatatgctaaatttttacagcctataaaataatgtatcttctcaagaacaattaagggtttaattgttgccttttgttgaggaagaatcatggaaagatattgagtagcaggcagaggaaaggaatcaaattagagccagaaggaatcagtttagtcacaaaaattctgtttctcaacagaaaaggtcccacacagggctgggtgtagtaggtctgtgttgcttgtctgccctgcaccctcctccggttcacatggtcctgatggaattgtgaaagattgcctcatcatcctcaactcgagagccatcatgtgacccaggccaaccaatcaatatgccccatccctctggtcatagtgaatggttctaagatgggcatgtgacataagtggagcccattagaatcctccttaggacttttctgccagagtaattagaagagaatatctcttttccattggggttgatagcctgtcatcttcatgaagccagctgtagccctgaatttccaattcgtgtggtcaacaaatttcttattttgccagggttgctttgttcagttttctgttctccaacaaaatgtttttaagcaatattgtgggtcactcacaagtctgttgttgctccttcttctgaggctattaatatgagagaacttatgtgcagaaggaggatggtcaaatgacacctctagaggttggttgcatctcatcagggatctgtctgatggtggatgtaatggaaataaaagagaatgcagggctggtgtgattctcacttcaaattcccagaaactcattcattgaccccacattctttaaatacgatttcagaactcataggtgagacatatttaagtgatttacaatacataatgaataaagctataatctttttttcctttgagaaaaaaaagaaaagaaaagttgattcctatttacaattattcacacaaaccagattctggaccaagtgtcaactgctgtgtgattagccaaaagagtacttcttaaacagtcctttctaaaactcagctagtcaagccaatttatccatcaggatgtgagttggaagccaggctatgatggttagaaccatagccaaattaaagcctttctgagagcctttgtaacttggggtttgaagggaacagaaggagctgaactgagctctaacccgaaggtgtttagattctatggagaaggagaataacgtcagactatgataagaatggccaccatttgtggagctgcttctacaggctaggtacactgcacgttttatcccatttaatcctcacaacgattttgtaaaggaggcatagttaacccatgagtattcacatggggaaactgaggctcacagaaatcaaggtttgtccagagttacataactggtacatgaaggatctaggcgtcatgttcagttctagcttgtccaaggtctgtgctttgggtctcttccctaaactccatgtttttctcacagcgttatgtggccatctacagctgagtttattaagttttgacttaaggcattccttccggaactagatttctagccaagacctctgaaggaatcagattgcatccacagttactacagtatttcttggtcttctcttccagaagggtgttcttctagaggaactgtttactgacttgaaatgctgttataaaatctcagttcaaaggttgtgtatctcccaggaaacaaatggcttttttattcttcgccactagcttaacactgcattatagctgctcataacaagtcatggtatgctaatttatgagtcacatgacacagtcaattcatattatagacattgccctgattatatgtctccttaactgaaatgtttacatagttgtgatggaatcaattttattaattttacagcattcacaggtttctcctcttcccaagactgccagagagatcctgtaattacctgcccggtttttcttcttaggagacatgagaaaagaatagaattcctccaattattttctgcttgtttgtgcctctgtaaatttgactcttctcagagatgaaaccacctgggacacagcttctttagagttgcacagtgacacctgcaaatagttagcagtgcaccaggtacagaagcacacacacctggtggcagggcaagatggggtgattcctggagccagatcatccctgatgtgttccttgcagtgttatcagggggattacaggaaataacatacacaaaaaactgtttcttaactgcaaagcactgtgcaaacgtgagctgttaagccaggtggtgtgtgcaatggagatcaccttttgccggggggtaatcatttcagtttacataacacttatcactccaggagccccaagcccttgtgaatattatcctgagaaatatcacttgaaatgaaatgcgcatgcataaacagagtctagcaaatggaggcaccaattatgatgacaatgacgaaggtcttaaatgagaacataaacattttgacatgtcagctcccaaggatgttgccactgtagtcacaacaccttctgagggaaaatcaattctcaacgttaatgtttcccatgagtgttgactcctcgggggatgggggaggaagagggaaacaaaagtggaaaaacattttaaaatatgaattttattttccatagcagtatatcagaaaactcaaatataactccacaactttttcaagagtttctttttgttttccaatggtaacgggagagaaaataagctgtcattatcggaatgatcaaacacagagagaaaagaggcagagatttggcttctggcttgctctctttgtttgggtagctaggcatgaaaaagaatcatctgcaaccagagctcaacttaattcccagttcctctctggaaactatctgttggcatcatgaaatgttctgtgtaaaaggccatgctttgactgatcaaaagtgggatttcagaccctccatcagagtctttgtggatgaaactcagccaattctcggaaagtgacagaagaggcctgcacctctggcataatttgcgtctccccagcatctcactgttcctgccaatgacaaacaggaacccccgacaatttttcctctctctcctggcaatgcaatgatggcccagctgttttctcactataaaaaggcagtcacttctctctatcactacagtctatagcaaaaggtctacttacattactgattgaacaaccatgtatcatatgaaaaaccacaaaagaaattcacaggagaggctctaagattgctgatcattttatccacatcccagtgtctacatctgagcatggtgctcggtagatattgcatgaatgaaggacaagaaatttggaaaaatactgcattgtctactgttttcagaaatatttatgcagggtaattttaatgtctgccattttcccttgggtcagggaagccactgtatgatattataattgctttgatttgtatcgtgttacctactaggttcaagacacattcaggagtgttctgaaaaacataatagaaattgacagaaaaaagtgactgaatagactttcagaaaatatgaaagattgaatacagaagtttgttttcccttttccaagcccctctaaaatgacaggaaaaataaaaataaaacatggatcccccaaaacaaaggaaacagaaagggaaatgaccacagatgatagacagccacaaaattttggacatggcaacccaagaggagagagggatgaggctacaggaggaggagtcaaccagaagaagcaaaccaatttatagctcagaatccccagaaagtgtcaggaattgaggatgccagctgcctctgaaggcaaattgaaaacaagacaatcaattaaaaatctttgtaaggagtaggcaaattctgaggtctcctaatcaaccctttgtggccaggtagccaactctccctactccagcagagcaccaaagatgtcctccctggagatgtggatgaataggtattccagacttgggaacaccagacacagctgaggtaccacaattaaatggagaaactaagcaaaaaatcacattataaacaaaaaatctgacccaactccacgcccttctttatgtcaattctcagaaatactgcattgtcattaaagcttagaactgtagacaggagagagaaaactagtcataaataactagaaataagaatagcatcatcttctcaatagcaacaacggcagcttgatctcaatttactctgattcaatcccaccctcacacacctcaaaatacttggttctgtggctttgacttcatgcatagactcctataaaatactagtgcttgcctcttaaagcatagcatatccatccagcccctgtgaccaaagaaatggtcttggctctcatcctaaagagatattaagaagcagccttaacaaaggaaaagaccagcatggattgtgcccctagaccttctattctttggatagtactttacccttaattccctgttctcctcttttgattataacctaattggcaactgtagcagccaatctcagatatgttcttgatttctgcaatgtagccaaaggcggatttcatcacattctcctttttttactttttgctggtgatggaaggagcaattggttcatgagcttggtttgatgattaaataaatggcttggtgacatttggagtgtcagctttccagatctgcaatcaccacaaaactgcagacacagataacgaacctggggtggagttgctgggttcagagaccatagattggatattacctcaccattagaacatcagtcttgatttccctttcttggctgcatttagaggctagatgcccgctcctccacaactatgtaatggagacaagaaggtggtacaaagaaagtccaccacagtttatggagcctgcagaagccagtgtgcttgacacacactgtcatcctgttgttgcaagtattctttttatagtggaggaggaggacgaagaggaggagatcacattttaaaaagaatgatctcatctttttaggtgagaagatggagaagatgaatacatttgctttcagcaaaccaatggaagtccatttgcatgatctgaaaaggaaaatgagaagctaatttttctatacaaggcagaatttaagaaatacaattcctaaggactccagtggatacagctctggttcctggacttcgtgttttggcttggtctttctgctttttcaattttgtcactgattccagagaggctttcaaaggaagtcgtggaatcttctgtggcaataacaaccattcacattcactcccggagatgtagactttcttgtggccttacagattgatcacagccatcaaaggaggaatgaacacgtttcctgaggcactctatttacatactcagggtttttcatcaatcatgtaaaagagagttacattttcaggtcaaagtgactcatcaagccagaggggtgagtcatggaagacatatgacgctttccagtttaacctgctgtgcgactatgaacacctgtaacagtcatcttgccataaatctctccctgacctttctgtgacaagagaaactgctaccaaatcctgaatcctacctgtatagtaagaaatgatttcagtgtttattgcagaaatcttctatttggagaatttaaatttaaatcaaattcagaggcaaattcatatcttactttagaagtaaagcaaatcattggaaaaagcactgggggagagagattgagatagagaaagagagagattctctttcaatcagcaattctgtgtctattagtttttcttgaaataagcaagtcttgaaagatgtatgtactgggtgtttattgcagtagattgaatattacgaaaatattgaaaattatccaaaaatctaaggctatgaaacttaattatggaatattcatacaatgaaatattatgaagtcttgaagaatgataggaaattgtgatatattgttttaaaagttgtatcttcaataaatagtgaaaagaggaagatatcagaaaaacctacagattaaaagagacttatgaaactttttttttaatgggggagacaagttctcactctgttgcccaggctggagtgcatagtgtgatcatggcttactgcagcctcaacttcctgatctcaagtgatcctcctgcctcagcctcccaagcagctgggactataggtgcacactaccatgtccagccaggaaacatattaaccagttgcaatgtactgcattgccctcataagtctaagcatgcacacatacagaatattaaggaaatgtaaacactgaccaattattgaattatactatggaatttttataattatttttaagtgtgataatggttttttttttagttctatattttagagaaaaaatactatgctgattggagaatgtaaagatatagatgaaacaagattgaggaagtttgaaagtttactatacacttctctctacttatgtacatgttgaaaatgatccatttgttaaaaggtttttttaagttataaaacagtgtgtatactgtgaccctatttgttaattattttaatatcttttttcttattcttctataaaagacatgacaatattttgaggtaaaaatactttttacttattcatgtatttattttttgagatagggtctcactctgtcacccaggcctgaatgcagtggcatgatcttggctcactgcagcttctgcctcccaggttcaagcgattcttctgcctcagcccctgagtaactgggattacaggcatgagccaccatgcctggctaatttttgtatttttagtagagacagagtttcaccatgttgcccagactggtcttgaactcctgacctcaagtgatccgcccgcttcggcctcccaaagttctgggattacagacgtgagccaccacacctggcccaaacatactttttataataaataagtaatttgacaacttgaactgatttactctagccattaatctctcaaaatttgctgttttcccattatatctaatatactactgagtttacagttcataaactattaaaaatgacagcgtgagatggactcacatgttgtctcaaattaagatcttctattatcataaggcccatccatcagttgtgaggtgacttttatcctgtggccagggagcctgataattcatgcctggggcaagcaaggagatcaggacaactcacgcgaaaccccggactttccagttttcatacaaagctggactttcataaacaaaacaaggaaagaaactgagcatcttaacaggcgaatttaggggaaaaaacaaacaaacaaacaaacgtcttttttatataaatgatttgagtaatttagaaaaattttaagggccattttgcctaaattaataagaaaatgtgattgctccaggtaccaattttgctcttttaagatggccgggtttacctcagctctcagaaaaaaaaacaaatcatcccaccgtaacattttcacactcctaaaataagctttaaattttatttatttatttatttatttatttatttttgagacaaggtctctgtttcactcaaattgagtgtagtggcatgatcgtggctcactgcagcctctaactcctgggctcaaatgatcctcccaactcagcctcccaactagctaggactgcaggcacgcaacaccacatctagctattttttttattttttgtagagatggggtcccactgtgttgcccaggttggtctcaaactcctagatgcaagtgatcctcctgcctcagcctcccaaagggctggattacaggcctgagccaccacacccagccaagttttgagtgggccttcctgaaagtgaaagtgaaagtgactgtgtgcatatacaatggaattggaataaattaaatgtaatgaacttctcacatcagcctctgttgatgggtgggctgtgctatgtacttgctcttgcttaaagacccaaccacacatcctgtgtgcaggaaagacagcagtttggaaattgcaggactgtgattctgctcatgccctccaaggctccaaactgtttgactagaaaattctgctttgcttctggtgttggtctccgcttgctaggtctctcaactgcaggccctgagccctatctcaggtaactaagttctgccccactcaacttctgagtccaagttcatcatctgtccagagtgagtctttgccacaccagagtagggtggagtgggccttgctaccctgccctgtagccagatgggtgctaggtctggaggcttctcccctgaccccttgtcattcacaatagcacctcgggacttctgttttggttttctgaatgttcccctggcccatacccagggggaagcccacagtctcagccccctagaagtggccccttttcatcctgtagtaaccacaggctgaggtctgattcccttcataagggaccacctgaaactacactgccccctcctggatgccattcctcttgctatgacatccatgcaagcaactggccgcccccctccacatgagacacccaaaaattttcttgggatgggattgaactctaatttgctatacctgtaaaacataattaggaccgtagggtatgcctcagtggtaatacagaagcaggagccgactgataaattttcaggatttttgcaagttggactgttaaacacccccagtattaaaatttgagtcatataaacttttaattaatctatactaaaaataaaggtcatactcaaaactcatcacttcttatcttactacattttactactgtctatgctctgagttatttacattgactgtagtgttatttgtatgactgtagtgttatttgtatggtggaaattactccacttatcaaatcatggttgaattgcaaccatcggttggctatggagacaagagttcagtaaaaatcaatgaaagcattctgtgagagtcaattggccatatgggacttaaaataagggtattgcatattttattattatttataaatggcatgctactcatccttttttgtatcaataaaatttataagttgatgtattttattttccaaagagcctattgttaagcatttcccagcacaccactgtatcccatctaccggactgtgagcccagttctatggtctcatccacaacttcggttctgctcacctcctgcactgactttgagactgttggagaacaggaggctcatacccaacccactcttaatttatctcatccatgtggcaggacatccattagcataacacacctggcttcggctccccgccacactcctctaggcaaactgacttacccggttggtgaatttggaagaaaaactgtgtcatatatagcttagcttttttccttttcttaggagctacccgcaggaggggcatctttctccagaggcaaagcctgccttgttctggtgttgcctgaggctgatgggcaagttggtcaaatcccaaagtttagttgataagaactgcacttgcttgaagatagaagctatgctttcccaagtagcattgatcaataaggagctacctgcaggtagcaggtgtgatccagagaacatgcctttcactgtgaaaaccagcaccttcaaggccaggcgcagtggcttgcgcctataatcccagcatattgggaggccgaggtgggtggatcacctgaggtcaggagttcaagaccaacctgaccaacatggtctactaaaaatacaaaaattagcccggcatggtggcgggcgcctataatcccaggtactcgggaggctgagacatgagaatagcttgaaccagggaggcggaggttgcagtgagacgagatcacaccattgcactccagcctgggcaacagagcaagactccatctcaaaaacaaacaaacaaacaaacaaaaacaccacacaaaaccagcaccttccacagtgtctagcatacgttagtcaccaaaacaggtttgctaaatgaacaaatgaatgaatggcattttatgtgtcagtaaatatgcttcaaaatcatgatgtatgatgagtaagcaactctatcaaataaatataacgtaatttgctgtgagcacataatttgctgtgttctagtattgaacagttggactatttccatattttaatttttactattatgtttgaggatgatatataaatctt

SEQ ID NO: 1022 - DNA, 3327 bp, Homo sapiens
tcggtcactgcacatctgttattcagttcactcacagacagcaaaccaaggggttgtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagagtttctttttgttttccaatggtaacgggagagaaaataagctgtcattatcggaatgatcaaacacagagagaaaagaggcagaggtgagaagatggagaagatgaatacatttgctttcagcaaaccaatggaagtccatttgcatgatctgaaaaggaaaatgagaagctaatttttctatacaaggcagaatttaagaaatacaattcctaaggactccagtggatacagctctggttcctggacttcgtgttttggcttggtctttctgctttttcaattttgtcactggtaagactggccccacctcacccatgaggagcacattttcaaggttaaaatgctgagttaattagagaaagtggtgttattaactgaatggcaatagagaagcagcagcaattgagggaaaggagatgataagttgttttggggcatggtgaatttgagatatcttgcagaacattcagatcaaggttcttatgacccctgaagttgtcacgtgttaaccagaaaacagatctgccaggtgcggtggttcacacctgtaatcccaacacattgggaggtcgaggcgggaagatcacttgaggccagaagttcaagaccagcctggccaacatggcaaaaccttgtctctactaaaaatgcaaaaaattagcctggtgtggtggcaggtgcctgtaatcccagctacttgggaggctgaggcatgataatcatttgaacctgggaggcaaaggttgcagtgagccaagattgcaccactgctctccagcctgggcaacagagtaagagtctgcctcaaaaaataaaataaaataaaataaaataaaataaaataaaataaaataaaataaaataaaggaaaagaaaactgggatctgagctagggcatcaatcaagtttagtctggtagatttgattagaggataaaattaaagtcttaatcttttataaaaccatcaagggataaggtaaagagttttttctaaaaaaaaaaaaaaaaaaggctgtttcagtcaggccacagctagattatgctacagtaacaaacaaccccaaaatctcagtgacttaatacatgacagttttatttctcatccattctttatgtcaagagctgactatgagttctgctcagcatcatctcgccctgggatttgagctgatgagcaaaccacccacctggaacattgctagtttctacagcagaaaaaaaggaggatctcacgctggcaattagatattctagcccagatatgacagacattatcttgctcatatatcaaaggccaggagtcatcacatagccccactcaaccaccaaggaggcaggaaatatcatccaaccatgagtctggaaaaaggcgtgctgccatcagtgagccatgttaataactactttaaggcccagggcagaattcgtataaacatgctgcttcagagatgtaagaactaagagttagcatagaaagaagttaatgaaagaaccatcagacataggaggaggaccaaaaaagcaagagtcatggatgaccaggaggaagaagagacagtgaagaaagatgcaagtgatcaatgcagtagtttctgataggaaggtgcaccatgcacagttaagacagacagatttaagaaggccaaccagctgtctcacaaggggagcttcaaaatggcactcatctccttgatggatttctcaggatcgcagtttccttgcctcagcccaaccctaacaccacatctaaccttagttattatgatgcacacgtggggttgcctgttgccactgaacattctaaatgtctaatccaaactctcttgctctggtgtcattcttattaagcaaactactgtttatggtttggcttcccttgaatatctatcttcggtaagagaaaatgttagtcatacagacttagagcatttcagaccacatgacaactccactattaattggattccagagaggctttcaaaggaagtcgtggaatcttctgtggcaataacaaccattcacattcactcccggagatgtagactttcttgtggccttacagattgatcacagccatcaaaggaggaatgaacacgtttcctgaggcactctatttacatactcagggtttttcatcaatcatgtaaaagagagttacattttcaggtcaaagtgactcatcaagccagaggggtgagtcatggaagacatatgacgctttccagtttaacctgctgtgcgactatgaacacctgtaacagtcatcttgccataaatctctccctgacctttctgtgacaagagaaactgctaccaaatcctgaatcctacctgtatagtaagaaatgatttcagtgtttattgcagaaatcttctatttggagaatttaaatttaaatcaaattcagaggcaaattcatatcttactttagaagtaaagcaaatcattggaaaaagcactgggggagagagattgagatagagaaagagagagattctctttcaatcagcaattctgtgtctattagtttttcttgaaataagcaagtcttgaaagatgtatgtactgggtgtttattgcagtagattgaatattacgaaaatattgaaaattatccaaaaatctaaggctatgaaacttaattatggaatattcatacaatgaaatattatgaagtcttgaagaatgataggaaattgtgatatattgttttaaaagttgtatcttcaataaatagtgaaaagaggaagatatcagaaaaacctacagattaaaagagacttatgaaacttttttttt

SEQ ID NO: 1023 - DNA, 849 bp, Homo sapiens
atgtgcttctgtccatcatctgggtcatatatagttcaatgcgagctgagcagacagggctgcaaggaaatctggcgcggttcaatacctcgtctagcctgggttccagtatctaattttttttttgttttaactgacaaactcatttctctactgggacaggatgctgtgctggctggaagttccatttctacagcaagaatcctatctggaaacacagaagttgtcctctagccacagcagctcgaacttttttgattgtcgttgctgctttctcccatcacccccatccccttttgacaaagatccaactgtaaaaagtcttacgtaacagttcaggactacttcggttcttttactggatgcagaatctacctacattcggctgaaaatcagatggaagaatccacagaggaaaggaaggaaaggcgaactgtcctgtggaaagcacagctgcagggatagtagaaagtaacaggctctcgatccgtgggaggtggtcactttggaggacagataagtcatcctcagagaacgaacacaatgaaggaaattccagcctattcatgttctcctctcaggctgtacctcaacaagatccaactggactttgtgatctcataacctgtcaaggggcctggcatggagtagataataaatgttttttttaatcaaatgaatttttaactttttttatcaaacgaattttcttgtaatttctagcacaattatatttataacttaggaagtaatcttctccttgaaccaagcacaggataccttcagctatctatctgtcccacacattgcagtttcagcctatatataattttaatagctaccaaatat

SEQ ID NO: 1024 - DNA, 922 bp, Homo sapiens
atgtgcttctgtccatcatctgggtcatatatagttcaatgcgagctgagcagacagggctgcaaggaaatctggcgcggttcaatacctcgtctagcctgggttccagtatctaattttttttttgttttaactgacaaactcatttctctactgggacaggatgctgtgctggctggaagttccatttctacagcaagaatcctatctggaaacacagaagttgtcctctagccacagcagctcgaacttttttgattgtcgttgctgctttctcccatcacccccatccccttttgacaaagatccaactgtaaaaagtcttacgtaacagttcaggactacttcggttcttttactggatcatataaatctttcgccttttaaatcatgtattaaaaaaaaagaaaaaggaaaaacaaagatttcttttagatgcagaatctacctacattcggctgaaaatcagatggaagaatccacagaggaaaggaaggaaaggcgaactgtcctgtggaaagcacagctgcagggatagtagaaagtaacaggctctcgatccgtgggaggtggtcactttggaggacagataagtcatcctcagagaacgaacacaatgaaggaaattccagcctattcatgttctcctctcaggctgtacctcaacaagatccaactggactttgtgatctcataacctgtcaaggggcctggcatggagtagataataaatgttttttttaatcaaatgaatttttaactttttttatcaaacgaattttcttgtaatttctagcacaattatatttataacttaggaagtaatcttctccttgaaccaagcacaggataccttcagctatctatctgtcccacacattgcagtttcagcctatatataattttaatagctaccaaatat

SEQ ID NO: 1025 - DNA, 922 bp, Homo sapiens; identical to SEQ ID NO: 1024

SEQ ID NO: 1026 - DNA, 10727 bp, Homo sapiens
gttcggagcagatatgctctgactcatattttaaaatctctctttggttgctgtgtaaacaacagactggagagaggccaagagcacaagcagaaaaaccagccagggtgctatttcagcagtctaggtggagagtcatggtgacttggacccatccaacagagacgaagacaactaaatggattcaggatatattctagagataacgagtcctaactctttgccaaggatatggcaaagactctgatggaaaaggcagtaatgtgtacacaaaggtgaacataaataaatgtgtgtatgataaacgctgggaatggacatagaaaaacgggtatgcaattggacagagacgacgggagacagaaggaaagatacttgctcagctgtatctaagtaagttcataggagtttcatggtctgaaaaatctgtgacagtggaatttctactaagaagcttaaaaaagtttcaccttctccttggacacttcagaataaggccttcttagaatataatgcattatatcacaaatatacttttatataaaatatttgggaccaaaacaagagtaaagaaccaggatccgaaagggtgaatgcctactaaatatctttgattatctaaagctgtttaaaagctattagattggcacctggaaccccaaaatatccacttttcactgggaaggagtggctgtgcctcttcaatcatcccctaaatgcaaagaagtttgacccccacgcaatggataaaagtcacccaaaaaatgaacaaaagaggtgtttggaaaaaccagaacaccattcatcccagctaacgacttgttcattatgagtgatgatggataaagacttctcatgctgagatgaaatcaagatttatatgcattgtttcctctcccaacttgtgggaagatcatcatcatttaattctatctctgcggccagtgatgggcatccagagagctggttatcaaacggcgcagtcagctggcaaaagccgaaacgtgcagttggcacatctggacggagccgccacagccgagggtgaacaatgactcctggcaagcatccaaattgcttgcagacgctagcaggtctcatctacaaccgcccctaccagcatctctctctctctctcttttttatgagaatcagattttcattgctccattcaattgctctcctctgccattttttacagctcttatcgttcccctggaatatggccttgagacagctcatccgtgtccttcactgtgttatctcttctaacttttattaaaacttcagctttcatctgaagatagctaattaaatctggaacagattatatgcctccccttaaaaagagcacaaaactattttcttcaaccccagcaatgctttttttcctttccaaaaggtaaaatcaaaggtgtttaagaagtctctttatttacagagctaagatattcaacacgtcatatatgagttgatttatattaaagttgtctgtgatatgacaaatctttgagctatttctcaagatgattatttctcaatcctggtatatatcctttaaatatcacagctaatactataagcatattttctatataaagttgggtaatgaggagttaagttattagtgcacatcaagtgatttgtctttttattcgtcttttttttttaaaggttgccctcatttgataaggatgaagagaaatttttcttttcttccccataccacaaatattagtaactaaaagttctcccatgggaaattatgtgaaaacatgaaattaatagcagtgattcaagtttaggactgattcggttttcaagacagctttatatcaactgatcatcagcacaagtagctctgtctgagtctaccacaaattattaatgaaggaacttccacaattgatatgaatacattcttctcacatatgccgctgacccagtccctttctgaggccgaggggcagtgtacaatcaccttttcttgcatagatcagctaaccaaaccttctagcaatgacatctgaaagaatctagccagccatcacacacacacaccccctatgcccttttaataagggttaagcttctactactgtgagaatatgatttaactatcccacctgaaactttctgggatccttttcttcgcttcactgccttcagtaagatttccttcatggtaacctttgtgttgtccacctgaataagggagaatccatgagcagcatttctgtaggaaaagacaaatattaaatcatcaccaacattcatccagagagatgttactgcaatcttcactgtgtttaagcaagttttttttgttgttgtttgttttgttttgtttttgaaatggagtctcgctctgtcacccaggctggagtgcagtggtgcaatctcggctcactgcaagatccgcctcctgggttcacaccattctcctgcctcagcctcccaagtagctgggactacaggcgcccgccactacatccggctaattttttgtatttttttttttttttagtagagacagggtttcaccatgttagccaggatggtctcgatctattgacctcgtgatctgcccgcctcggcctcccaaagtgctgggattacaggcatgagccaccgcgcccggccgtgtttaagcaagttttaaaaatacataaatccattgtggcacaatgtaatatgtatcaccatgctacacctgcggacgcttccgagcggctgccatgtctgtgcagtcaggaatgataagtgaaccacccgtgaatgttaacgatagtgatcattctgagaccacaaggcaatagcatataacagaaggaaaggcttcaagctaatgacaccctttaataaaggtctggtcacttggggtatactgtggatttatcatcaagaaggtaaactaaaactccccactcttctgaaaagcccagtaaagagcatgaatgaacctagggcacgcctctttaaaaaagcagctcatcgttccctttctgcagagccaagagaagccaaggtagtctctgggagcctgcccaaggcagcccagcttctgggctaagaccttccactgttacctgacagctgttacccaaagagctcttggttagaactgttccttcctcatgttcctctaatatatcaaatatttaaaggaaaatacatatatatataggagacagtttaactgctctgacttctaacctaaggagattctgaccattttattggccttgacttttttttttttcctttaatgcccttcttcccccactccagagtagaatcctggcatgaaactttaatgtcaacacatataaggtaataatactaccacagttgtttttgtcattgccacttttgaactcaattcagtctcacaaattctgactaaattaggtctgtgttgggaatgggagaaggagacgaacaaggcaggtccctatccttgagaggcacttagcccactcaagatctcattctcccttgtcctactttgtctaaaggaacagtaggctttggcttggtcactgctggcaagaaacacttcttgagatgctgggcactatctgagctccagctctttatctggttttgggggtcagccaaaaaccttcccattcctcccactccctacttctcctctctgacactactgatatccaaacatctttactgcttaagctcaaagtagtcagcaagttagggattcccatttatagatatatttgctctgtccaaaatcaatcaggaacaatggatagcttaggaatccacttgaagatttgttaaaagaggcagtttccattaccaggctcctaatttgcaagttgttagaataatccattctccttccctgaacaacaactctatccaggggattcctggggcccaggggttctagagggaaagctagatagatctagtcctgatttagtaagaacatcagaagacatccaatttcacgttccctccacagaataattttccaatgagaaattcattaattagttcccctttaaaaaatgtaaataattataaaatataattcacaacctttgcatgatggaatgaagacaaatttaaaaatttcttttatatgcagaaacagatctatttcccaattttgctataatggacacatattaattatataataaaaaataactcaaaggaaggttaaaccccattctcaccttagtgtaaattattcccactgagaatccctgacagaaataacaatagcaactatgtaacacttcctacatgccagagtctcagctaatattaataatcacagcagcatttcctgaggttcaagagcccccaggaatcaacagatgaatttacagactaagtttcagaatttaaaaacctgttttctaacggtgatgtgagcctctagttccagctactcaggaggactgtctgaacccaagagttccagtccagcctgggcagcatagtgagacactgtctctaaaaatttttttaaattaaaaacaattttgattttagtcaatgaaaagcatatagagatgtattatctatacatatcaatatatgtatgatatggatgtgtagctatatatatctatatgtgcttttcattgaactaaaagcaaaattatatgtgtcaccacatattttatatatgtcactgtgtgtgtgtgggggggtgtatgagataaagatacagatataggcccctcctcactcctcatcttccatgttccccattttccacccacctggggagccctgagccactgcctagaggagaaatacccaagagagtcacctggcctacatcagacaaatgtgaacaagaaataaaattattaggctgggcgcggtggctcatgcctgtaatcccaggggaggatttgggaggtagaggcaggcagatcccctgaggtcaggacttcgagaccagcctggccaacatggcgaaaacccatctctactaaaaacacaaaaattggcagggcatggtggcaggtgcctgtaatcacagctactcgggaggctgaggcaggagcatcgcttgagtctgggaggcggaggttgcagtgagccaagatcacgccattacactccagcctgggtgacaagagtgaaactctacccaaaaaaatgggaggggaggggagggcaagacggaaagaaagaaagaaacttattgggaaaatccagaagttgaccaacaaacctaccccatgcccatttgtctatgtagtctacggctactcacacactacaatggcagtgctgagttacagaaactctatggccaatagcctaaatatttaccatctggccctttgcagaaaaagtttgctgagctagaagcggtggctgaagcctataatcccagcactttgggaagctgaggtcagcagatcacttgagtccaggagtttgagaccagcctgggcaacacagcaacactctatctctacaaaaaatacaaaaagtatttgggcatggtggtgcatgcctgtagtcccagctacttgggaggctgaggtgggacgattgctcgagcctgggaggcagaggttgcagtgagccaagatgatgtcactgcactccagcctgggtgacagagcaataccctatctcaaaaaaaaagtttgccaaccctaggataacgtggcgagatttggggggttatgtgttccagcagctagagttatttaacataactaacaaacttagtaaaagtcaaatggcattactgcaagctgcatacagaacttgtttgctgaacagagaaaaatggtgacagaattcagtgggcacaaagatctctatgaacagtcttgctggtctctgaaaaatctgtgctgtttggtgccaagtcacactatacacaagtatcagtcaggcagagcccacttatgtatagaccaagcaacagataaagtagagtgaccaatctggtttacctaggatggaggaaggggttggaggtgagcatcagggagtgctcatagattcaggactttcagttttgaaacagggagagtcctggacaaaccatcacaaactgatcatactaacagaaagcgtggtgggccaaacgtaaagtagagttttctaggttaggagcggtggctcatgcctgtaatcctaacactttgggaggccgaggcaggaggactgcttgagctcaggagttcaggaccagcctgggcaacacagtgagaccttgtctctactaaaaatagagttagttgggcatggtgacacatgcctgtagttccagctacttgggaggctgaggcaggagggtcctttgagcccaggagtttggggctgcagtgagccatgatcacatcactgcactccagactaggccacacagcaagacacttatcaaaaaaaaaaaaaaaaaaaaaaagcattttctagtaaagaacatttaaaatttatgtgtttgtgtggggggacacattataaatcaattggcccactaaaataatggacgagtagttaaaaatacactgtttaaaaggatgttaatcgtgatgtctcatatgaaaatcaaaagactcaagttgacaagtaaaacatttaacacccaattaaacccaacatcagcaatgtttaatttcagcaaaacatcatctgttacattaaagttgttaatttgtattttattaacgttataattttatctgtatttagtttgtaattttgtttaggttgtgtaaaaacactgaatttatagctaaacattacagaactttgtatttgcatgtatctaagtagcattattaaaaaactcatttggataaacattgagactttaggagaatttatttccctttaaaagagttctgtacataacttacatttaagaaactccctcatgacaattccatgagatagttactgttacccaaattttaaagatgaagaaactgagacttaacaaaggtaagtaaaattgtctaaggtcatgcatgtagcaagatactattgaagctgaaacatgaacccaggtttgcctaaattcaaagtctgtgctgccgcacttagagggaaagatggtactggagccccgggaatagccggtgtgagggcctctaaaggtcagaaggcgacatgggcttcctggtatttgaaaggcaggaacgggtgtaaaaaaggggaagaggtcttagaaagcaaggtgggacacactgctgggtcaggtgtcctcctggcagcccacagacacctgaagtttcagtcattccttctccatgaagccctgtgctgggtgctcaggatacagagagacaataagactgtgccttcctagtcttcaagaagttaatggtcttgctactaactcagaggatgtgtgctcataagaggactcatttgaaagtatgtagatcctcgatgtttacccactgcccatgttcactgaaagttattccaattcagctttttcagtccagctgagcaatgtccacctaaacactacccctcctctgctataaaacaaagtcggagaagaaaaatgtagaagtggcagagatctactcagtaacccattcaagaaatacgtgtgacagatctatcacagtaatggagtgatggtgagtattgtgggcacagataattcagttcttgctctccaagggttgtttattaatagtaacaataacagcagctaacactaagatgatgcgtacatatgctaaacactgttctaagtgcttcagatctattaactcatttaatcctcataactgatctgtgaggtaggtattattatctccatttcactgagccacagaaaagttaaatattcatccaggaccacacacactagtaagggcaaggctaggatcggcatccaagcgatctggctcacagcccaccatgctgtcacctactgcactatagcagtggctgaatgtcagccttaagacagtgagattcacaggttaaaccaacaccagattccccagcctcaatctttcagcagagggttggaaagggcatggactttaaagtcagggatggcgtcaaatccaggcctaagaacaatattgctcaccctcaggttccacgcctctaaattgttcataaaaactgggctattttgggattaagtgagatagcatatgcatagttggcccttagtaagtattagttcactccctatgtcaaacctacttgcctctttctgtttcagcttagtgtcttcccagccacttcttgtccctcctctactgggagacaaatggaaggaggaaaggggggaaatgacgaggaggagtagttacggctttatttattttgctgggatttccttctctgaaactttagacacatccctacagactcctgaaggtctgctctgttctgcatctgtaggagaagctttactaacttagaatatagaccagaaaggcgagtaagaggttgctgaaccaagaaaatacacacagggcaaacggtcagtaatctgtactatttcatcagacgactgagaaaaagaaaatttattgacacttttgttcttaatgctcacatataaagatttcactttacctcgtgttttcagaaacactccagacacatcaaataaactctcttgaattttaaaatagaaaaaggattgactgggctatgtgtgtgtctgggagtgggaacacagggatgggagtaattcaggatcaaaaaacagagtattaagtttaaagcagttgttactctctgccttccccctccttcctattctccagaaggcagggttcatagtgaaacactgtgtagtcttagatgcccctcctggaaaggcatatgaatcctagccccactccactctactgaaaactcagtgatttaaagcctcttgctttaaaaaaggacttctggttcaaaagactgctatgatcatgtgttaacattcatgtagaaaaagttctagtcatattaataatcaataaaaatgcaagtaaaaactatcgaaatgccactgtgtatatcttttagagtagaaaaaaaaacttctaataccttgtaatggtaaaactataaaaatgattttaggaattctgttggtaacattgtaaattaggacatctttcagagggctattgtcaataaaaagtgagtctaaagatgtttttactctgaccaataatcctacttacaaggcatgatcctaaggaagttgttcaacagaataaaaggtatatagataatgaccatcatcatcaaattacttattaaaaccacacaaggaagcaatctaaatattctgtgatcggcttccactacaacccatacacttttcttttatactgcttatcacattttaattatttgacaactgtctcactactagatagtaagctccatgagggtagtgctgtctctgcctagatctctggcacataaatacagactgtaggaattaagaacaaatactgaaacgtttataatttattatttttagatggagtctcactttgtcgcccaggctggagtgcaatggcgcgatctcagctaactgctacctccgcctcccgggttccagcgattctcctgcctcagactcccgagtagctgggattacaggtgcccaccactgcatccggttaatttttgtatttttagtagagacggggtttcaccatgttggccaagctggtttcgaactcttgaccctcctcggcctcccaaatcctggcctgcctcggtctcccaaagtgctgggattacaggcgtgagccactgcgcctgacctaatttaatgtcaagtaaaaataacacaaaaatatgtgtgctacaagtgaaactgagtaacatatacacacgattattatacaagattaaaaatagttaagatggaggcatcattggccaacttttcaattattttaaatatcctttaaagttattttagtacctctgaaatgaaaaagcaggaaaaaatttgctgttatttacaccaaacttgaccttgtagtagggatgaaacggccaccatgaaagcctgagggcccactccccagcttacccccaggtactcagttattctttctttgctcaagggtagaaagagccaaaatactcatatatcatatgtagcataaccctattttctgtaacaatctcaaacaaaggcagtatgttgagagagacagggaaatgtcttctaaagcaatcccttttgagcagtgaatttgctggttactaacagcagggggtgccaaagggatcgctattgttcccaggagacagccatgagaaggactgctgaggcctaggttgaaaaaaagcttaggtttgagagtaaaatccaaatgcagcaggttttcccttaacaactgggacatgtggataaaactcaggagctcataaacttgaatggataaaaactacattttaattttcactaacttctaatattttgcatttccttgatttataagtgtaggcaaacaatcacagcagaatcacagtgccagtgactctgtcatgaacagaagtcatagctaacactacagcacattacagctgttgcagatttctcaaataccatttatgctcatcaccgctttgaaacaacaggcttcaggagttactgttaggtatacagctggatattgtttaatctactagtaaagccacacatattactatatcatgaatttgttcaataatctgataactttaaataacagaatacttttatattccag

SEQ ID NO: 1027 - DNA, 10727 bp, Homo sapiens; identical to SEQ ID NO: 1026

SEQ ID NO: 1028 - DNA, 6079 bp, Homo sapiens
gttcggagcagatatgctctgactcatattttaaaatctctctttggttgctgtgtaaacaacagactggagagaggccaagagcacaagcagaaaaaccagccagggtgctatttcagcagtctaggtggagagtcatggtgacttggacccatccaacagagacgaagacaactaaatggattcaggatatattctagagataacgagtcctaactctttgccaaggatatggcaaagactctgatggaaaaggcagtaatgtgtacacaaaggtgaacataaataaatgtgtgtatgataaacgctgggaatggacatagaaaaacgggtatgcaattggacagagacgacgggagacagaaggaaagatacttgctcagctgtatctaagtaagttcataggagtttcatggtctgaaaaatctgtgacagtggaatttctactaagaagcttaaaaaagtttcaccttctccttggacacttcagaataaggccttcttagaatataatgcattatatcacaaatatacttttatataaaatatttgggaccaaaacaagagtaaagaaccaggatccgaaagggtgaatgcctactaaatatctttgattatctaaagctgtttaaaagctattagattggcacctggaaccccaaaatatccacttttcactgggaaggagtggctgtgcctcttcaatcatcccctaaatgcaaagaagtttgacccccacgcaatggataaaagtcacccaaaaaatgaacaaaagaggtgtttggaaaaaccagaacaccattcatcccagctaacgacttgttcattatgagtgatgatggataaagacttctcatgctgagatgaaatcaagatttatatgcattgtttcctctcccaacttgtgggaagatcatcatcatttaattctatctctgcggccagtgatgggcatccagagagctggttatcaaacggcgcagtcagctggcaaaagccgaaacgtgcagttggcacatctggacggagccgccacagccgagggtgaacaatgactcctggcaagcatccaaattgcttgcagacgctagcaggtctcatctacaaccgcccctaccagcatctctctctctctctcttttttatgagaatcagattttcattgctccattcaattgctctcctctgccattttttacagctcttatcgttcccctggaatatggccttgagacagctcatccgtgtccttcactgtgttatctcttctaacttttattaaaacttcagctttcatctgaagatagctaattaaatctggaacagattatatgcctccccttaaaaagagcacaaaactattttcttcaaccccagcaatgctttttttcctttccaaaaggtaaaatcaaaggtgtttaagaagtctctttatttacagagctaagatattcaacacgtcatatatgagttgatttatattaaagttgtctgtgatatgacaaatctttgagctatttctcaagatgattatttctcaatcctggtatatatcctttaaatatcacagctaatactataagcatattttctatataaagttgggtaatgaggagttaagttattagtgcacatcaagtgatttgtctttttattcgtcttttttttttaaaggttgccctcatttgataaggatgaagagaaatttttcttttcttccccataccacaaatattagtaactaaaagttctcccatgggaaattatgtgaaaacatgaaattaatagcagtgattcaagtttaggactgattcggttttcaagacagctttatatcaactgatcatcagcacaagtagctctgtctgagtctaccacaaattattaatgaaggaacttccacaattgatatgaatacattcttctcacatatgccgctgacccagtccctttctgaggccgaggggcagtgtacaatcaccttttcttgcatagatcagctaaccaaaccttctagcaatgacatctgaaagaatctagccagccatcacacacacacaccccctatgcccttttaataagggttaagcttctactactgtgagaatatgatttaactatcccacctgaaactttctgggatccttttcttcgcttcactgccttcagtaagatttccttcatggtaacctttgtgttgtccacctgaataagggagaatccatgagcagcatttctgtaggaaaagacaaatattaaatcatcaccaacattcatccagagagatgttactgcaatcttcactgtgtttaagcaagttttttttgttgttgtttgttttgttttgtttttgaaatggagtctcgctctgtcacccaggctggagtgcagtggtgcaatctcggctcactgcaagatccgcctcctgggttcacaccattctcctgcctcagcctcccaagtagctgggactacaggcgcccgccactacatccggctaattttttgtatttttttttttttttagtagagacagggtttcaccatgttagccaggatggtctcgatctattgacctcgtgatctgcccgcctcggcctcccaaagtgctgggattacaggcatgagccaccgcgcccggccgtgtttaagcaagttttaaaaatacataaatccattgtggcacaatgtaatatgtatcaccatgctacacctgcggacgcttccgagcggctgccatgtctgtgcagtcaggaatgataagtgaaccacccgtgaatgttaacgatagtgatcattctgagctttttcagtccagctgagcaatgtccacctaaacactacccctcctctgctataaaacaaagtcggagaagaaaaatgtagaagtggcagagatctactcagtaacccattcaagaaatacgtgtgacagatctatcacagtaatggagtgatggtgagtattgtgggcacagataattcagttcttgctctccaagggttgtttattaatagtaacaataacagcagctaacactaagatgatgcgtacatatgctaaacactgttctaagtgcttcagatctattaactcatttaatcctcataactgatctgtgaggtaggtattattatctccatttcactgagccacagaaaagttaaatattcatccaggaccacacacactagtaagggcaaggctaggatcggcatccaagcgatctggctcacagcccaccatgctgtcacctactgcactatagcagtggctgaatgtcagccttaagacagtgagattcacaggttaaaccaacaccagattccccagcctcaatctttcagcagagggttggaaagggcatggactttaaagtcagggatggcgtcaaatccaggcctaagaacaatattgctcaccctcaggttccacgcctctaaattgttcataaaaactgggctattttgggattaagtgagatagcatatgcatagttggcccttagtaagtattagttcactccctatgtcaaacctacttgcctctttctgtttcagcttagtgtcttcccagccacttcttgtccctcctctactgggagacaaatggaaggaggaaaggggggaaatgacgaggaggagtagttacggctttatttattttgctgggatttccttctctgaaactttagacacatccctacagactcctgaaggtctgctctgttctgcatctgtaggagaagctttactaacttagaatatagaccagaaaggcgagtaagaggttgctgaaccaagaaaatacacacagggcaaacggtcagtaatctgtactatttcatcagacgactgagaaaaagaaaatttattgacacttttgttcttaatgctcacatataaagatttcactttacctcgtgttttcagaaacactccagacacatcaaataaactctcttgaattttaaaatagaaaaaggattgactgggctatgtgtgtgtctgggagtgggaacacagggatgggagtaattcaggatcaaaaaacagagtattaagtttaaagcagttgttactctctgccttccccctccttcctattctccagaaggcagggttcatagtgaaacactgtgtagtcttagatgcccctcctggaaaggcatatgaatcctagccccactccactctactgaaaactcagtgatttaaagcctcttgctttaaaaaaggacttctggttcaaaagactgctatgatcatgtgttaacattcatgtagaaaaagttctagtcatattaataatcaataaaaatgcaagtaaaaactatcgaaatgccactgtgtatatcttttagagtagaaaaaaaaacttctaataccttgtaatggtaaaactataaaaatgattttaggaattctgttggtaacattgtaaattaggacatctttcagagggctattgtcaataaaaagtgagtctaaagatgtttttactctgaccaataatcctacttacaaggcatgatcctaaggaagttgttcaacagaataaaaggtatatagataatgaccatcatcatcaaattacttattaaaaccacacaaggaagcaatctaaatattctgtgatcggcttccactacaacccatacacttttcttttatactgcttatcacattttaattatttgacaactgtctcactactagatagtaagctccatgagggtagtgctgtctctgcctagatctctggcacataaatacagactgtaggaattaagaacaaatactgaaacgtttataatttattatttttagatggagtctcactttgtcgcccaggctggagtgcaatggcgcgatctcagctaactgctacctccgcctcccgggttccagcgattctcctgcctcagactcccgagtagctgggattacaggtgcccaccactgcatccggttaatttttgtatttttagtagagacggggtttcaccatgttggccaagctggtttcgaactcttgaccctcctcggcctcccaaatcctggcctgcctcggtctcccaaagtgctgggattacaggcgtgagccactgcgcctgacctaatttaatgtcaagtaaaaataacacaaaaatatgtgtgctacaagtgaaactgagtaacatatacacacgattattatacaagattaaaaatagttaagatggaggcatcattggccaacttttcaattattttaaatatcctttaaagttattttagtacctctgaaatgaaaaagcaggaaaaaatttgctgttatttacaccaaacttgaccttgtagtagggatgaaacggccaccatgaaagcctgagggcccactccccagcttacccccaggtactcagttattctttctttgctcaagggtagaaagagccaaaatactcatatatcatatgtagcataaccctattttctgtaacaatctcaaacaaaggcagtatgttgagagagacagggaaatgtcttctaaagcaatcccttttgagcagtgaatttgctggttactaacagcagggggtgccaaagggatcgctattgttcccaggagacagccatgagaaggactgctgaggcctaggttgaaaaaaagcttaggtttgagagtaaaatccaaatgcagcaggttttcccttaacaactgggacatgtggataaaactcaggagctcataaacttgaatggataaaaactacattttaattttcactaacttctaatattttgcatttccttgatttataagtgtaggcaaacaatcacagcagaatcacagtgccagtgactctgtcatgaacagaagtcatagctaacactacagcacattacagctgttgcagatttctcaaataccatttatgctcatcaccgctttgaaacaacaggcttcaggagttactgttaggtatacagctggatattgtttaatctactagtaaagccacacatattactatatcatgaatttgttcaataatctgataactttaaataacagaatacttttatattccag

SEQ ID NO: 1029 - DNA, 868 bp, Homo sapiens
tccagccccacccgccaggtaacttttgaaagcgccggagcgcgcgcgcacctcccccgcgctccgctgtgccctcccccgcgttcccctgtgcccgccctcgcagcctcgcgcatgcgcgtagctccctgggcgcttcgaagatccagcggcttgctgtgagtccgggaggcaaaattgtacccatttcaaagatgtgatgactaaagtctcgagagggccaaggctcgcccaaggttgctctgtggtgacagctttacctccttgctatgtattctcagatattgcaaacggacgagagaaaagtggagaatgaatcctggagaaaacaaggtcgttcgacgatttcgacacgtcgcatccctgagagtctctcgtgtcctgatcaactcgagaactggaggcggtgacattttagatgctgcagtgaaagccacagagccacggaaggccgagactccaccatgtttgtgatcttcacattcagcaaactcactcgcactctgcctcatcttatctctagaatgtattttaccacactgtgtcccttctttagtgggaatgtctttggccaaaaataatgaatagttctgacctgacttgctaatacccagtgataaaaggatggaatttgttgggaataaaagaaaactaagcttacaaacgagggccctgatgctccgttccgagcttggtcatctaatttccagccacaatgtggtcgagatgacatttggagaggccccaggtggacatcaatacactgtcaacctccatactcaactctaagctgtccctgggaatttcagccattcctaacctccagagggcgcccgctatgcccttactcccctaaaccaaggttcca

SEQ ID NO: 1030 - DNA, 868 bp, Homo sapiens; identical to SEQ ID NO: 1029

SEQ ID NO: 1031 - DNA, 1049 bp, Homo sapiens
gtttgcatgtctgcattttttactgctccgtttaatatgtatgcaaatgccggccggctgcgcccgccgcgcggctgcacagtcacacgcggcgccccattaaagcggccgtcccgggcgcgcgcctcattcgaggcgacgggctccgggccctgatagatggggtgcggggacggagacaaatgacggcctttgggctcggaatacccacctttctggtaatgcagcccagcgggtcccagcctcgttttccagccctcactcaaaatggagtcgctctggttcgaacgcctctgacaagtgtgtacctacgtgtcaggcccatccttcctgcaggcctttgtcttggtgtcaccctgcctgagctggccccaaccacagtagcaacagtgatgctgatgtgtgactgctgccaggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagccctaggtctcctctccagaagttggagtgccatggtgtggtcatagcccactgaagcctcaaacctctgggctgaagccatccttccgcctcagcctcccaagtagctgggaccataggtgcatggcactgtgcctggcactgtctgaatgcatacagctgcgtagcatcgtggtaagaacacccgccctgacatcacacagacctgcatccacgtcccagctgagcctcagttctcacatctgcaaaatggggagaacaacagcagcagcgtcctgaggctggggtgaggaccgagtgaaaaacctttgtcgcatctttgggcatcgcaggagttcaataaatgttagctatcgttgtcactttgtattatccagcccagtctggcccgttgtaatcacctcctgacctgtgtctgggagctcacagctccaagcagcaa

SEQ ID NO: 1032 - DNA, 1049 bp, Homo sapiens; identical to SEQ ID NO: 1031

SEQ ID NO: 1033 - DNA, 1049 bp, Homo sapiens; identical to SEQ ID NO: 1031

SEQ ID NO: 1034 - DNA, 1049 bp, Homo sapiens; identical to SEQ ID NO: 1031

SEQ ID NO: 1035 - DNA, 1049 bp, Homo sapiens; identical to SEQ ID NO: 1031

SEQ ID NO: 1036 - DNA, 4425 bp, Homo sapiens
gtacggtgtcatttaagtttcgcattagcccatgaagtgggtcccgggttcacacccattgtgcagatggggaaactgaggtttgcgggagtgaagtcccttggggagggttgcagagagagtgggtggggattgggtccctccagagccctgtctttgatccccacggccctctgctgtctctctggctctcagcggtggggtgtccgcgtgcctgcctgtgccccaaatctgcccgggctcgccccataccacgagccagccccctcctcctgcctgcccccacgcgcgccaggtgacaggcccacagcccagcgagctgggggactgagcctcacattttccaaatattgcttaagcctaaaatccgaagtgctggttttaaaggaatctttcctaatttgtcaggattttaggccacatggcagctgggggcagaaacatttctgagaggaggctccagcctcaggagagacccaccgtggagcagaccactcagacccaccggagacccagagttacacactgctgtgtccgtgtgtgcgcgcctgtgtccgtgtgtgcttgggtgtgtcgtgtcattgggctcggaatacccacctttctggtaatgcagcccagcgggtcccagcctcgttttccagccctcactcaaaatggagtcgctctggttcgaacgcctctgacaagtgtgtacctacgtgtcagggtgagtatggggctgtatgtacacacgtgtcactgtgtacacgtgtcggtgcgcatgtatgaatgtgtgttgtccttggctggcaggcagctggagtgtgaatttccctgagggtttccacttccctgtggttcaggctggggccgtccccgctctcctggccccagagctgccccactaggcagggaaagcctctggaatgagggaacaggatatggctccatgaggcccccacaagccagaggcacccctgagctttgcatagatgggaaggacttggattgctggggccgggctggagcctgggaatcctgagccggaagtgaggggtgcacacagctgtctagagaagccctctgcgtgtgcgtgtgtgtgtccctccagatctgtgcatgttgagtcactcggggaagtggctctcctcatgtaaatgtcttcaggatgaagggaggtccttctggtgtctggacttgagcttctctgggggcagaacctgggctctgggggctgctatttgggaatcaccctccttgccgccccctgggccagtgccctgaggacactggaggggtccttgagccctagtggggggtagggtgtgtgtgtgtgtgtgagagagagccagagagagtgtctgtgagcaggggtgtatgtaaatgtgtgtgaggatgtgtatatgtgcattggtgtgagttgtgtgtgtgaggttgtgttggggtgagggtgtgggcgtgtgagttggtgtgagggtgtgtgagttggtgtgtgtgagttgtgaggttgcgttgggagtgagggtgtgtgcatgtgagttggtgtgtgagttgtgtatatgtgaggttgtgttgggtgggggcaagggtgtgtgcatgggtctgtgagttgtgtatgagggaggatgtgtgcatgggagttggtgtgtgtgagggtgtgtgagggtgtgtgtgaaagtgtgtgggtgtgagttggtgtgtgtgttgtatatgtgtgaggttgtgttggggtgagggtgtgtgtgtgagttggtgtgtgagttgtgtatgtgtaagggtgtgagtgtgagttggtgtgtatttgagttagtgtgtgttggtgtgcatgcgagttggtgtgtgtgagttggtgtgtgttagtgtgagttgtatatgtgtgagttggtgtgtgtgttggtatgagttgtgtatgtgagttggtgtgtgttagtgtgagttgtgtatgtgtgagttggtgtgttggtgtgagtgacttgtgtatgtgtgagttggtatgcgtgtgagttggtgtgtatgtgagatgtgtgagttggtgtgtatgcgagttgatgtgagttgtgtatgtgtgagttggtgtgtatgagttggtgtgtgagttgtgtatgtgtgagttggtgtgtatgagttggtgtgtgagttgtgtatgtgagttggtatgagttggtgtgagttgtgtatgtgtgagttggtgtgtatgtgagttggtgtgtaagtgacttgtgtatgtgtgtgtattggtgtacatgtgagttgagttggtgtgtgagttggcatgtgagttggtgtgaattatgtatgagttggtgtgtgaattgtgtatgtgtgagttggtgtgtgaattgtgtatgtgtgagttggtgtgcatgtgagttggtgtgtgagttcgtgtgtgagttggcatgtgagttggcacatatgtgagttggtgtgtgagttgtgtatgtgtgagcgcatatgagttgtgtgagttggcatgtgagttggtgtgagttatgtatgtgtgagttggtgtgtgagttgtgtatgtgtgagttggtgtgcatgtgagttggtgtgtgtgtgagtccgtgtgtgagttggcatgtgagttggcacatatgtgagttggtgtgtgagttgtgtatgtgtgtgttgatgtgtatgtgagttgctgtgcgtgtgagttgtgtgcgtgtgagttggtgtgtgagttgtgtatgtgtgaattggtgtgtgtgtgagttgtgtgtgtgtgagggagggtgtgtttgtggacagatgtgtgtgcgcctggatgtgccggaccggttgggaggggcggatggaccgaggctccgcgacaggcatttccgagctcccctggcagatctggcttaggaggagctgcagggaccagcgctgagggcccttctggctgccctggtccgggccttggtgtcttcctggtctcatctctctctagtctctgcagtcccctgggctctccagtcccacagggggctctcccttggaaacccgtggggaatgtcacccgtggggaatgtctctgcccacccaagcctccccggggaacggcagacaggatggcccctcaggccggcacctcccagaactcacgtccccacagtggccctggggtcccctctggcctcacgcccgctcctcttcctctctttcaagatttgccgggtgctgggccccagaagccagccctcctgacgtgtggcggccgtcctcaccgctccctccttccctgcagcattccccagcccccggcccaccctcctcccacccgcttcctgacccaggctcccgggccttcccctcgtggccacctagctgtgtgctttgtttggctgctgtcacccccaggaaggtgatccccgtgagaactcaaatagcagatgctcatctgggacccccgcctccagccccaggggaggtttcctggtcctcactgtggccggggcatggctccttcaccccggggctcaccctcggtgtccgtgaagtccagccgacggtgaccctaagtcctccctccactcgcctatgtttggggatagcccatccttcctgcaggcctttgtcttggtgtcaccctgcctgagctggccccaaccacagtagcaacagtgatgctgatgtgtgactgctgccaggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagccctaggtctcctctccagaaagaccggattttgccatgttggccaggctggtcttgaactcctgacctcaagtgatccacctgcctcggcctcccaaagtgcagggattacaggtgtgagccactgcacccggcctcaggcaggtatttttaccagccgaatactcttgcactgtgcactcttcgtgttcatcatcagtcccccggatgggtgtttaaggcatttccaaagctctgttattaaaaacacgatgcaatgagtttctttcagcatttccccttgttgccgtgtgaatgcgtccgtggtataacttcctaaaagtggaatcgcttggtcaaagggtgggtgcatttagcaacctgatggctttccaggagacaagtgctgcctcccggccacgagcttttaagaagaactgttgatggaacccgagctggagtcccagggaccggggcgagttctccatcccaggggattttcagatgggacactggggagaagctgccctgcccatctgaactctatgatcccagtactaacactggtagctgtgccatccccagtatagagacagcaccgtgctcttgggagggtgagtcattggcccccg

SEQ ID NO: 1037 - DNA, 1795 bp, Homo sapiens
catgtgcaggcatggagactgcccggccccttcctgtcctgttggggcatgattttcaacagagggaggattctgggcatgttttcctttggaagtctcaccaggctgagcaggacttagaggaactccggctacgtttgctgtcccaacaaatagaccagggttccctaagtgtcgcttcctccaagaagccctccctgatgagttgagccactttagtttgtgctcaggctcaccctgcacgtcttggttgctctcatcactgtaatgatctaaaacacacgtctgctcatgagacccgcatcccacccccgatgctggggccgctcttggattttcatgcctgctgccagcacccagggggagctccggaaatgtctgctgggggctcggaatacccacctttctggtaatgcagcccagcgggtcccagcctcgttttccagccctcactcaaaatggagtcgctctggttcgaacgcctctgacaagtgtgtacctacgtgtcaggatttgccgggtgctgggccccagaagccagccctcctgacgtgtggcggccgtcctcaccgctccctccttccctgcagcattccccagcccccggcccaccctcctcccacccgcttcctgacccaggctcccgggccttcccctcgtggccacctagctgtgtgctttgtttggctgctgtcacccccaggaaggtgatccccgtgagaactcaaatagcagatgctcatctgggacccccgcctccagccccaggggaggtttcctggtcctcactgtggccggggcatggctccttcaccccggggctcaccctcggtgtccgtgaagtccagccgacggtgaccctaagtcctccctccactcgcctatgtttggggatagcccatccttcctgcaggcctttgtcttggtgtcaccctgcctgagctggccccaaccacagtagcaacagtgatgctgatgtgtgactgctgccaggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagccctaggtctcctctccagaaagaccggattttgccatgttggccaggctggtcttgaactcctgacctcaagtgatccacctgcctcggcctcccaaagtgcagggattacaggtgtgagccactgcacccggcctcaggcaggtatttttaccagccgaatactcttgcactgtgcactcttcgtgttcatcatcagtcccccggatgggtgtttaaggcatttccaaagctctgttattaaaaacacgatgcaatgagtttctttcagcatttccccttgttgccgtgtgaatgcgtccgtggtataacttcctaaaagtggaatcgcttggtcaaagggtgggtgcatttagcaacctgatggctttccaggagacaagtgctgcctcccggccacgagcttttaagaagaactgttgatggaacccgagctggagtcccagggaccggggcgagttctccatcccaggggattttcagatgggacactggggagaagctgccctgcccatctgaactctatgatcccagtactaacactggtagctgtgccatccccagtatagagacagcaccgtgctcttgggagggtgagtcattggcccccg

SEQ ID NO: 1038 - DNA, 1795 bp, Homo sapiens; identical to SEQ ID NO: 1037

SEQ ID NO: 1039 - DNA, 1313 bp, Homo sapiens
catgtgcaggcatggagactgcccggccccttcctgtcctgttggggcatgattttcaacagagggaggattctgggcatgttttcctttggaagtctcaccaggctgagcaggacttagaggaactccggctacgtttgctgtcccaacaaatagaccagggttccctaagtgtcgcttcctccaagaagccctccctgatgagttgagccactttagtttgtgctcaggctcaccctgcacgtcttggttgctctcatcactgtaatgatctaaaacacacgtctgctcatgagacccgcatcccacccccgatgctggggccgctcttggattttcatgcctgctgccagcacccagggggagctccggaaatgtctgctgggggctcggaatacccacctttctggtaatgcagcccagcgggtcccagcctcgttttccagccctcactcaaaatggagtcgctctggttcgaacgcctctgacaagtgtgtacctacgtgtcagggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagccctaggtctcctctccagaaagaccggattttgccatgttggccaggctggtcttgaactcctgacctcaagtgatccacctgcctcggcctcccaaagtgcagggattacaggtgtgagccactgcacccggcctcaggcaggtatttttaccagccgaatactcttgcactgtgcactcttcgtgttcatcatcagtcccccggatgggtgtttaaggcatttccaaagctctgttattaaaaacacgatgcaatgagtttctttcagcatttccccttgttgccgtgtgaatgcgtccgtggtataacttcctaaaagtggaatcgcttggtcaaagggtgggtgcatttagcaacctgatggctttccaggagacaagtgctgcctcccggccacgagcttttaagaagaactgttgatggaacccgagctggagtcccagggaccggggcgagttctccatcccaggggattttcagatgggacactggggagaagctgccctgcccatctgaactctatgatcccagtactaacactggtagctgtgccatccccagtatagagacagcaccgtgctcttgggagggtgagtcattggcccccg

SEQ ID NO: 1040 - DNA, 1313 bp, Homo sapiens; identical to SEQ ID NO: 1039

SEQ ID NO: 1041 - DNA, 877 bp, Homo sapiens
cttccagtccagtaaagatgccaggatcccccagggcatggcaggcaccctcaaaggcagacgtggggaggccctgcgccccacacacactgaccccgcatcggcatcgggggccctgcgccccccacgcactgaccccgcatcgggggccctgggctgcagaacccatcgatgctgttgccgtgcccctggttctggtgacactgggaccctccaggttgggctgagcagggcccccccaccagtgcgtactccagcaccagcgggagtgggcctgggcaggggctgagggagtgacacccaaggggacctgccccagcctcctcctgtaccctgggggttctcgttttccttggctgagggaggtggcctctcccagctgaaacctggggacaggctgggcgtgagagcaaaggggggtgagcaggaccccaggccttggaaatcctgagtcgggggaacaggctttgcctatgacgtgcctgggagctgtctgggggccctcctggggagccaggctcacaggatgttgtgtgggactcaacgtggggcaacgtcccggccaagagggggaaggccatcaccccagggtctgtgggaggcacatgcaggccaagctctcgcccacccggcgtgccgatccgctgcagccagggtccctcagccttggccagaacctgaagtccgaccgctatccctggggctccccagccaggcaggcaccccccgcttacaggcccaggagccaaaacggagtcaagcgctcggtgcggggaccagccgggggcaggcctggggagcccatctggcaagggcggcaggaaggcgcccactccgggactgtgcctgggcctgccgggggtctccagccagagag

SEQ ID NO: 1042 - DNA, 877 bp, Homo sapiens; identical to SEQ ID NO: 1041

SEQ ID NO: 1043 - DNA, 877 bp, Homo sapiens; identical to SEQ ID NO: 1041

SEQ ID NO: 1044 - DNA, 877 bp, Homo sapiens; identical to SEQ ID NO: 1041

SEQ ID NO: 1045 - DNA, 877 bp, Homo sapiens; identical to SEQ ID NO: 1041

SEQ ID NO: 1046 - DNA, 877 bp, Homo sapiens; identical to SEQ ID NO: 1041

SEQ ID NO: 1047 - DNA, 877 bp, Homo sapiens; identical to SEQ ID NO: 1041

SEQ ID NO: 1048 - DNA, 5925 bp, Homo sapiens
gtttggtaatgggtgcaaaaactgtacagaggggacaatggtagctgagtaagttttcactggattcctttctaggcttttggttttggaccatgagaatggcttacatattcaaaaggtaagtacatattttaaaaatttaattaaacaccacacccccagcctaaacactgacattgttccaagtcaatagagggttggggaatctgcattttgcaatgagcagcctggctgattctgatgtagatggtccaaggaaccaaggaactgtggggcacatagccacagactatgttcatgcaacaactattttttattgaacgttggatacatgtatctgtccatttcacaaattatgttttattatattaaagaataaacctcatttcttctacaacttgaacatccagcttactatacacgggatctgacttaatgtcatacagaccacttacaatgtgatagaagcattggaagcatttgttgaaaaataacaatttcactcaaagcacactttatagatagagttttacatggtcacagagttaagtctgaacatttaaagggatctgagtcattcatattaatattgtgaatttcttataaataattcatttgttcaaggagtccaggcaaagccaagccgtgacattatttacactaagtaccacacctggaacttgttctgagttatttaacacagagtacatttttcaatgcaataaatatttacagttaatagtagcaagtacaattataatttatgaaatatgagtctaatatttaaaacaaaacataaaatgacattaaagaagtttgtgccatttatttttacaactcaccgaattgactgttttacgaattttattacccaaaactctactgacttgaatgcaagaaaggtcatgtttgaatcagtaaagcccagactgcagaaaaaaaaaaacttttagaagataatgagttttactttcttaatgttatacacgtattattaatgtcattagctaaaatggaagcaaagttatgaaaatctggattcacaacaggctcaaattatataatgtaccttcaacattgaagttctgagttatgccaacatttttaagcttgtctgggagttaatgaggccttgaatgtacgaggttttactgtccattaaaattattcttttaaaatgtcataaaattatgtgagtcctttcatgtcattatatgactctgtgagtgaattttaaattgggggaaaaaaggcaaataatcttatcttctagaaatgtgagctcagagagggccgagagacagtggtgtctgtgtttagaacagggcacctagggctgggcactcagatacctaagtccatatctgagtttcttatctgtccccttagtccaggagatgcttttctgttagaggctatttatgtagcctgggtccccagactctaggaaaccaaccattgtcgtatcttactctattttggggaaagtgggggcgtaggtggttctacctctacctgacactttttctccaactaattctgattcaaagaaagatggctagattcgctgttctcatttgggttttctctctaacttggtccttagcaagtttttttctctcctcagacacagaactaggtgggaaattcttcccagggcttccagttgcaagtgaattgtgtctctgagtaggggagaaggagggtgcgaacaactgacctaagggactttctgactcacccgctttgtgctgcatttcagcctctgccctcaacaattccttaaactaggtgcctcaatgctctttgcatacattctttgactctatcattagttcaggtctctggacaaaacctagaatagggagtggagttttcttctaagtactgtgaacttaatttttcacacaggttggatttgggaagcaatgctaagcagtggaatggacatcgacatagagagatcagctccacacttatactctgccactcaacttccccatgtgacttgaggatcagtaagtaatctccctgccacggcttcatgtgcccagcactggacttggcacattgtcagtgtttggtgaagttgagccccttcctttccagcacttccagagccacagcactccattcaggttttggtcaaatttggtgtatttcttggccagtgtctttgctcccaaggatcccacccttctttgtcttagccttccatttcattgtggcattgaatgttgtgcccaccaatatgtctctcctggggcagcccacaatgaccctgtccactcccttgtgccaagttaaacagattcactttggggacaagagaatatcctgtaaagtggagaagtgatgatcagcactgctcttcagtataactgaatagcccatgggaatgaagtacagttagttcacctcgaaacaatatgaaatcagattaagctgaaccagatgaaattgcctttttgtagttcgaaaatggcccaatcttaacagtttcatgtttcagcctcatagttccatgggccttttaatgtaatggtagatggtcacatttccatagtaaaggatgtaaagcagctctttggccagcagggaaggcttggatgaaatgaggtaatgagtataaaagtactttatagaccatgaacactaggtaaatgcaatgtttttaaaaaaattagtcatggacatgattccacagtaatattctaacccagggattcttaaatttaacatatgtgcaacattgaagctttttaaaaatttagatacattctactgaatgaatttctaatgtgaagtctcataagagaaaagtctgttctcagtgtgttatttgttgattgctctgaatatattcagctggacttaatgcttggccgcctgcaatataacaaagggtgtttctgaaggccaaagttacagtaagagattgtgagatagtgaaattgtcgtgtgtatttgagaagtgtgtgtctgggtgtgggctaggagaaatgaaatgaccatccagatacggaataaagtagagcttggtaagccttggtttcatcgaacagtgtgcacaaagcctaggcccatgaaagcctaggcccaagaaagattctttaatccctttgttttcagctgttaatccatttcataagaatacagccaaaaattagacaagtgtacaaaaggtgctccattcccccagaaacccagggataattctaagctactctctaacaatagctacctcctgttgtggatgtgaagagcacaaatggcaagaaagtttgcacccttcccatctcaccacgatacaagtggatggctcttcattcagcttccatacagtcagcttcccagggtgatggtttctagctggcttccaggaacagtgacttagccactttttagtccacagatgatgccattcaatgtgtactccccaaacaaagttaatctctattaccagaagctacttgatgcatgaagacactttgaaacaaataaccaactgctgcttttgacatgaatgaagactttacaatgcaaggatgctcatgtgctattgtcaagttcatttatttctgttcagtgttcattttcataacaagatgagcttggttcatctgcagcagcccctaaacagtttatttacctaggggttctccatcctcccggatggaaccaaattgtttgtggacaaagagggaaatccagagcttgttaatgaggcggaaggcaggttcagtgtgagagtgaaggcagtcaaaaaaacagggtttagccatccacatttatggagaatcatcaaatcaacaacagggaggggccctgtcttcactaagcagggaggatcttcttgctaaagaatatcactcccaatagcagctgcaccttccctgccagcagcagccgttggtgggaagattgctttgtttattgcttaatctatcactgttgagctgcctgcctcagggaggctcaatttaagatagattgaaaggtagtgtctgtcaattgaataaacacagatggttttccacagcaaaaattgatttttttttcttgccaaagacataagtgctaaacgtgattatctttggaagccaggcgtgaaatgtctcagctccagcccctgccacactctgctttggcagagaagtgatacacgtggggacttgggtctctcctctaactccaaaacatagcaagctcgcggaacatcagggttcatgcaaagtattccaaggagccccttgaagcaacagaatggtctgtctcctttcataccactaacgtgaacacaaatatagaatagcggttgatttccaaagagttgttgttgcaagcgtagcagaagtgaggctactgtgaccaaatgggctacagaaaggctgcaaagacagaactagagacgatgaagagactcagaattttagcgatagacaagaccttagcactgtcttctcagtctagagatgaaaacaagagtctagacaagtgaaattgatagccagagtgatatagctagaggcagagttggactgtcaagctagaaatcttggttctttaagctatactatctgtcttgcttttcaaactgttcaatgtaattatggactaccagcaaagcaggtttgtacagtacagacgagcacgtagcaagcagaattgaagtttcattctgtcttggtcccaactcctaaagctccatagacagtgggcacttcttcatatcaagagacaagaatcttttcatatgtgccatgtgaaaatgagagccaactgtttgtatctcatctggatagagaaaacctaaattaaaattgtcttagaattttaatgtgtaagggcacatttgtaaaatttgaatttatttgaaagtgggttaatatgtttgcaacctgtcaaaattgccctctttgagtgaaaaaaaactcgattcagggtttctaaagtaagggaatcaaatctttttagagccaactaaactcacttagaaaaagaaaaatatttcagccaagtctttttctgcacatggctctttcataaatactcttcttaagtagaaacaagtctgtagctgtttttcaatcagttcttaaagttaagacccctgtgactttcttatacatattcagacaaaaaatacgtgttactgaaattttattcacttcctcccacaaacgttaggagaagcatacattaaatataaacatgttcccatttctactcagatacaatcccttctttcttatagtgaaactactgattcagtgtagcagtcaaagacaaatctaagtaaatacatttgactcaaaacctatgtatcaagaataaatactgtactttatgcatttatagatatttgattaattaatagcatgattttttttttcctaaaaggattgctcttctatggtggaatggcaccctggatgattaaaaccgtagcagcaaacaaaacctccatcaagtaagaattcagagtgtgagatatcacgcacagccacgcgtggatctttatatacgtgtcaatgtgtttgattgtatttttgctttcaaagtatgtattgagcatttcttctaggtcctcagtaacatctttttaaaaaaaaaataaatgcttagggaattgttttatattaaactcgcttccattgttatcaacttggagagtgtccctcatacatggagctctctcacaggattgacttttcatattaggagtgtaaataaaagttgttccttggtttgtgtattacagatattcctgaaaacagagtcaagttatatttctaaagtactagcgtctgcttaaagaaatgacaaggtgaagtctttcacaaagtaagcattcaatgtatgatttctctgctatgtaaatctggttgttcatacagtttctatgacataattggccacgac

SEQ ID NO: 1049 - DNA, 2443 bp, Homo sapiens
tccaagtcaatagagggttggggaatctgcattttgcaatgagcagcctggctgattctgatgtagatggtccaaggaaccaaggaactgtggggcacatagccacagactatgttcatgcaacaactattttttattgaacgttggatacatgtatctgtccatttcacaaattatgttttattatattaaagaataaacctcatttcttctacaacttgaacatccagcttactatacacgggatctgacttaatgtcatacagaccacttacaatgtgatagaagcattggaagcatttgttgaaaaataacaatttcactcaaagcacactttatagatagagttttacatggtcacagagttaagtctgaacatttaaagggatctgagtcattcatattaatattgtgaatttcttataaataattcatttgttcaaggagtccaggcaaagccaagccgtgacattatttacactaagtaccacacctggaacttgttctgagttatttaacacagagtacatttttcaatgcaataaatatttacagttaatagtagcaagtacaattataatttatgaaatatgagtctaatatttaaaacaaaacataaaatgacattaaagaagtttgtgccatttatttttacaactcaccgaattgactgttttacgaattttattacccaaaactctactgacttgaatgcaagaaaggtcatgtttgaatcagtaaagcccagactgcagaaaaaaaaaaacttttagaagataatgagttttactttcttaatgttatacacgtattattaatgtcattagctaaaatggaagcaaagttatgaaaatctggattcacaacaggctcaaattatataatgtaccttcaacattgaagttctgagttatgccaacatttttaagcttgtctgggagttaatgaggccttgaatgtacgaggttttactgtccattaaaattattcttttaaaatgtcataaaattatgtgagtcctttcatgtcattatatgactctgtgagtgaattttaaattgggggaaaaaaggcaaataatcttatcttctagaaatgtgagctcagagagggccgagagacagtggtgtctgtgtttagaacagggcacctagggctgggcactcagatacctaagtccatatctgagtttcttatctgtccccttagtccaggagatgcttttctgttagaggctatttatgtagcctgggtccccagactctaggaaaccaaccattgtcgtatcttactctattttggggaaagtgggggcgtaggtggttctacctctacctgacactttttctccaactaattctgattcaaagaaagatggctagattcgctgttctcatttgggttttctctctaacttggtccttagcaagtttttttctctcctcagacacagaactaggtgggaaattcttcccagggcttccagttgcaagtgaattgtgtctctgagtaggggagaaggagggtgcgaacaactgacctaagggactttctgactcacccgctttgtgctgcatttcagcctctgccctcaacaattccttaaactaggtgcctcaatgctctttgcatacattctttgactctatcattagttcaggtctctggacaaaacctagaatagggagtggagttttcttctaagtactgtgaacttaatttttcacacaggttggatttgggaagcaatgctaagcagtggaatggacatcgacatagagagatcagctccacacttatactctgccactcaacttccccatgtgacttgaggatcactctaactccaaaacatagcaagctcgcggaacatcagggttcatgcaaagtattccaaggagccccttgaagcaacagaatggattgctcttctatggtggaatggcaccctggatgattaaaaccgtagcagcaaacaaaacctccatcaagtaagaattcagagtgtgagatatcacgcacagccacgcgtggatctttatatacgtgtcaatgtgtttgattgtatttttgctttcaaagtatgtattgagcatttcttctaggtcctcagtaacatctttttaaaaaaaaaataaatgcttagggaattgttttatattaaactcgcttccattgttatcaacttggagagtgtccctcatacatggagctctctcacaggattgacttttcatattaggagtgtaaataaaagttgttccttggtttgtgtattacagatattcctgaaaacagagtcaagttatatttctaaagtactagcgtctgcttaaagaaatgacaaggtgaagtctttcacaaagtaagcattcaatgtatgatttctctgctatgtaaatctggttgttcatacagtttctatgacataattggccacgac

SEQ ID NO: 1050 - DNA, 2443 bp, Homo sapiens; identical to SEQ ID NO: 1049

SEQ ID NO: 1051 - DNA, 3108 bp, Homo sapiens
gtcctgcaaccatggggaagcccacaacaccaagggcccttcaaaacacagaagcttcttgctcacggcagaaagcccaattccatctggcccctgcaggttggctcagcactggggaatcagagtcccctccatgaccaaggcaccactccactgacagggtcacatctcccaggaagatctcacttccccacagaagctcttggcctggcctcctgcagtgccacgctccgtgtatttgacaagctgagttggacactccatgtggtagagtgtcagtttgtcaaataccccaagtgcggcacatgcttaccagctctaggccagggcagatgggatatgacgaatggactgccagctggatacaaggatgctcaccaagcaccaagttctcacaagttattttatgtgactttgcaggaactgaggcattatatctgaggacaccaggggaaaagtgtggcatctcagggaaatacagccctgggctgtgtctacacacaccatgagagtgctgatgggggcgcaatagtcttgaaaatgtataaagtgtccaggaatggaagtgctctttgattcattattattttcttccttcatattcccctcccagagtctcctatctaggacatcagcattctcacacaagcctaatggcttatctgagtaagcagggcttagaaattcactttcttgatactcagtcttgccttctaaacactccttgatcttgcctacctctccccttttccacatgtcttttcctgtaggaacactttctccatttattcctgcctatccaattcttccctatatttcctggaccagctaaagtccagtgtttccagagacttttgaaagtcaacttacactttttccttcttcattcacaaagctcttcttccctgggccctggtatgtatgcctttctctcctactgtctaatagcacctcgtaaattgtcaatgaacttttctaaggggtattcttgaattcccaactagattgtgagcttctggaagacaaggctatgtctttgattgttgtctcccctaccacagcccagtactttagttacagaaaataataaatatttactgattgattgactttcctcttgtccactagctttaggtttgggggccaaattctaccctggattttgaaaaattcaaactgtgaacaccacaatgttatagagcatatgaggtagtagccagcatgaaggatgttttcttcctgagaaacagtgtcaagggctggaggaagagggcaaaatagcagactcagagggcaaataaattttggtattacttggtcacacaaggttatacaggtgttttcttgtaggatttttcagagcctttaatagtctaatgttgcattgagaatctcaaagaggaaaccatagaatgaggcatttgccatacctatctgatcatgaattttcttttcccccacagccttctcctgtgtcaatgtccaatgaagcacgatttgggaaactgtcctagagaaactttataccttcccgctcttctggagatcttttcctcttttcattcatctactttccccaaccagccatctgcctaagaaaggtcacatgttatcatctcatttttgtttagcctctgcagctgtggactatctttattacataggaattctttactagcttgtcctgtatttaaaaatattctaagttttgaggcaaagaagatccagatgctgcaataaatatatgcactgaggagttcacaggcctgacttttggtctcctttctaccactaactgtgtttttgttcctctctgagcttcattttctcatctccaatacggaagtattagaatcagtgatctctaggctctttaagattaatgactttgagatatccctgggagtccttagctcttatggagcagcgtccctggatgtgtggctccttttaccagtgaaaatgcaaccaggattctcttcccaacacctaaaactcactttttctatgggtagtagggaaagataatgggtattttcaaaggctgtagggtctggacgcagagttgtttcatgaaggaagttggggtttccactgggtggaggccctatttcagaggcttgtaagcacgatggggaagaaagagttgttcctttcgccaactaggagaagctagcgtctggaatgaggaaaatgttgaggtttttaccctggatttggcatgttgggtggcggtgaagtggaggactcctttttgttactttcgtgtactattttgacttctgtaatcattgcaaaaggggagcagctccttgtgaaacatgagctgacctaggggctgcatgggaaccagaaatagcaacatggcagcttccttgaagagtgcagaagttgatttgacattaattacatcgagaaaataaaactgtgtcaacctgggtcagaacaggtcctcacagcggagcctgatttaaaggtgtaggaacttatgtacacatacaaactctctctctctctctctgtcgtgcgcacacacacacacacacacacacacacactcctagccctattcctccttgaagagaaaggctttcttgctcttatccccacctcacattgtaagaaggggccaggagctaaagaagataacatatgaaaaatgcaactacccccaggattttaagattcaaagaagtggaaatccttgggagtggtgcatccatacttgggaaagaaggaaatcccttcatctctgcattcatagtcccctgagacagaaagactttttctttcttaggcttccagttgatgtgggaagaatcatccaggtggacctggcaggatgacaggttgggtaatggaagccaggggagtactgtttaatcaagtattcactgttctccagctgggcttaccagtggagtgaagtaggagtggcatgtgtgggaaggggaaagaccaaaaaagcaaaagtgacatccatattctcgggccccagccatcttaactagtctcactttaattacttttagtaggtcctaccatactgtgagagaagaccaacacaactgaagttgctgttatgattagatatttattgagcaccag

SEQ ID NO: 1052 - DNA, 7147 bp, Homo sapiens
tcttggttcttggcccctggccctatgcctgcaacactgtcacctgcacgtggattgggaaccacatagcccccggacctgctaaggccattaaggacaggatggtgatgcctcggctgactgacgtgagaagattgtcatgacccatggcctctactgctgtcctaccaacagaaacttcataatgttgtgcaggcgttaccactacctagttccagaacattgccatcacccccaaaataaatcttgcattcattaagcagtcacccctattttcccccatccctgtcaaccactgatttatgttctgtctctatggattcccctgttccggataattcacgtaaatggaataacacaatagatgccttttatcatgggtttctttcacttaggatgttttgtagggtaatccatatagcatgtatcaggacttcattttttttttttttttttttgagatggagtttcattcttcttgcccaggctggagtgcagtggtgcagtctcagctcacttcaacctctgccttctaggttcaagcgattctcctgtcttggcttcccaagtagccaggattacaggcgcctggcaccatgcccagctactttttttgtatttttagtagagacagggtttcaccatgttggccaggctggtctcaaactcctgacctcaggtgatccgcctgcctcagcctcccaacgtgctgggattacaggcgtgagccaccatggtcagccttcattcattttcatggagaaaaatatttcattgtatgagtataccacattttgtttatccatttatccattgattggttgtttctacttttttttagctattatgaataatattgctgtgaacatttgtgtacaaggttttagtggacacaagtttttatttttcttgggtatatatctaggagtggaattgctgggtcatattgtaattctgttcaactttttgaagaacttcccaactgttctccatggtggctgtgccattgtatattcctaccagcagtgtatgaagttacaaatttctccacatcctgagaacccctttattattttctgtttttctttttgattatagccatcctagtaggtgtaaagtggtatctcattgtgattttattttgcatttccctaaatgattaatgatattgagcatcttttcatgtgcttcttggccactagtatatcttctttgaagaaatgtctattcaagtctttggcagtttctaaatgagttattgtctttttgttgttaggttgtaagagttataatctggataacagatccttattagatatgtaatttgcacatattttctcccattttgtgggttgtcttttgtcttttttattttttattgcttgtgttttggtatcattattgataattcattgttaaattaaaggtcatgaagagttactcttactttttcttctataatttttagttttagctcttgtattcatgtctgtaatcaattgaagttaatttttaatatagtatgtgttaggagtccagcttcattgttttgcatgtatctatgcaattgacccaaagtgatttgttgaaaaatattattttctgatggtatggtcctgacacccttgtagaaattcaattgaagatatatgtatgagtttacttctgcagtctcaattctattctattggtctaaatgtttatctttatgccagtaccagcctgttttggttattttagttttgtaataaaatagacaaacatttggccgattaatcaagacaaaaagaaaagtatatagaaataatattatgaaagaaaagggggagcatattgaaaaacaccataaagattaaaaagattaagggacagtgttaacaatttatgccaatagggtttgaaagtttagagaaaatagacaaattcctagcaaaatataaattatcaaaacctactcaagaaaaaatagaaatcttatatagtcacaaggtattaaatattcaattcttcctagagacccaaatatatgctttctacccgtaactcactgtaaataaaaagaaagggataatatattgtgcaaactctagtcaaaaaaaagttggaatgacaatattaatataaacaaaagtggacttcaaaagaagcaatattatcagagagaaagagggcactgcttggtgaattgccccctgataaagacataacaataccggaagtaaaaattgacataactgcaaggggaaattgacaaatccacaattatatttgggatttaaatgctttactcttaataattaataaaagttagctaaaaaattaattttagctaaataaattagctaaaaagttaacaaggatagatctgaacaacactaggataaacttgtcctaatggacatttatagaccactataaccaaaagtggtagaattcacaatttttgcaagtacacatggaatattcaccaaaataaaccatatcctgatttataaaataaactaacaaactggcttctctcacttagcaatatgaatttaaatttcccccatatctcttcatggctttatacctcatttccttttattgctgaataatgtttcattttatggatgggccataaaatgtttatctatgcacctatagagggacatcttggttgcttccaagttttggccaatattaataaagctgttataaacattcatttgcaggtttttgtgttatcatgaatttccactcatttggttaaatacctaggaatataattgctagatagtatagcaattctgtttagttttgtaggaaactgcaaactgtcttccaaagtggctgtatcattttgcatttccactaacagtgactgggagttccttatgctaaacatcctctacagtatttggtgtggtcagtgttatagattttggctattctttcaggtgcatagtggcatcttattgttgttttaatttgcaattccctgatgatgtatgaggggacttcaaaaatttatggaaaaattgaactaaaaggtaaaagtaaaaaatataaacttcttaacataagctccatcgagttcaagatactttgtaagcaatgataccagccatttggttcatccctaaggaactgagggttctgagaatttaatcaggtcaatgaagtcttttttacgttatgaactgaagaaaaatgtgtgcaatttaaaggtttgttaagactttgaaacaaaaagaagtcagaaggagccaaatcaggactgtaaggtggatgaatgcctaatgatttcccatcaaagctctcacaaaattgcccttgtttgatgagaggaataagcagaagcattgtgatggggaaggactctctaatgaagctttcccaggtgtttttctgctaaagctttggctttctcaaaacactttcataataagcagatgttgttgttctttggccctccagaaaaccaactagaaaaattcctttaacattccaaaagactattgccatgagctttgttcttgaccagtccagttttgctttgactagaccgcttccacttcttggtagccattgctttgattgtgctttatctttaggatcatactggtaaagccatgttttgtctcctgttaaaattcttcaagaaattgctacaggatcttgatcctacttgttaaaatttccattgaaagctcagctcttgtctgcagctgatctgggcacaacagttttggtacccattgagtggaaagtttgctcaactttaatttttcagtcagaatagtgtaagctaagccaatttagatatctatggtgttgactattgtttgtgctgttaattcttgttcttcttcaattaaggcatggacataatttttttcaatttttttttcaaacgatgtggaaggcttgctgctatgtgcttcatcttcagcatcatctcatcccttcttaaaatgagttatctgtttgcaaactgctgatttcttttggagaatcatccccataaacttctcataaagcatcaatgattttaccattcttccacccaagcttcacactaaatttgatgtttggttttgcttcaattttagtagaatttatgttgctctgacaggtgctcttttcaaacttacgtcttacctttttagtgcctcaaactacatcctgttcaggcatgttataacaagttagtatgagcttattttggtataaaaaatttggactccataattttttcataatatgcatttttcattaccttttggaagacaactcatatcaccttgagcttcttttcatatgcctattttccatatgtatatcttctttggtgaggtgtccttttcagatgtttgtacatttaaaaatcagttattacccactcccaccacttctattcaacatagtactggaagtactatcaagagagagcaattagacaagaaaaagaaattaaagatatctaaattggaaaggaagaagtaaaatgatctctctttgcacatcatatgatcctatgtgtagaaaactccaaagactccaccaaaaaaacctattagatctaataaatgaattcagtaaagttgcaggatataaaattaatatacaaaaatccatggccattttattcacaaataacaacctagctgagaaatcaagaaaacaatcccatttatgataacataaaacacttaagaatacatttgaccaagaagatgaaagtgcatcagtatagcctgcacactgaaaaccacaaaacattgatgaaatacattgaagaggacacaaataaataaaacgatattccatgctcatagattggaagaattaatgttgttaaagtgtccatactacccaaagcaatatatagattcaatgcaatccctatcaaaatctcatcagcattcttcacagaaatagaaaaaaatcatacaatttctgtggatccacaaaagatcccaaataaccaaagcaattctgagaaaaaaaaatcctggaggcatcatacttcccaatttaaatttatattacaaaacgagagtaatcaaaacaatacagtattggcataagagatacacaggacagtgaaatagccagaaataaatccaaacatgtatggttaatgaatttttgacaagagcaccaaaaagacaaaatgagaaaagggtagtctcttcaataaataggtgctggaatttccacatgcaaaagaatgaaattagactcttacattacaccatacacaaaaatcaatccaaaatggataaaagatctgaatgtaagacctgaagccataaatctagaagaaaacataagggaaaagctccttgacactggctttggcaatgtttccttggatatcacaccaaaacctcaggctacaaaagcaacaataaataaatgaaattatatcaatctaaaaaacttctacacagaacgaaaacaatcaacaaaatgaaaaggcaatgtacagataaggagaaaatatttgcaaaccatatatcaggcaaggttttaatattcaggatttaggaagaactcatacaactcaatagcaagacaacatataacctgattaaaaaaaagtggggaaaggacttgaatagacatttcttcaaagatgacagaaaatgaccaacaggtatatgaaatggtgctcaatatcaccagtcatcaggaaaatgcaaatcaaaactactttgagataccacctcatacatgttaggatagctattatcaaaaagacaagagctaacaagtgttggtgagggtgtggagaagagggagcacttgtacactgttagtgggaatgtattatatattggtgcagccattatggaagacagtatggaggttcctaagtaaattaaaaatagaactaccatatgacccagcaatccctcttctgggtatatccccaaagggaatgagattatctctgcactcccaagtttattgcagcacaattcacaatagtcaagatacagacacaacctaggtgttcatcaatgggcaaatggataaagaaactgtgatatagagagatcaatagatagataattagaatattatttagcctttaaaaagaaggcagtcctgtcatttgccaaaacatggatagacctagaagacattatgctaaatgaaataagccagacacagaaagaaaaatattgcgtgatctcacttatatgtggaatcaagaaaaaaaaggttaaatatatagagatagagaataaaacagtaattactaaggtcaggataaggtggaggaaatgagatgtaggtcaaaggatgcaaagtagtaaatatgcaggatgaacaagtgaaaagatcaaagatcaaatgtacaacatgaggactatagttaatacatattgtatattgtgttcaggactttttgctaaatgagtagattatacctgctcttgccaatgggggaataatcagtaactatgtgagatgatgggtatgttcattgttccactatagttttactatatatatatatatgtttcatttaacattgtgttgtataccttaatatagacaataaaatttatttaaaacataaaaaaaatcaggtttattttcttattgttgagtttaaagagttctttgtatattttggataaaagttctctatcagaatgtcctttgctaatattttatctcagtctgtggcttatcttctcattctttttacattgtcacagggtagaaatttttaattttaatgaagttcagttaatctattctttcttccattggttgtacttttggtattgcttctaaaaagtcattgctaaaccctaggtcaaccagattttctcctatgctattttacaggagttttatagtttttcattttacacttaggtctgtggtccattttaagaacatttttatgaagggtgtaaggtctgtgtctagctcccattcaaggcttattatatctcacctggagtgtcagcctgcctgcatttcttgtcccctccaattccaacttgaattgactaaattcctggtgagtgtagccaagagtcatgcctccaggcttcaggccagcacttgtggatggaacctccaggccagtacacccaggacccagctccaggataaccttggcagtctcaggcaccag

SEQ ID NO: 1053 - DNA, 386 bp, Homo sapiens
actgtttggaatgcgaagtcttccctcttaaagaagtcaaggaaacttattttatgctatttgcagtctttaataattgagtaaggcagagtcctgtgaagaaaatttggagcatgtttgtttctctctgcctgtttcctctagaatttggaaactatctccatcaaagatttctgaagcttatttggccttgtctagaacatgctgccatgtatgactgccccaagtgacaggagaaagccaaaaacaagacccagcaatggaagttttagcaggattccagctgtcagaattaaccatgagccaactcctatagaataaccatccaattgtatcctccatgcttagcctgtttgtccaagtaaattgcagacttatccagaaca

SEQ ID NO: 1054 - DNA, 26348 bp, Homo sapiens
cttttggcctctctctccctctgcaaactggtaaaagtgtcaggcctctgagcccaagccaaggcatcgcatcccctgtgacttgcacgtatatgcccagatggcctgaagtaactgaagaatcacaaaagaagtgaatatgccttgccccaccttaactgatgacattccaccacagaagaagtgtaaacggccggtccttgccttaactgatgacattaccttgtgaaagcccttttcctggctcatcctggctcaaaaagcacccccactgagcaccttgcgacccccactcctgcccgccagagaacaacccccctttgactgtaattttcctttacctacccaaatcctataaaacggccccacccctatcttccttcactgactctcttttcggactcagcccgcctgcacccaggtgaaataaacagccatgttgctcacacaaagcctgtttggtggtctcttcacatggacgcacatgaaatttggtgccgtgacttggatctggggacctcccttgggagatcaatcccccgtcctcctgctctttgctccgtgagaaagatccaactatgacctcaggtcctcagaccgaccagcccaagaaacatctcaccaatttcaaatccggtaagcgacctctttttactctcttctccaacctccctcactatccctctacctctttctcctttcaatcttggcgccacacttcaatctctcccttctcttaatttcaattcctttcattttccggtagagacaaaggagacacgttttatccgtggacccaaaactctggcgccggtcacgaactgggaaggcagccttcccttggtgtttaatcattgcagggacacctctctgatttgaaacgtgggtgaataaggtgtcagaccatgcagggatgcctgccttggtccttcacccttagccgcaagtcccgcttttctggggaaggggcaagtacctcaaccctttctctcattgtctcctaccccttctctgcttttctgggagaggggcaagtacccctcaaccccttctccttcacccttagcggcaagtcccgcttttctactgggcaagaacccccaatcccttatttccacgccccgacctcttatctctgcaccccaatcccttatttccacaccccgacctcttatctctgtgccccaatcccttatttccacaccccgacctcttatctctgtgccccaaccccttttcccacttttctggaaggtaagaacccccaaaccccttccctccgtttctctactctctcttttctctgggcttgcttccttcactatgggcaaccttccaccctccattcctccttctactcccttggcctgtgttctcaagaacttaaaacctcttcaactcacaactgacctaaaacctaaatgccttattttcttctgcaatgctgcttgaccccaatacaaactcgacagtagttccaaatagccagaaaatggcactttgaatttttccatcctgcaaaatctaaattcttgtcataaaataggcaaaccgtctgaggtgcctgacttccaggcattcttttacacagcagtcccttcctagtctctgtgcccagtgcaactcatcccaaatcttccttctttccctcccgcctgtcccctcagtaccaaccccaagcgtcgctgagtctttctaatcttccttttctacagaccaatctgacctctcccttcctccccaggctgctcctcgccaggccgagctaggtcccaattcttcctcagcctctgctcctccaccctataatctttttatcacctcccctcctcacacctggtccggcttacagtttcattccatgactagccctcccccacctgcccagcaatttactcttaaaaaggtggctggagccaaaggcatagtcaaggttaatgctcctttttctttatcccaaatcagatagcgtttaggctctttttcatcaaatataaaaacccagcccagttcacggctcgtttggcagcaaccctgagacactttacagccctagaccctaaaaggtcgaaaggccgtcttattctcaatatacattttattacccaatccgctcccgacattaaataaaactccaaaaattaaattccggccctcaaaccccacaacaggatttaattaacctcaccttcaaagtgtacaataatagaaaaaagttgcaattccttgcctccactgtgagacaaaccccagccacatctccagcacacaagaacttccaaacgcctgaaccgcagcggccaggcattcctccagaacctcctccccgaggagcttgctataagtgccagaaatgtggccaccaggccaaggaatgcctgcagcccaggattcctcctaagccacatcccatgtgtgcgggaccccactggaaatcggactgtccaactcacctggcagccactcccagagcccctggaactctggcccaaggctctctgactgcttcccagatcttcttggcttagcggctgaagactgacgctgcccaatcgcctcagaagccccctagaccatcacggacgccgagcttcaggtaactctcacaatggagggtaagtccgtccccttcttaattaatacggagtctacccactccacattaccttcttttcaagggcctgtttcccttgcctccataactgttgtgggtattgacggccaggcttctaaacctcttaaaactccccaactctggtgccaacttagacaacactcttttatgcactcttttttagttatctccacctgcccagttcccttattaggccgacatattttaaccaaattatctgcttccctgactgttcctggattatagccgcatctcattgatgcccttcttcccaatccaaagcctcctttgcgtcctcctcttgtattcccccatcttaacccacaagtataagatacctctactccctccttggcgaccgatcatgcaccccttaccatctcattaaaacctaatcacccttagcccactcaacgccaatatcccatctggcagcatgctttaaaaagattaaagcctgttatcactcgcctgctagagcatggccttttaaagcctatcaactctccttacaattcccccattttacctgtcctaaaaccagacaagccttacaagttagttcaggatctgcgccttatcaaccaaattgttctgcctatccaccccgtgctgccaaacccatatactctcctatcctcaatacctgcctctacaacccattattctgttctagatctcaaacatgctttctttactattcctttgcacgcttaatcccagcctctcttcactttcacttggactgaccctgacacccatcaagctcagcaaattacctaggctgtactgccgcaaagcttcacagacagcccccattacttcaatgaagcccaaatttcttcctcatctgttacctatctcggcataattctcataaaaacacacgtgctctccctgccagtcatgtccgactgatctctcaaacccaagcaccttctagaaaacaacaactcctttccttcctaggcatggttagcacggtcagaattcttacacaagagccaggaccacaccctgtagactttctgtccgaacaacttgaccttactgttttagcctagccctcatgtctgtgtgcagcagctgccgctgctttaatacttttagaggccctcaaaatcacaaactatgctcaactcactctccacagttctcataacttccaaaatctattttcttcctcatacctgacgcatatactttctgcttcccggctccttcagctatactcactctttgttgagtctcccacagttaccattgttcctggcccagacttgaatccggcctcccacattattcctgataccagacctgacccccatgactgtatctctctgatccacctgacattcaccccatttccccatttttccttccttcctgttgctcaccctgatcacacttgatttattgatggcagttccaacaggcctaatcgccacacaccagcaaaggcaggctatgctatagtacaagccactagcctgcctcttagaacctctcatttcctttccatcgtggaagtctatcctcaaggaaataacttctcagtgttccatctgctattctactactccttagggattattcaggccccctcccttccctacacgtcaagctcgaggatttgccccacccaggactggcaaattagctttgctcaacatgccctgagtcagataactaaaatacctcttagtctaggtagatactttcactggataggtagaggcctttcctacagggtctgagaaggccaccgcagtcatttcttccgttctgtcagacataattcctcagtttagccttcccacctcaatacagtctgataacggacgagcctttattagtcaaatcagccaagcagtttttcaggctcttagtattcagtgcaacctttatatcccttacggtcctccgtcttcaagaaaagtagaatggactaaaggtcttttaaaaacacacctcaccaagctcagccaccaacttaaaaaggactggacaatacttttaccactttcccttctcagaattcaggcctgtccttggaatgctacagggtacagcccatttaagttcctgtatagacgctcctttttattaggccccagtctcattccagacaccagaccaacgtagactgtgccccaaaaaacttgtcatcactactatcttctgtctagtcatactcctattcaccgttctcgactactcatacacgccctgctcttgtttacactgccggtttacactgtttctccaagccatcacagctgatatctcctggtgctatccccaaactgccactcttaactcttgaagtaaataaataatctttgctggcaggactatgctgaatctccttaggcactctctaatcagatattctgagtcgtcccaattcttagaccttttatacctgtctttctccttctgttattccatttagtttctcaattcatccaaaaccgtatctaggccatcaccaatcattctatatgacaaatgtttcttctaacatccccacaatatcaccccttaccacaagacctcccttcagcttaatctctcccactctaggttcccacgccgcccctaatcccgcttgaagcaggcctgagaaacatcgcccattctctctccataccaagccccaaaagttttcaccgccccaacacttcaacactattttgttttatttttcttattaatataagaaggcaggaatgtcaggcctctgagcccaagccaagccatcgcatcccctgtgacttgcacgtatacgcccagatggcctgaagtaactgaagaatcacagaagaagtgagtatgccttgccccaccttaactgatgatgttccaccacaaaagaagtgtaaatggccggtccttgccttaagtgatgacattaccttgtgaaagtccttttcctggctcatcctggctcaaaaatcacccccactgagcaccttgcgacccccactcctgcccgccagagaacaacccccctttgactgtaattttcctttacctacccaaatcctataaaatggccccacccctatctcccttcactggctctcttttcggactcagcccgcctgcccccaggtgaaataaacagccatgctgctcacacaaagcctgtttggtggtctcttcacacggacgcccatgaagaaaaggaatgacaaggaccactgtttatattctctgtaaagttttggttaatgaaaaaggatttatgaagttgttcttaagctgtaaccaatctggtgtgctttgtgtgtctttcagtatggttctgttagaaaaaaaggggtaccttaggatatcatgtgggccaaggaccccataagcccactgtttaagtcagccctgcaatctggtcagtaacaaactttgctgcaggcctccatcttattttatgtctttaggagcatgacctgtaaccatatgacagtattttgttttagtctccgccattttacaatggtggcccaggttcaatcctggcttggggaatgagtgctttcaggttgatatctgcgtgacttatgccatttgctaattctcttcccctctcatgaacaagttctagcttcctttcttaaatcatcctttccctgagccataaaggttctagattttgtaaaaaaactgcttactatgtcttgaaaatatcttgtatgctcacagttaagacataactttaattgagacttgttggtttcacctgtgaggttacttttgataaaattcaaaatccagaaatattggctgtttggcatggctaaagtcaggtaataagagatttaaaaggactttcttaaagaatgctcagcttaattaaaaatggatatccaagttataggcatatttaaaaggcctttatgttttttcttcttggatcttattttgctggaaataggttttaattagttgactgaattacttttctccatcttgtcttgccattcttaatgcacgcttgagagtccctaaggtaatttctgattgcctgggactccttgggaaaaacaaaaaaggtgccacagattccattttgggagcaacctctgttttccttatggaaccccaggaattagatgcagatagatccctctcaaaatctagttttgtcttctacctatacctgtttattagtccctagaaactgcttgttttcctagccctgcttttaaaaggccccacttgagactagtaatccaattgagagattggcaaatgaaaaatcttataactactggattttctgtttgtctgtgtagttatatatgttgtatgtgatgtatataaaaaatagctatatttaattggcttaaagaaaaataagctcttagatcaaagtttttgaaggaaaagtaaaagctgtactgctttttagttcacatgactaatctttgagaaataaaaacagtcttaaagattataggaaaatacaaatgtcattaaaatgtaaataggtgatctaaattgtgcaagtcagatactaggtttgctaaatgttttaaggttgcaaactgcttttttggcctttgagagctgtttgactggccaccatgcccttaactatgctggaaggaatcaaacttcatcagcacttaatgcataattaaaacaacttaccaggttttacactaaaattaaaatttgccgtttaatggtaaagaattatcattataacatgtaattgagaccacttaaaatggatttacatgcaaggtgtgtaagaatggtaaaatgtgtttttagtgaaagattataagaaagcatgaaaatggaaatatttgcctagagctaaaggattgttttaaattagataaaataaagctaaaggtttaaacaagttatgggatgttttaaaaaattaaccttgcaaaataaattcaaatggatattatatggtttttctgtaaattgagcattgaagtaaaaacacaacaaggtttccttaaggcactaatctgctctttagcaaaatgtgtaaagcgttataaaagttttataagaatctcacctcatggttaaactggttaagttcggatagaattgtctataaggtttcattagaaaagctgggattgacataaacggtaaactaatgtaagtgttatatttggctttctctcccttgtacaagattttcatataacagtaaaggataatgaatgattttcatttgccttgtggatagactgtcaaggagaagaaagagaagacaggagacaaactgtttggaatgcgaagtcttccctcttaaagaagtcaaggaaacttattttatgctatttgcagtctttaataattgagtaaggcagagtcctgtgaagaaaatttggagcatgtttgtttctctctgcctgtttcctctagaatttggaaactatctgtgagtattcttaacttatggcaacatgattctttgcaccagtacaacaagaagctattttcttttgcaacaggacacaattggaggaactggttcttttaccaaagtttttactagaaggatatgcttccctttaaggaatcaagcttggcttacagaattgataaaatctccttgggaaaactgtactgatagcatgtttacacagtctccatataggattcctaacctgtggtgaataaagaatgtcattttctaacagacccaggaaccccatattattaggacctcaagaagagagaaattcacccagctcataggtatttgagagtacaaacccatgcctgggctcaactttaataactcctatctgagatgccttgaggaacagagttccatcatatccaattttaaaaacctatgtaaaaataattgttcttgctgcactttatggaaataatcaggctaactataagactaaagtttattttgcaaacaactcagccctatcatgatttttaaattaattaattaatttatttttccataggttattgtggtacaggtggtatttggttacatgagtaagttctttggtggtgatttgggagattttggtgcacccatcacccgagcagtatacactgtaccatatttgtagtcttctatcccccgcccccccgtccattcttccccccaagtcctcagagagtccattgcatcatttttatgcatttgtgtcctcatagcttagctcccacatattggtgagaatatacgatgtttggttttccattcctgagttactaagaataatagtctccagtctcatccaggttattgcaaatgctcttaattcatccctttttatggctgtgtagtattctatcatatatatatatatatatgtgcatgtgtatatatatatatatatatatatatatatatatatatatatataccatagtttctttatctactcattgatagatgggcatttgggttgggtccacgattttgcaattgtgaaatttgctgctataaacatgcatgtgcaagtatcttttttgaataatgaattattttcctctgggtagatacccagtacttggattgctggatccaatggtagttttacttttagttctttaaggaatctccacagtgttttccatagcagctgtactagtttacattcccaccagcagtgtagaagtgttccctgttcaccccatccatgccagcatctactgttcttcgattttttgattatggtcagtcttgcaggagtaacgtgataccacactgtggttttgatttacatttccctgatcattagtgatgctgagcatttttttcacatgttcgttggccattagcatatctttttttgagtattgtttattcatgtccttagcctactttatgatggtattttttgtttttttcttactgatttgcttgagtttgttgtagattttgaatattagtgctttgtcagatgtatagattgtgaagatttcctcccactctgtaggttgtgtttactctgctgactgttccttttcccgtgcaaaagttctttagtttaattaggcttcagctatttatctttgtttttattgcatgtgcttttggcttcttggtcatgaaatccttgcctaagccaatgtctagaagagtttttccagtgttatctattagaatatttctggtttcaggtcttaggtttaagtccttaatccatcttgagttaatttttgtataatatgagagatgaagatccagtttcattctcctacatgttgccagccaattatcccagcaccatttgttgaaaagggtgtcccttctctgtttttgtttgttttgtcaaagatcagttggttgtaagtacttgggtttatttcttggttctctattctgttccattggtctgtgtgacaatttttgtaacagtaccatgctgttttggtgactatggccttatagtatagtttaaaatcaggtagtgtgatgcctccatatttgttctttttgcttagtcttgctttggctatgcaggctcttttttggttccatattaattttaggatatttttataagtctgtgaagaatgatggtggcgttttgatgggaattgcattgaatttgtagattgcatttggcaacatggtcattttcgcaatattgattctacccatgtgggatgtgtttccatttgttcatgtcatctatgatttctttcagcagggtttcgtagttttccttgtagaggtctttcgactccttggttacacatattcttaaatattttattttattgcagctactgtaaaaagggtcgagttcttgatttgattttccatttggttgctcttggtgtgtagaagaactattgatttgtgtatattaatcttgtatctgcaatctttgctgaattgttttatcacttttaggagctttctggaggagttcttagggttttcaaggtaagcaataatatcatcagcaaacagtgacagtttgacttcctctttactgatttggatgccatttctttctttctctgattgctatctgattgctcatttctatctgattgctctgactaggacttccagtactattttaaagaggagtggtaagagtgggcaaacttgtcttgttccagttctcagagggaatgctttcaacctttacccattcagtattatgttggctatggatagatggcttttattacattgagatatgccccttgtatgccaattttgctgagagttttaatcatgaatggatgctgggttttgtcgaatgctttttctgcatctattgagatgatcatgtgatttttgtttttaactctgtttatgtggtgtatcacatttactgtcttgcctatgttaaaccacccctgcatccctggtacaaaacccacttgatcggccgggcgcggtggctcacgcctgtaatcccagcactttgggaggctgaggcgggcagatcacgaggtcaggagatcgagaccatcctggctaacaaggtgaaaccccgtctcttctaaaaatacagaaaattagccgggcttggtagcgggcgcctgtagtcccagctactcgggaggctgaggcaggagaatggcatgaacctgggaggcggagcttgcagtgagccgagatcatgccaccgcactccagcctgggtgacagagcaagactccgtctcaaaaacaaaacaaaacaaaacaaaacaaaacaaaacaaaacacccacttgatcatggtggattatctttttgatatattgttggattcggttagcaagttttttgttaaggattttagcatctatgttcatcaaggatgtcagtctgtagttttcttttttggtgatgtcctttcctgatttcggtattagggtgattctggcttcatagaatgaattagggagggttccttctttctctatcttgtggaatggtgtcaaaaggattggaaccaattcttctttgaatgtctggtagaattctgctgtaaatgcatctgttcctggactttttttgttgttaattttttaattaccattttaatctcactgcttgttattggtctgttcgggatatctaattcttcctgatttaagctaggagggttgtagttttccaggaacttatccatctcttctaggttttctagtttatatacataaaggtgttcatagtagctgtgaatgatcttttgtatttcagtggtgtcagatgtaatatcccctgttttgtttcttgatttatcttgccaatgttctatcaattttatttatcttttcaaagaacaagctttttgtttcatttatcttttgtatttatttttgtttcaatttcatttagtttggctctgatcttggttatttcctttcttttgctgggtttgggtttgacttgctcttgtttctccagttccttgaggtgtgaccttagggtgtcaaattgtgctctttcagtctttttgatgtaggcttttatagggccaaggactttcctcttagcaccgcctttgttgtatcccagagattttgataagttgtgtcattattgtcattcagttcaaagaattttttaatttttatcttgatttacgtgtatttgtatggttttgaaggtaccttttggagttgacttccagttttattccactgtggtctgagagagtgcttgatataatttcaattttcttgaatttattgaggctcgttttatagcctatcgtatggtctttcttggaaaaatttccatgagctgttgaacagaatgtgtattctttggtctgtatatatctgataagtccatttgttccaaggtatggtttaaatccattgtttctttgctgactttctgtcttgatgacctgtctagtgctgtcagtggagtattgaagtcccccactattattgtgttgctatctatctatctcatttcttaggtccattagtaactgtgtataaatttgggagctccagtgttaggtgcatatatgtttagaattgtgatattttcctgttgaacaaggccttttaccattatataatgtccctttttgtctcttttaactgctattgctttaaagtttgttttctctgatataagaatagctacccctgcttgcttttggtttccatttgcatgaaatacaatttccccccatttactttaagtttatttgagtccttatctacaagatgagtttcctgaaggcagcagatagttggttggtgagttcttatccactctgctcttctgtatcttttaagtggagcatttaggccatttactttcagtgttagtattgaaatgtgaggtaccattgcattcatcatgctctttgttgcctgtatactttggtttttttgtttttaggttttgctttttaacttgtgtttttgttttataggtcttgtgtggtttatgttttaaagaggttctgttctgatgtgcttccaggatttgtttcaagactcagagctccttttatctgatcttgtagtggtggcttggtaatggcaaattttctcagcatttgtctgaaaaagactgtatccttcctttatatatgatgcttagtttcactggatacgaaattattagctgataattgttttgtttcaggaggctgaagatagggccccaatcccttctagcttgcagggtttctgctaagaaatctgctgttaatctgataggttttcctttataggttacctggtgcttctgtctcacagctgttaagattctttccttcatcttaactttggataacctgatgacaacgtgcctatgcaaagatctctttgagataaatttcccgagtgttctctgtgcttcctgtatttggatgtctaggtctctagcaaggccagggaagttttcctggattattcctgcaattatgttttccaagcttttagaatcctcttcttcctcaggaatactgattattcttaggtttggtcatttaacataattccagacttcttggagcttttgttcatattttctttttctttgttggtttaggttaattctaagaccttgtcttcgagctctaaatttctttcttctacttgttcaattctattgctgagactttccagagcatttcacatttctaaaagtatatccaaagtttcatgaatttttgattttttttctttaagctctctatttccttaaatatttctcccttcacttcttgtatcctattttggattttcttgcattgggctttgcctttctctggtgcctctcttattagcttaataactaacctcctgaattctttttcaggtaaatcagaaatttcttgcttttgatccattgctggtgaactagtgtattttttgggggggatgatgaggagccttgttttgtcgtattactaggggtggttttctggttccttctcatttggttgggctgtgtcagagggaaggtctacagctgaaggctgttgttcagattcttttatcccacagggtgttcccttgatttagtactctcccccttttccttactttggcttactgtgaaccgaactgcagggattgttgtctctcttctgagtctagccacccagcgagtctacccagctccaggctggtactaggggttgtctgcacagagtcctgtgacgtgaaccatctatgggtctctcagccatggataccagtgcctgttccagtggaggtgacggggtatgcaatggactctctgatggtacttagctttggtggtttaatgttctatttttgtgctggttgaccccctgccaggaggtggtgctttccagagaacatcagctgtggaattatggggaggaactagcagtgggcagggccttagaactaccaatattgtatgccctttgtctttcctaccagagtaggtaggggaggaccaccaggtgggggtagggctaggcatgtctgagctcagactcttcttgggcaggtcttgctgccactgctgtgctgtgggggatgagggtgagattcccagatcaccggaattgtgtacctaggaggattatggctgcctctgctgagtcatgcaggttgtcagggaagtgagggaaagccagcagtcacaggcctcacccagctcccatgcaaaccgaagggctggtctcgctcccaccatgtccccccagaccgtttccaggtggagagagagatgggcttgaaaacctgccccaggctgtctgcctcccagctgtgaaagaaaggggcttgcttcttcccctacctgtggagtctgcacaccagatttgcgccctctccagagttctggtcagaaagcttttcacccctttcaaattgttaaagttcagctagagatttgcttctctctgtgtagctttagcccctgcttttctcctgttggtttcctgtggtgccaggaaggaatggcctgctaggggacccagctagctcccaggggcctttctgctgtttcctctacacctgtatttcacttggctctccaaattgactcagctcaaggtaaagtcagaaacttctcccacaaacagacctttggcttctcctgtgcgggtatgtgttcaggagaggagggtctccctttcccacttctgcagttcagtcattcacaattttgggggggtctcctgggtcctgcaggagcagtccgcttccttcagagggtctgtgggtcctttggggattgctgattgactcttgcagtacatctggagttaaaattcacaatgtgagtcgctgcccactgctctgtacggagctgcaatctagtcctgactcccatctgccatgatctcccatgatttgctttcaacaaaaatgaggactggagagagagaaattatgtttcaaaaattatcctacatttgtcattaaattctagaatcattagttgttttttgcctacaatttggactaatcctactcattcctgtgaaccaaccagaaaactctggctgcagctcagaagaaacaaaagaaatgtgtagtgtaaaaatctggatcaatagtctagttctgggcagttaccctgcaaatcctgccaggtgataggaataaatagggtgtctgcaacccagagtttggtttttttgttttttgttttttataagaccaagagagctaaccaaagtgaaaccccatgtacctagatcttagcaagcataactatagccaccggttatctgggcatgctagcagcctcagaatttttaagctgtccttgcccccacttttgtttcattttgatatatgtcttctaatcattttgtttgtctcttctcaccttcaggccattgaactccaaatggtcaagcaaccggagcctcgaacaatggccctccttttaccagggatccttagataggcctctgagagagatctgactgctgttttcacaatacagcaccaccagtcagcagaaagcatttaagatcagttgttatcgtccttatccttatccttgtccttgtccttgtccttatcctaatggcagttagatgtacttctttggagggggtaatgatagaggcaggagacagccaaatgtctaggcaattagggaagggtacccagagaacctccaacccatctaggtcattgtgtgcaggggtcttgcctaaacatgcccacagtaaaaaattctctcccttaacacatgcacagtacaggaaataaatcagtctggagtgactcagactaagggcccacatgctcactagaagaatggggtggagccaccaagaatttgtgccttatgcagggaaggaggctggcatcttcaactcatgtgtagtggcctaatattcaatttgtgaggtggaaacctgcatctaagacctctcattttgttgacagctttttttttttttttttttgattaacaaattctgccctccttaccttttaatgtgtctacatgcctaatttttcctggttgtgaaacaagatcccagatttagctgaactaaggagcaaaaatcttgcatccaaaataccataattaaataggaaacaaactggagcacgctttaaagacagatgcagatttgaatattttcttaaacctttgagaataaagatacatctatttaagatcttctcagggacaaacattagcttttttcaatatttaaatgtaaacatctctacccatacatgaaggaatcccaacaacttaatatttagccattatggtgattggaagttctcttatattttgctggtaatttaactctctcactaccacagggttcttttgtttgcttggctgtctactttcctgactgaaaggacaaacccttatttctgacctttctgctgttaacctttttggctcagtcaggattgccttcaatttcctttgaaggtaaaagtacactttagcaagtagaaggcataagtaagcaatagacttgttcaatgaatcactgaatgaatgaaagaatccatgactactttattatcatcttttttttttttttttttttttttgagatggagtctcactctatttcctaggctggagtgcaatggcatgatatcagctcatggcagcctctgcctcccgggttcaagcgattctcctgcctcagcctcccaagtagctgggattacaggcaggagccaccatgctctgataattttgtatttttagtagagacgaggtttcaccatgttggtcaggctggtcttgagctcctgacttcaagtgatctacctgcctcggcctccctaattgctgggattacaggcctgagccaaccctccagccaattatcatttctttcactttgctttacttctaaagacattttacacttgttttgagtttcttttccttttttttctttttcgacatttgttttagattctggggatacatgtgaaggatttttacaaaggtatattgtgagattctgaggtttggggtatgaattatcccatctcctgtagtacccaaaaggtagttttaaattatttccccactctaccctcttatattccccagtgtctattgtttccatctttatgtcaacatgtaccctttgtttagctcctacttataagtgagaacatgcaatattttattttctgtttctgcatcctttcacataagataatggcttctagatgcatccatgttgctgcaaaggacattattttattctatttttatggctgcatagtatttgatgatgtatatgtaccacattttctttttcccatccacaattgatgggcacctgggttgattccatgtctttgctattgtgaacagtgctgtgaagaacatatgggtacatgtgtctttttggtagaatgatttattttcctttgagtatataccaagcaatgggatgggattgttggctcaaatggtagttctgttttaagttctttgagaaatctccaaactttccacagtgcctgaactaatttacatttctgccagcagtgttgtaagcattcccttttctccccagccccaccaacaccttattttttccttttttttttttaaagccattgtgattgctgtgaatttgtatctcattgtggttttgatttacatttttgagttccttttgttttggactcactttttccatttctgtgtcttagcagtataaaatagagattatgattgcctggtgtacctacatgttagagtcatgaatacttgagaacaacttttactttgaaagcagtatttacaatttttttatcagtatttgcctgttaagtgtttactgattacattgtgttaaattgtttttaacacttatcactcagagagcaaaagtatttgatagtttgagacaaactgcttaaagaacttgtagctgcaaatcaatgctgtactaggatatcattttaaaaacacatttaaactaagcatatgattttccaacagacttatttctcaatgattgttgaaaactaaaacttccctggccatcgtgaaattgtagtagaatatatatatagaaagcttggtgctgtttaaaaacagttacttcagtgactccttattgcttacagtatagagttctaaattcttatcctcaatacataaatccatagtctcctgctttaccattagtctccctcatgaactctaaagtagaagcttcttttcacttaccctcaatatagtttgtactctttttatagctctatttccatgcatttttattcaattcctttgcttaagatggtctcactaatcctttctttttgtaattattattatcaaaaattttgatattaaataatttcattgagcacatggtaactatacaatgttatttaagtacctgacattgattttctcctttaattcttctgataacccaatgcagcagatactattatgatcactatttcacagataagaaacctgagaccaaaaagattacatagcttgttcaaagtcctgataatacacactatatagtggctgagcttgatttcaaacccagttttatactgatacaagagttttgactcttgtgttattctacctggaatcagcaccctcaaaacacttttgtttcatattataactaattaaagatagtaaatggttctctggtgcaggttttttgctccttagttcagttaaatatgggttcttgtctcatggccaggaaaaattaggcatgtagcagattgaaaagtgaggagggtggaatttactaagcaaaaggaaaactgtcaacaaaaagaggggtcctgcacacaagttttcacctcacaagttgagtaccaggccaccatacacgagttgaagaggccagccttcttccctgtatgaggcgcaaattcctggtagctccaccccattcttccgcacagccatcaaagatttctgaagcttatttggccttgtctagaacatgctgccatgtatgactgccccaagtgacaggagaaagccaaaaacaagacccagcaatggaagttttagcaggattccagctgtcagaattaaccatgagccaactcctatagaataaccatccaattgtatcctccatgcttagcctgtttgtccaagtaaattgcagacttatccagaacagagactgtgtattatttgtatccttatccccttctacaatagaggttaaatgaggttttgaaaccatggaaacttactggtaactgtatcacaatgctcatattttcttgaccatgttgaaaacacatttttttcccaacccagtataacatgttaaaatggaatactttcaatctcagtgtttctgcagtggccttacagtctgagaatagtacaatatgtgctatgtatgatcacattctaaagcaatgggctatatgaaaaatctagaccacaataccttgctaatatattgtgaaacaggttttgttgccactagccagcccatgatttcatgcagggctaaggaggaggaatgtattaacattgtgactttgaagaatctgggatgagaatgtataaattgcttcctgcttggagttctttccactacattccataaactacataatgcagaatctccatgaatatcacattgggtattttctgtgagtagttcagcccctaaagtctatcaacctaggaatttcctttccacagggaaattacaattatcctcagcctcatccagattctggtagtctatatacttttccaacaaaattaagactttgggggcaaattatacctatgtactagacttcatgtcagcacaatgtacaatgaataccaatactatactcaaatgttgttgggaaccaaaatgttgaggccaagagctggcttattactgaaaatggggtgggacttatacttaagacagagtctgtgcatcttctgtaaagcgggtgaacatactaaaagtgggccaatctaaaggatcaaaaaatcatcaactgatcttccttttgccagaaaaagcaacaacaaattatcaaagacagtttgcaaaataacagagagataaggctgggttgagtatggcctgaatttccagagttcaaattcactagtgaattccaactcattattaatcaatggaatccaaattaaaacatttattttacatatcacatcagaaaaatattaaaaagaatgataatgcctggagatggagatgggagtgtggagatttaagatatgtaatagactagtgatgaggttatacattggtacaatatttatgaaatttaattataaaataactgaaaagttttaaaaatttggtatattccttaatacagacaatccacacctaggaaagtgtcctactggaaatatagatgtaggtataaacatagatattcagtgtaatattattgtgaaagaaaaaacaaaacctatatgatcatcattaggaagttaatttagtaaatcatggtctatccatctaattgaatgctataggtccactaaaatctatgatgtctgtttatataaataaacacaaaatgatgcctaaaacattatgtgaaaagttcagtttgcatatcattgtgtatagtataatccaatttcattaaaaatacctttaacatgtaaatataactatgcatgcatgtgcatatactacacaggaaaaagttttgagaaaacacattgaacattcatggtctccctagagatcaaggaactccacattatgaaatcctgccacatccacagtcccactaagttaggcattatacattatttgggcagattaaaactatttgtttttctcttgtcttcctcttcaaatttttcacactctagcatttgcaaaagtaaaagttttattttttccttctaaatttttaagaggtgttagcagtaatataaatttttacacataatgtttctgatatatgctaaggcagaaattatacaccaaaattcctgttttactcaccagatatcttgcacataatgacatagactgccctatgttgaggaaaattttaagatattcacagctaactactgagtcagcccatattcagaaagggaacaatgccaagcaatacatttatttgactatgtctcactggatatatggaccagaacatcagtgctaccactatcattttagcacagattattattatttttttcttttgagatggagtcttactctgttgcccaggctggagcgcagtggcatgatctcagctcactgcagcctttgcctcttgggttccagcgattctctcacctcagcctcctgggtagctgggattacaggcgcacaccaccacacctggctaatttttgtatttttagtagagatgggtttcaccatgttgaccaggctggtctcaaactcctgacctcaggtgctccgcccacctccacctcccagagtgctgggattacaggcatgagccactgtgctgggcctacagatcattttttttacaacacatgtggaactcactgaaaaaaatgcagtttcaatcaaatgggactgccaaacctcaaattgtatgtctttgacagggattaaatgatgtcagttgtattgaatttggtattagtgtttggtgggagtaatctcaaaagcctttttaagtagatccaatgtcactggtttaactaaagtatataaattcaggaggactagtcctagatttgttaccatagatattttcccaaatgtccctccttcataaaaatgtcacctttcgtaactctcagtaatttcttttcaggttgtaggcaggtctccatttagcaaatggtgttctcagtaaggttttttcttcttcaaggtactctggatgttgccattaattatatcctcacagtatacattgttaaacattttgggattcattttgcttatgggcataatttcacaaagcctcttctaatggctcttggttgggcattgagacaccagatttatttctctgaagaaaaagaatatccttaatatgccgtaagatgtggtttgggatatttgtatggtaaagatgattctgaggataaaggtgactttttcattcaagttgactacatattgattcatcttagagagagaaaaaaggaaaaatcagatccaagaaggctttcaaatgcattcccagcgcgtttcacaaagacagttttaagacattttgagaagaagtatattttatgtttgaagttaacttttcaataaggaattttgattgcttggaatttaattatctctttgaggtgcggtattcacagaaactgtaccatagcattggaaaaacagggaaagacaagatcatctcttctttatgttttgttaacacttgtcacccttaagatgtcttttgttgtaggagcttaacaaatatatctttgtgatggatggaggtaacccaagtgagtacaaataaattatgacagacaagataacttttcttacctcctcatgcaatggtaatatttgtagaatatgttgtcagtttccaaacaaaatatgtcaaagaataaacttccaataaatatccccagatattctaatcacggctttaaataggtaacatggtctttgtggaaataagagatccagttgatgacaaagcaacgaatgagactgaatgtcaacaaagttatatgaaaggtatttattcacctgaggacagattagaaaggtagcaaacacttgggaatattttatctttggaaaaataatgaagtatttgatcataaagatctgctaaagtaaaatagagcatatgcctcatgacatttaattaatcattaatttcatgcctgtgtattgtgggttaaaaagatgttttcaatatgaattgatccaaaacaactctttaagttagtattattaaaatacatcatttatataacaaattttcacagccagagaatgtggaagcataaaatgccaatggtcactgtatctcaattcattttctgccaacttattttctctctgattgctgtgaggctaatattagagtcggttacatcctctatttcctaagttgcctatgtgaatgttagtaaaaaaataataattttacttcactatctggtgaatgtttgaactatatgtttatgaatgaggaaagtgaaacaacaaaaatttcctttgtaggtaaaattcagggtgttcattggaaaaagggctattttagataagacatttttatttatgaaggataagttgaaatacagtattggaatttaaaatcattcatgtaaaagttaatgggtctgtcctttgattatatagccaaggctgagttcttaataaaaatgctaaaatgatcattaataacattctgtacactgatatcccatctggaagttatcacaaatgcatgttctggagtgctaagttcataattattttagagaactgatttaggtattgtagagaggcactagatattcttttatttacaggtgacatgattttattatccataactttccatccactgaatagtgagacattttttctgaatgaggacttatagtattaataattagctcaaggatattggtctaaaattctcttttttggttgtgtctctgcccggctttggtatcaggatgatgctggcctcatcaaatgagttagggaggattccgtctttttctattgattggaatagtttcagaaggcatggtaccagttcctccttgtacctctggtagaattcggctgtgaatccatctgttcctggactctttttggttggtaagctattgattattgcctcaatttcagaggctgttattggtctattcagagagtcaacttcttcctggtttagtcttgggagggtgtatgtgtcgaggaatttatccatttcttctagattttctagtttatttgtgtagaggtgtttgtagtattctgatggtagtttgtatttctgtaggatcagtggtgatatcccctttatcattttctatcacatctatttgattcttctctcttttcttctttattagtcttgctagcggtctatcaattttgttgatcctttcacaaaaccagctcttggaccaatatccttgatgaacatcgatgcaaaaatcctcaataaaatactggcaaactgaatccagcaacacatcaaaaagcttatccaccatgatcaagtgggcttcatccctgggatgcaaggctggttcaatatatgaaaatcaataaatgtaatccagcatataaacagaaccaaagacaaaaaccacacgattatctcaatagatgcagaaaaggcctttgacaaaattcaacaacgcttcatgctaaaaactctcaataaattaggtattgatgagacatatctcaaaataataagagctatctatgacaaacccacagccaatatcatactgaatgggcaaaaactggaagccttccctttgaaaactggcacaagacagggatgccctctctcaccactcctactcaacatagtgttggaagttctggcaagggcaattaggcaggagaaggaaatcaagggtattcaattaggaaaagaggaagtcaaattgtccctgtttgcagatgacatgattgtatatctacaaaaccccattgtttcagcccaaaatctccttaagctcataagcaacttcagcagtctcaggatacaaaatcaatgtacaaaaattacaagcattcttatacaccaacaagacaaacagagagccaaatcatgagtgaactcccattcacaattgcttcaaagagaataaagtacctaggaatccaacttacaagggacgtgaaggacctcttcaaggagaactacaaaccactgctcaatgaaataagagaggatacaaacaaatggaagaacattccatgctcatgggtaggaagaatcaatatcatgaaaatggccatactgcccaaggtaatttatagattcagtgccatccccatcaagctaccaatgactttcttcatagaattggaaaaaactactttaaagttcatatggaaccaaaaaagagcccgcatcaccaagtcaatcctaagccaaaagaacaaagccggaggcatcatgctacctgacttcaaactacactacaaggctacagtaaccaaaacagcatggtactggtaccaaaacagagatatagatcaatggaacagagcagagccctcagaaataatgccgcatatctacaactatctgatctttgacaaacctgagaaaaacaagcaatggggaaaggattccctatttaataaatggtgctgggaaaactgggtagctatatggagaaagctgaaactggatcccttccttacaccttaaacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaatggacaaatgggatctgcttaaactaaagagcttctgcacagcaaaagaaactaccatcagagtgaacaggcaacctacaaaatgggagaaaattttcgcagcctactcatctgacaaagggctaatatccagaatctacaatgaactcaaacgcatttacaagaaaaaaacaaacaaccccatcaaaaagtgagcgaaggacatgaacagacacatctcaaaagaagacatttatgcagccaaaaaacacatgaaaaaatgctcaccatcactggccatcagagaaatgcaaatcaaa

SEQ ID NO: 1055 - DNA, 32499 bp, Homo sapiens
cttttggcctctctctccctctgcaaactggtaaaagtgtcaggcctctgagcccaagccaaggcatcgcatcccctgtgacttgcacgtatatgcccagatggcctgaagtaactgaagaatcacaaaagaagtgaatatgccttgccccaccttaactgatgacattccaccacagaagaagtgtaaacggccggtccttgccttaactgatgacattaccttgtgaaagcccttttcctggctcatcctggctcaaaaagcacccccactgagcaccttgcgacccccactcctgcccgccagagaacaacccccctttgactgtaattttcctttacctacccaaatcctataaaacggccccacccctatcttccttcactgactctcttttcggactcagcccgcctgcacccaggtgaaataaacagccatgttgctcacacaaagcctgtttggtggtctcttcacatggacgcacatgaaatttggtgccgtgacttggatctggggacctcccttgggagatcaatcccccgtcctcctgctctttgctccgtgagaaagatccaactatgacctcaggtcctcagaccgaccagcccaagaaacatctcaccaatttcaaatccggtaagcgacctctttttactctcttctccaacctccctcactatccctctacctctttctcctttcaatcttggcgccacacttcaatctctcccttctcttaatttcaattcctttcattttccggtagagacaaaggagacacgttttatccgtggacccaaaactctggcgccggtcacgaactgggaaggcagccttcccttggtgtttaatcattgcagggacacctctctgatttgaaacgtgggtgaataaggtgtcagaccatgcagggatgcctgccttggtccttcacccttagccgcaagtcccgcttttctggggaaggggcaagtacctcaaccctttctctcattgtctcctaccccttctctgcttttctgggagaggggcaagtacccctcaaccccttctccttcacccttagcggcaagtcccgcttttctactgggcaagaacccccaatcccttatttccacgccccgacctcttatctctgcaccccaatcccttatttccacaccccgacctcttatctctgtgccccaatcccttatttccacaccccgacctcttatctctgtgccccaaccccttttcccacttttctggaaggtaagaacccccaaaccccttccctccgtttctctactctctcttttctctgggcttgcttccttcactatgggcaaccttccaccctccattcctccttctactcccttggcctgtgttctcaagaacttaaaacctcttcaactcacaactgacctaaaacctaaatgccttattttcttctgcaatgctgcttgaccccaatacaaactcgacagtagttccaaatagccagaaaatggcactttgaatttttccatcctgcaaaatctaaattcttgtcataaaataggcaaaccgtctgaggtgcctgacttccaggcattcttttacacagcagtcccttcctagtctctgtgcccagtgcaactcatcccaaatcttccttctttccctcccgcctgtcccctcagtaccaaccccaagcgtcgctgagtctttctaatcttccttttctacagaccaatctgacctctcccttcctccccaggctgctcctcgccaggccgagctaggtcccaattcttcctcagcctctgctcctccaccctataatctttttatcacctcccctcctcacacctggtccggcttacagtttcattccatgactagccctcccccacctgcccagcaatttactcttaaaaaggtggctggagccaaaggcatagtcaaggttaatgctcctttttctttatcccaaatcagatagcgtttaggctctttttcatcaaatataaaaacccagcccagttcacggctcgtttggcagcaaccctgagacactttacagccctagaccctaaaaggtcgaaaggccgtcttattctcaatatacattttattacccaatccgctcccgacattaaataaaactccaaaaattaaattccggccctcaaaccccacaacaggatttaattaacctcaccttcaaagtgtacaataatagaaaaaagttgcaattccttgcctccactgtgagacaaaccccagccacatctccagcacacaagaacttccaaacgcctgaaccgcagcggccaggcattcctccagaacctcctccccgaggagcttgctataagtgccagaaatgtggccaccaggccaaggaatgcctgcagcccaggattcctcctaagccacatcccatgtgtgcgggaccccactggaaatcggactgtccaactcacctggcagccactcccagagcccctggaactctggcccaaggctctctgactgcttcccagatcttcttggcttagcggctgaagactgacgctgcccaatcgcctcagaagccccctagaccatcacggacgccgagcttcaggtaactctcacaatggagggtaagtccgtccccttcttaattaatacggagtctacccactccacattaccttcttttcaagggcctgtttcccttgcctccataactgttgtgggtattgacggccaggcttctaaacctcttaaaactccccaactctggtgccaacttagacaacactcttttatgcactcttttttagttatctccacctgcccagttcccttattaggccgacatattttaaccaaattatctgcttccctgactgttcctggattatagccgcatctcattgatgcccttcttcccaatccaaagcctcctttgcgtcctcctcttgtattcccccatcttaacccacaagtataagatacctctactccctccttggcgaccgatcatgcaccccttaccatctcattaaaacctaatcacccttagcccactcaacgccaatatcccatctggcagcatgctttaaaaagattaaagcctgttatcactcgcctgctagagcatggccttttaaagcctatcaactctccttacaattcccccattttacctgtcctaaaaccagacaagccttacaagttagttcaggatctgcgccttatcaaccaaattgttctgcctatccaccccgtgctgccaaacccatatactctcctatcctcaatacctgcctctacaacccattattctgttctagatctcaaacatgctttctttactattcctttgcacgcttaatcccagcctctcttcactttcacttggactgaccctgacacccatcaagctcagcaaattacctaggctgtactgccgcaaagcttcacagacagcccccattacttcaatgaagcccaaatttcttcctcatctgttacctatctcggcataattctcataaaaacacacgtgctctccctgccagtcatgtccgactgatctctcaaacccaagcaccttctagaaaacaacaactcctttccttcctaggcatggttagcacggtcagaattcttacacaagagccaggaccacaccctgtagactttctgtccgaacaacttgaccttactgttttagcctagccctcatgtctgtgtgcagcagctgccgctgctttaatacttttagaggccctcaaaatcacaaactatgctcaactcactctccacagttctcataacttccaaaatctattttcttcctcatacctgacgcatatactttctgcttcccggctccttcagctatactcactctttgttgagtctcccacagttaccattgttcctggcccagacttgaatccggcctcccacattattcctgataccagacctgacccccatgactgtatctctctgatccacctgacattcaccccatttccccatttttccttccttcctgttgctcaccctgatcacacttgatttattgatggcagttccaacaggcctaatcgccacacaccagcaaaggcaggctatgctatagtacaagccactagcctgcctcttagaacctctcatttcctttccatcgtggaagtctatcctcaaggaaataacttctcagtgttccatctgctattctactactccttagggattattcaggccccctcccttccctacacgtcaagctcgaggatttgccccacccaggactggcaaattagctttgctcaacatgccctgagtcagataactaaaatacctcttagtctaggtagatactttcactggataggtagaggcctttcctacagggtctgagaaggccaccgcagtcatttcttccgttctgtcagacataattcctcagtttagccttcccacctcaatacagtctgataacggacgagcctttattagtcaaatcagccaagcagtttttcaggctcttagtattcagtgcaacctttatatcccttacggtcctccgtcttcaagaaaagtagaatggactaaaggtcttttaaaaacacacctcaccaagctcagccaccaacttaaaaaggactggacaatacttttaccactttcccttctcagaattcaggcctgtccttggaatgctacagggtacagcccatttaagttcctgtatagacgctcctttttattaggccccagtctcattccagacaccagaccaacgtagactgtgccccaaaaaacttgtcatcactactatcttctgtctagtcatactcctattcaccgttctcgactactcatacacgccctgctcttgtttacactgccggtttacactgtttctccaagccatcacagctgatatctcctggtgctatccccaaactgccactcttaactcttgaagtaaataaataatctttgctggcaggactatgctgaatctccttaggcactctctaatcagatattctgagtcgtcccaattcttagaccttttatacctgtctttctccttctgttattccatttagtttctcaattcatccaaaaccgtatctaggccatcaccaatcattctatatgacaaatgtttcttctaacatccccacaatatcaccccttaccacaagacctcccttcagcttaatctctcccactctaggttcccacgccgcccctaatcccgcttgaagcaggcctgagaaacatcgcccattctctctccataccaagccccaaaagttttcaccgccccaacacttcaacactattttgttttatttttcttattaatataagaaggcaggaatgtcaggcctctgagcccaagccaagccatcgcatcccctgtgacttgcacgtatacgcccagatggcctgaagtaactgaagaatcacagaagaagtgagtatgccttgccccaccttaactgatgatgttccaccacaaaagaagtgtaaatggccggtccttgccttaagtgatgacattaccttgtgaaagtccttttcctggctcatcctggctcaaaaatcacccccactgagcaccttgcgacccccactcctgcccgccagagaacaacccccctttgactgtaattttcctttacctacccaaatcctataaaatggccccacccctatctcccttcactggctctcttttcggactcagcccgcctgcccccaggtgaaataaacagccatgctgctcacacaaagcctgtttggtggtctcttcacacggacgcccatgaagaaaaggaatgacaaggaccactgtttatattctctgtaaagttttggttaatgaaaaaggatttatgaagttgttcttaagctgtaaccaatctggtgtgctttgtgtgtctttcagtatggttctgttagaaaaaaaggggtaccttaggatatcatgtgggccaaggaccccataagcccactgtttaagtcagccctgcaatctggtcagtaacaaactttgctgcaggcctccatcttattttatgtctttaggagcatgacctgtaaccatatgacagtattttgttttagtctccgccattttacaatggtggcccaggttcaatcctggcttggggaatgagtgctttcaggttgatatctgcgtgacttatgccatttgctaattctcttcccctctcatgaacaagttctagcttcctttcttaaatcatcctttccctgagccataaaggttctagattttgtaaaaaaactgcttactatgtcttgaaaatatcttgtatgctcacagttaagacataactttaattgagacttgttggtttcacctgtgaggttacttttgataaaattcaaaatccagaaatattggctgtttggcatggctaaagtcaggtaataagagatttaaaaggactttcttaaagaatgctcagcttaattaaaaatggatatccaagttataggcatatttaaaaggcctttatgttttttcttcttggatcttattttgctggaaataggttttaattagttgactgaattacttttctccatcttgtcttgccattcttaatgcacgcttgagagtccctaaggtaatttctgattgcctgggactccttgggaaaaacaaaaaaggtgccacagattccattttgggagcaacctctgttttccttatggaaccccaggaattagatgcagatagatccctctcaaaatctagttttgtcttctacctatacctgtttattagtccctagaaactgcttgttttcctagccctgcttttaaaaggccccacttgagactagtaatccaattgagagattggcaaatgaaaaatcttataactactggattttctgtttgtctgtgtagttatatatgttgtatgtgatgtatataaaaaatagctatatttaattggcttaaagaaaaataagctcttagatcaaagtttttgaaggaaaagtaaaagctgtactgctttttagttcacatgactaatctttgagaaataaaaacagtcttaaagattataggaaaatacaaatgtcattaaaatgtaaataggtgatctaaattgtgcaagtcagatactaggtttgctaaatgttttaaggttgcaaactgcttttttggcctttgagagctgtttgactggccaccatgcccttaactatgctggaaggaatcaaacttcatcagcacttaatgcataattaaaacaacttaccaggttttacactaaaattaaaatttgccgtttaatggtaaagaattatcattataacatgtaattgagaccacttaaaatggatttacatgcaaggtgtgtaagaatggtaaaatgtgtttttagtgaaagattataagaaagcatgaaaatggaaatatttgcctagagctaaaggattgttttaaattagataaaataaagctaaaggtttaaacaagttatgggatgttttaaaaaattaaccttgcaaaataaattcaaatggatattatatggtttttctgtaaattgagcattgaagtaaaaacacaacaaggtttccttaaggcactaatctgctctttagcaaaatgtgtaaagcgttataaaagttttataagaatctcacctcatggttaaactggttaagttcggatagaattgtctataaggtttcattagaaaagctgggattgacataaacggtaaactaatgtaagtgttatatttggctttctctcccttgtacaagattttcatataacagtaaaggataatgaatgattttcatttgccttgtggatagactgtcaaggagaagaaagagaagacaggagacaaactgtttggaatgcgaagtcttccctcttaaagaagtcaaggaaacttattttatgctatttgcagtctttaataattgagtaaggcagagtcctgtgaagaaaatttggagcatgtttgtttctctctgcctgtttcctctagaatttggaaactatctgtgagtattcttaacttatggcaacatgattctttgcaccagtacaacaagaagctattttcttttgcaacaggacacaattggaggaactggttcttttaccaaagtttttactagaaggatatgcttccctttaaggaatcaagcttggcttacagaattgataaaatctccttgggaaaactgtactgatagcatgtttacacagtctccatataggattcctaacctgtggtgaataaagaatgtcattttctaacagacccaggaaccccatattattaggacctcaagaagagagaaattcacccagctcataggtatttgagagtacaaacccatgcctgggctcaactttaataactcctatctgagatgccttgaggaacagagttccatcatatccaattttaaaaacctatgtaaaaataattgttcttgctgcactttatggaaataatcaggctaactataagactaaagtttattttgcaaacaactcagccctatcatgatttttaaattaattaattaatttatttttccataggttattgtggtacaggtggtatttggttacatgagtaagttctttggtggtgatttgggagattttggtgcacccatcacccgagcagtatacactgtaccatatttgtagtcttctatcccccgcccccccgtccattcttccccccaagtcctcagagagtccattgcatcatttttatgcatttgtgtcctcatagcttagctcccacatattggtgagaatatacgatgtttggttttccattcctgagttactaagaataatagtctccagtctcatccaggttattgcaaatgctcttaattcatccctttttatggctgtgtagtattctatcatatatatatatatatatgtgcatgtgtatatatatatatatatatatatatatatatatatatatatataccatagtttctttatctactcattgatagatgggcatttgggttgggtccacgattttgcaattgtgaaatttgctgctataaacatgcatgtgcaagtatcttttttgaataatgaattattttcctctgggtagatacccagtacttggattgctggatccaatggtagttttacttttagttctttaaggaatctccacagtgttttccatagcagctgtactagtttacattcccaccagcagtgtagaagtgttccctgttcaccccatccatgccagcatctactgttcttcgattttttgattatggtcagtcttgcaggagtaacgtgataccacactgtggttttgatttacatttccctgatcattagtgatgctgagcatttttttcacatgttcgttggccattagcatatctttttttgagtattgtttattcatgtccttagcctactttatgatggtattttttgtttttttcttactgatttgcttgagtttgttgtagattttgaatattagtgctttgtcagatgtatagattgtgaagatttcctcccactctgtaggttgtgtttactctgctgactgttccttttcccgtgcaaaagttctttagtttaattaggcttcagctatttatctttgtttttattgcatgtgcttttggcttcttggtcatgaaatccttgcctaagccaatgtctagaagagtttttccagtgttatctattagaatatttctggtttcaggtcttaggtttaagtccttaatccatcttgagttaatttttgtataatatgagagatgaagatccagtttcattctcctacatgttgccagccaattatcccagcaccatttgttgaaaagggtgtcccttctctgtttttgtttgttttgtcaaagatcagttggttgtaagtacttgggtttatttcttggttctctattctgttccattggtctgtgtgacaatttttgtaacagtaccatgctgttttggtgactatggccttatagtatagtttaaaatcaggtagtgtgatgcctccatatttgttctttttgcttagtcttgctttggctatgcaggctcttttttggttccatattaattttaggatatttttataagtctgtgaagaatgatggtggcgttttgatgggaattgcattgaatttgtagattgcatttggcaacatggtcattttcgcaatattgattctacccatgtgggatgtgtttccatttgttcatgtcatctatgatttctttcagcagggtttcgtagttttccttgtagaggtctttcgactccttggttacacatattcttaaatattttattttattgcagctactgtaaaaagggtcgagttcttgatttgattttccatttggttgctcttggtgtgtagaagaactattgatttgtgtatattaatcttgtatctgcaatctttgctgaattgttttatcacttttaggagctttctggaggagttcttagggttttcaaggtaagcaataatatcatcagcaaacagtgacagtttgacttcctctttactgatttggatgccatttctttctttctctgattgctatctgattgctcatttctatctgattgctctgactaggacttccagtactattttaaagaggagtggtaagagtgggcaaacttgtcttgttccagttctcagagggaatgctttcaacctttacccattcagtattatgttggctatggatagatggcttttattacattgagatatgccccttgtatgccaattttgctgagagttttaatcatgaatggatgctgggttttgtcgaatgctttttctgcatctattgagatgatcatgtgatttttgtttttaactctgtttatgtggtgtatcacatttactgtcttgcctatgttaaaccacccctgcatccctggtacaaaacccacttgatcggccgggcgcggtggctcacgcctgtaatcccagcactttgggaggctgaggcgggcagatcacgaggtcaggagatcgagaccatcctggctaacaaggtgaaaccccgtctcttctaaaaatacagaaaattagccgggcttggtagcgggcgcctgtagtcccagctactcgggaggctgaggcaggagaatggcatgaacctgggaggcggagcttgcagtgagccgagatcatgccaccgcactccagcctgggtgacagagcaagactccgtctcaaaaacaaaacaaaacaaaacaaaacaaaacaaaacaaaacacccacttgatcatggtggattatctttttgatatattgttggattcggttagcaagttttttgttaaggattttagcatctatgttcatcaaggatgtcagtctgtagttttcttttttggtgatgtcctttcctgatttcggtattagggtgattctggcttcatagaatgaattagggagggttccttctttctctatcttgtggaatggtgtcaaaaggattggaaccaattcttctttgaatgtctggtagaattctgctgtaaatgcatctgttcctggactttttttgttgttaattttttaattaccattttaatctcactgcttgttattggtctgttcgggatatctaattcttcctgatttaagctaggagggttgtagttttccaggaacttatccatctcttctaggttttctagtttatatacataaaggtgttcatagtagctgtgaatgatcttttgtatttcagtggtgtcagatgtaatatcccctgttttgtttcttgatttatcttgccaatgttctatcaattttatttatcttttcaaagaacaagctttttgtttcatttatcttttgtatttatttttgtttcaatttcatttagtttggctctgatcttggttatttcctttcttttgctgggtttgggtttgacttgctcttgtttctccagttccttgaggtgtgaccttagggtgtcaaattgtgctctttcagtctttttgatgtaggcttttatagggccaaggactttcctcttagcaccgcctttgttgtatcccagagattttgataagttgtgtcattattgtcattcagttcaaagaattttttaatttttatcttgatttacgtgtatttgtatggttttgaaggtaccttttggagttgacttccagttttattccactgtggtctgagagagtgcttgatataatttcaattttcttgaatttattgaggctcgttttatagcctatcgtatggtctttcttggaaaaatttccatgagctgttgaacagaatgtgtattctttggtctgtatatatctgataagtccatttgttccaaggtatggtttaaatccattgtttctttgctgactttctgtcttgatgacctgtctagtgctgtcagtggagtattgaagtcccccactattattgtgttgctatctatctatctcatttcttaggtccattagtaactgtgtataaatttgggagctccagtgttaggtgcatatatgtttagaattgtgatattttcctgttgaacaaggccttttaccattatataatgtccctttttgtctcttttaactgctattgctttaaagtttgttttctctgatataagaatagctacccctgcttgcttttggtttccatttgcatgaaatacaatttccccccatttactttaagtttatttgagtccttatctacaagatgagtttcctgaaggcagcagatagttggttggtgagttcttatccactctgctcttctgtatcttttaagtggagcatttaggccatttactttcagtgttagtattgaaatgtgaggtaccattgcattcatcatgctctttgttgcctgtatactttggtttttttgtttttaggttttgctttttaacttgtgtttttgttttataggtcttgtgtggtttatgttttaaagaggttctgttctgatgtgcttccaggatttgtttcaagactcagagctccttttatctgatcttgtagtggtggcttggtaatggcaaattttctcagcatttgtctgaaaaagactgtatccttcctttatatatgatgcttagtttcactggatacgaaattattagctgataattgttttgtttcaggaggctgaagatagggccccaatcccttctagcttgcagggtttctgctaagaaatctgctgttaatctgataggttttcctttataggttacctggtgcttctgtctcacagctgttaagattctttccttcatcttaactttggataacctgatgacaacgtgcctatgcaaagatctctttgagataaatttcccgagtgttctctgtgcttcctgtatttggatgtctaggtctctagcaaggccagggaagttttcctggattattcctgcaattatgttttccaagcttttagaatcctcttcttcctcaggaatactgattattcttaggtttggtcatttaacataattccagacttcttggagcttttgttcatattttctttttctttgttggtttaggttaattctaagaccttgtcttcgagctctaaatttctttcttctacttgttcaattctattgctgagactttccagagcatttcacatttctaaaagtatatccaaagtttcatgaatttttgattttttttctttaagctctctatttccttaaatatttctcccttcacttcttgtatcctattttggattttcttgcattgggctttgcctttctctggtgcctctcttattagcttaataactaacctcctgaattctttttcaggtaaatcagaaatttcttgcttttgatccattgctggtgaactagtgtattttttgggggggatgatgaggagccttgttttgtcgtattactaggggtggttttctggttccttctcatttggttgggctgtgtcagagggaaggtctacagctgaaggctgttgttcagattcttttatcccacagggtgttcccttgatttagtactctcccccttttccttactttggcttactgtgaaccgaactgcagggattgttgtctctcttctgagtctagccacccagcgagtctacccagctccaggctggtactaggggttgtctgcacagagtcctgtgacgtgaaccatctatgggtctctcagccatggataccagtgcctgttccagtggaggtgacggggtatgcaatggactctctgatggtacttagctttggtggtttaatgttctatttttgtgctggttgaccccctgccaggaggtggtgctttccagagaacatcagctgtggaattatggggaggaactagcagtgggcagggccttagaactaccaatattgtatgccctttgtctttcctaccagagtaggtaggggaggaccaccaggtgggggtagggctaggcatgtctgagctcagactcttcttgggcaggtcttgctgccactgctgtgctgtgggggatgagggtgagattcccagatcaccggaattgtgtacctaggaggattatggctgcctctgctgagtcatgcaggttgtcagggaagtgagggaaagccagcagtcacaggcctcacccagctcccatgcaaaccgaagggctggtctcgctcccaccatgtccccccagaccgtttccaggtggagagagagatgggcttgaaaacctgccccaggctgtctgcctcccagctgtgaaagaaaggggcttgcttcttcccctacctgtggagtctgcacaccagatttgcgccctctccagagttctggtcagaaagcttttcacccctttcaaattgttaaagttcagctagagatttgcttctctctgtgtagctttagcccctgcttttctcctgttggtttcctgtggtgccaggaaggaatggcctgctaggggacccagctagctcccaggggcctttctgctgtttcctctacacctgtatttcacttggctctccaaattgactcagctcaaggtaaagtcagaaacttctcccacaaacagacctttggcttctcctgtgcgggtatgtgttcaggagaggagggtctccctttcccacttctgcagttcagtcattcacaattttgggggggtctcctgggtcctgcaggagcagtccgcttccttcagagggtctgtgggtcctttggggattgctgattgactcttgcagtacatctggagttaaaattcacaatgtgagtcgctgcccactgctctgtacggagctgcaatctagtcctgactcccatctgccatgatctcccatgatttgctttcaacaaaaatgaggactggagagagagaaattatgtttcaaaaattatcctacatttgtcattaaattctagaatcattagttgttttttgcctacaatttggactaatcctactcattcctgtgaaccaaccagaaaactctggctgcagctcagaagaaacaaaagaaatgtgtagtgtaaaaatctggatcaatagtctagttctgggcagttaccctgcaaatcctgccaggtgataggaataaatagggtgtctgcaacccagagtttggtttttttgttttttgttttttataagaccaagagagctaaccaaagtgaaaccccatgtacctagatcttagcaagcataactatagccaccggttatctgggcatgctagcagcctcagaatttttaagctgtccttgcccccacttttgtttcattttgatatatgtcttctaatcattttgtttgtctcttctcaccttcaggccattgaactccaaatggtcaagcaaccggagcctcgaacaatggccctccttttaccagggatccttagataggcctctgagagagatctgactgctgttttcacaatacagcaccaccagtcagcagaaagcatttaagatcagttgttatcgtccttatccttatccttgtccttgtccttgtccttatcctaatggcagttagatgtacttctttggagggggtaatgatagaggcaggagacagccaaatgtctaggcaattagggaagggtacccagagaacctccaacccatctaggtcattgtgtgcaggggtcttgcctaaacatgcccacagtaaaaaattctctcccttaacacatgcacagtacaggaaataaatcagtctggagtgactcagactaagggcccacatgctcactagaagaatggggtggagccaccaagaatttgtgccttatgcagggaaggaggctggcatcttcaactcatgtgtagtggcctaatattcaatttgtgaggtggaaacctgcatctaagacctctcattttgttgacagctttttttttttttttttttgattaacaaattctgccctccttaccttttaatgtgtctacatgcctaatttttcctggttgtgaaacaagatcccagatttagctgaactaaggagcaaaaatcttgcatccaaaataccataattaaataggaaacaaactggagcacgctttaaagacagatgcagatttgaatattttcttaaacctttgagaataaagatacatctatttaagatcttctcagggacaaacattagcttttttcaatatttaaatgtaaacatctctacccatacatgaaggaatcccaacaacttaatatttagccattatggtgattggaagttctcttatattttgctggtaatttaactctctcactaccacagggttcttttgtttgcttggctgtctactttcctgactgaaaggacaaacccttatttctgacctttctgctgttaacctttttggctcagtcaggattgccttcaatttcctttgaaggtaaaagtacactttagcaagtagaaggcataagtaagcaatagacttgttcaatgaatcactgaatgaatgaaagaatccatgactactttattatcatcttttttttttttttttttttttttgagatggagtctcactctatttcctaggctggagtgcaatggcatgatatcagctcatggcagcctctgcctcccgggttcaagcgattctcctgcctcagcctcccaagtagctgggattacaggcaggagccaccatgctctgataattttgtatttttagtagagacgaggtttcaccatgttggtcaggctggtcttgagctcctgacttcaagtgatctacctgcctcggcctccctaattgctgggattacaggcctgagccaaccctccagccaattatcatttctttcactttgctttacttctaaagacattttacacttgttttgagtttcttttccttttttttctttttcgacatttgttttagattctggggatacatgtgaaggatttttacaaaggtatattgtgagattctgaggtttggggtatgaattatcccatctcctgtagtacccaaaaggtagttttaaattatttccccactctaccctcttatattccccagtgtctattgtttccatctttatgtcaacatgtaccctttgtttagctcctacttataagtgagaacatgcaatattttattttctgtttctgcatcctttcacataagataatggcttctagatgcatccatgttgctgcaaaggacattattttattctatttttatggctgcatagtatttgatgatgtatatgtaccacattttctttttcccatccacaattgatgggcacctgggttgattccatgtctttgctattgtgaacagtgctgtgaagaacatatgggtacatgtgtctttttggtagaatgatttattttcctttgagtatataccaagcaatgggatgggattgttggctcaaatggtagttctgttttaagttctttgagaaatctccaaactttccacagtgcctgaactaatttacatttctgccagcagtgttgtaagcattcccttttctccccagccccaccaacaccttattttttccttttttttttttaaagccattgtgattgctgtgaatttgtatctcattgtggttttgatttacatttttgagttccttttgttttggactcactttttccatttctgtgtcttagcagtataaaatagagattatgattgcctggtgtacctacatgttagagtcatgaatacttgagaacaacttttactttgaaagcagtatttacaatttttttatcagtatttgcctgttaagtgtttactgattacattgtgttaaattgtttttaacacttatcactcagagagcaaaagtatttgatagtttgagacaaactgcttaaagaacttgtagctgcaaatcaatgctgtactaggatatcattttaaaaacacatttaaactaagcatatgattttccaacagacttatttctcaatgattgttgaaaactaaaacttccctggccatcgtgaaattgtagtagaatatatatatagaaagcttggtgctgtttaaaaacagttacttcagtgactccttattgcttacagtatagagttctaaattcttatcctcaatacataaatccatagtctcctgctttaccattagtctccctcatgaactctaaagtagaagcttcttttcacttaccctcaatatagtttgtactctttttatagctctatttccatgcatttttattcaattcctttgcttaagatggtctcactaatcctttctttttgtaattattattatcaaaaattttgatattaaataatttcattgagcacatggtaactatacaatgttatttaagtacctgacattgattttctcctttaattcttctgataacccaatgcagcagatactattatgatcactatttcacagataagaaacctgagaccaaaaagattacatagcttgttcaaagtcctgataatacacactatatagtggctgagcttgatttcaaacccagttttatactgatacaagagttttgactcttgtgttattctacctggaatcagcaccctcaaaacacttttgtttcatattataactaattaaagatagtaaatggttctctggtgcaggttttttgctccttagttcagttaaatatgggttcttgtctcatggccaggaaaaattaggcatgtagcagattgaaaagtgaggagggtggaatttactaagcaaaaggaaaactgtcaacaaaaagaggggtcctgcacacaagttttcacctcacaagttgagtaccaggccaccatacacgagttgaagaggccagccttcttccctgtatgaggcgcaaattcctggtagctccaccccattcttccggtgaatatgcgggcccttagtctgagccactccaaattgatttatttcctttactgcgcatgtgttaagggatggaattttttgccgtgggcatgtttagacaaaccccttacacacaatgacccgggtgggttggagattctccagggatacttccctatttgcctaggcatttggctgtctctgcttctatcattttcacaaataaatatgatcaactgttgaaaaagaatttgtctcaaaatattatcagtgtaaaagcatgaccttctctttgtgtcttaaccacaaccatggagcctagttgttccaaataaaaggctagtcttgaaacactgtcaatatggtgagaactgatcctagttgggggccaaaaacttaggcataaatagtgttttccattacttcaaaataccatcaatcacaataaaatgatcagttattttgaaaacaaacaacttattgcccttgtttcattgaaatagataactgattttaagtcaatccatttatgtaaatataacctttgagtaatggcagtcgttaattttgggaatgacttacatttcattaacttggacacacatttttttcaaatgcattctgcattattaatgcatttagaagagatggtatactaataacctcttacatgtttatataagcataacattacattgcaaaagtattatatgtagaatttctcatataatcctaacaacaacctttgaatttctttttcttattttatagttaagttaattgatgttcagtgaaattaagtagttcacccaaggttatacattcagtacatgtcagatacaccactagaattaaggtatctaactctcagtccagtgccgtttccatttcaccaatccaagcatcttttctctcagagaaaggtgagagggtcatcaccttgaaattctttctttagaaagaccttacttcattactcttttcttattaatattcacatttccttatgtctcttaaatcatgacctctgtcaccaccaaagacatcctgagtttatgcttctcctaccatggtagaaccatagctttctttatagagaaacttttataggcaatttttgcggtgtttgtaagaatgctattttagaaatagcagtttttcactgatatagaggtagtctgttctgactattagaataaaatgtgaacaattctgaataaaaaagcaaagttgcataactgtgtcatatttttctgggctgagttttttaaacagtaggtctaggaaattgaatagaacagggttctcaatggatcctggatgtgctaactaattagtatgagtatcgagatctcttaggagcctatgtggaaagtgataaagatgaaaagtcatatagcgcagcactgcccaatgcaattataatgcaagctatatatataattttacatttttttgtaggcacaacttagaaaaataagcaagtaaaataaattcaataatatattttgtttaaccaaatatgtccatatagtataatttcaacatgcaataagtattttaaacatattaagtatataagtatatattttacactctttttttatgctaagattttgaaatctggtgagtattttttacatttatagtttatatcaatttggatcaaccatatttcaagtgtttattagccacatacaactagtatctactgtattagacaacaaagtctggaaatttttttgaagactgttccatacatggccatggaaatgctgaactgttgctaccatttggaaaagaataaaggtatatttttaggcctcaagatatgagggttcttataaggctgatatagaagtagactaaaacagagtttatcaactctgtttatcaacttcagcactattgacatttttggctgaataattatttgctgtggtggggctgtcttgatcattatagaatatttagcaacaactctggccttttcccaatagatgtcagttggactccttcctagttgtgataagcaaacatgccttcaaaatatgttaaaaggccctgcagtgttatgggggtggggaatgtcaacctctggttcagaatgaccgatcagccaagcaaagttttttagacttaggctgggtgatacacaaaacgaggattctcaaattctgagctctgaatgtcaattttctattccattgtcaatgtgtgcatcttagatggatggataagaagactaacaggacttggtgatacttttagtatttgctattatttaaaccaatgattttaagcctggattgaactgtttagcttttctttcttaaaaagttagaaaagatattcttgaacctctcccagcagtaagtggaggaacaaataaatggtggatggttcaaagaaaactaatttaaactggggaaaacagatatgtatcttgcaaatggtaaattgtgaaaggttataggtatgtatactttttccagtccatgacacgttagccaaccctccaaaatctgacatccctctaccttccaaaagtatctcttacaaccctccaatagaagcttaaaccagtcagccagatctccttatggtttgctgagtgtaccatggtctttcccacagtcatgcatttatttatgctgttcctatcatggagaatgcattctctgtttctttttactatctaaatttaatttatttgtaaaatcctgttcaagccctagcttattctacaagccatctctgacttaattgacttatggtgaccaaccttttttcttttatgctgtgaaagtataatgttaagtcggtaggtgttattttgtgtggactggtcttgtatctatgtaagacagaaaagttcttgaaggacaggggctgtagtagttttttttcttttcccaaatgcaaaatcacacagaccccctagaaagtaactggcagtgtgttccagtgtgaattatctgagaagcagattctcaattggagtttagtgagatggatgtttattagggagtggccatgagtcaacaactgtagaagggaggagaagaaagtagaactgagcagagggagacattgagctacaatgtagatacaaaagcctcagccaacctcacagggagctgtagagctaaaatggctctcactgagccaaaactgccagacttttataacctcacctcaagtcactgtgtaactacccaatgggttccttttacccactgcctagatagagccaatttaccaagacaaaggaattgcaatggataaagtgttcaattaacacagaaacagctgaatgggagaccagagttttattattactcaattcagttctccacaaaatatggagactggggttttttaaggacaatttggtgggtaaggggctatggagtggggagttctaattggccgggtcagagatgaaatcatagggaatcaaggctgtcctcttgcactgagtcagttcctgggtggggaccacaagagtacatgagccagtttatctgggtggcaccagctgatccatcaagtgcagggtctgaaaaatatcttgagcaccaatctcaggttttataatagtgatgctattctcaggatcaatgggagaggtttagagtaatgtggcctctagctgatgactactaaaccataatttctaatcttgtggcttatttgttctacaaaggcagtctggtaactaggcaagaagggggtttgttttgggaaagggctattatcatctttgtttcaaagttaaagtataaactaagttcctcccaaagttatttctgcctgtccccagaaatgaacaagggcagcttgaagtttagaagccagatggagtcggttaggtcagatgtcattcactgtcatagttttctcagttataattttttaaaaggcagttcaaattgaatattggctttccctagcatggtatgaccttgggcagttcctgaaagggctgagtgcactcccaacagctagggcaacaaatacttctgtgaagggggatctagatgatacattgccatgtttatcaaagtgatagttgtatagaaaaggttcagtaaatgtttgttaaatgctataaaaccttgccgtggtgctaactagcagcagaatgaatcaggagaagttttgtctgttggtctgattgggtgggcctatttgatagctaagcagatggcttctctaaggagcactccctttccaggacaagagaaaggattgcttgtaatacaccccaaattactgcttcaaggattaactattataattgttttgaagaatatatagtaaatattacattatcaaaaagattttgagactgaagcagcataaaaactgctgggtatgtaaaaaatcaagttagctaagtacaggtgctgaaagaccatgtataagcttgtgggatcaatgacattaaaaaaagaaaaaagccaaatcctcagttcattaattgctatttccattcttctacagacaaaagaaagaatggttgagataggatggtgggaaacacatttatttagttagtattatatttgaaatcatttatatacttatctgtttacccttgcagtaatccttagaaatagacaacactacctgtactttagcagatgaggaatctgtagccctgatatatatatatattatccctgggaccatcaccttactagttatcattatcatcatcaccattcctaggacgtacacagtgctactttgtgctagccactcttcgaagtgttttccatatatgaactcatatccttctcataactgccttataaattaggagctatttttagtcacactgtaaacaaacaaacaaaaaatcctaagtgccccccaacccccttggaaccaactaaactaacaagctctgagccaaggaaagccaggaaaactgaattcctggccatgtggagaagggagattggacacgtctcattaaaacctctcccttttggagttaagggacaactaaccagcattaacattaaagtagacatcgtaatcctgacaaaacagactccttggcagtaagaaaccaaattccaacctgactctggtatagcatcacatgatacatagctgaccctgaagaaaatcaaaatagtttaccccaaaatacatttctttgacatatttcgaaatggcactgaaaagccatctttgtgagagaaattttacatctgtagagagtctccattaatgcagataggcctttcccagatctgggagagattaactaagaatctcacactttttaagatctccaaaaacacatttaccatctattctggcctcatctatataacaagaaccttggctttgccacccctcttatgttaattcaagcacttctttctactgacttcaagtctttagcttaactctcaaccaattgccaatcaaaaaatctttgaatccacctataacctgtaagcccctctgctttgagatatcccacctttcagagctgaaccaacatataccttgcatgtattggtttatgtctttgccagtaacttctgtctccctaaaatgtagaaaagtaaactaaactaacttctcaggacctttttcaaacagatccttggaccatggtcactcacattggcttaaaataaagctcttaaaatatgttacaaagtttagctttttcatcaacaacatttataagtaaagtaactgaggaacagaaaggtttagtaacttgctcaatgtcaaaatatagtggcaaaccagaagtttgaaatcaggcaacttgtctctattatctgtcctctaaaccactatgtgaacttgcctaactagtaagaggcagaaatggggaaggaaaactagtctgtctgattccagaaactgccattttccactacacaaaggtgactccaaaggcaccgtgcttgtacaatttgggaaatcattctcttttgattgattgtaggtagagtctacatggaaaattggtaacataattgttaggtgacctttaggaaaaaatacgcatttttcaggtatttgaaggtgatttttcatgagaaattatgggatttctacaaaagtgactgggaatcagatctcacatttggtaccttctaaaaaataatattctttttattctaattagcacagccatcaaagatttctgaagcttatttggccttgtctagaacatgctgccatgtatgactgccccaagtgacaggagaaagccaaaaacaagacccagcaatggaagttttagcaggattccagctgtcagaattaaccatgagccaactcctatagaataaccatccaattgtatcctccatgcttagcctgtttgtccaagtaaattgcagacttatccagaacagagactgtgtattatttgtatccttatccccttctacaatagaggttaaatgaggttttgaaaccatggaaacttactggtaactgtatcacaatgctcatattttcttgaccatgttgaaaacacatttttttcccaacccagtataacatgttaaaatggaatactttcaatctcagtgtttctgcagtggccttacagtctgagaatagtacaatatgtgctatgtatgatcacattctaaagcaatgggctatatgaaaaatctagaccacaataccttgctaatatattgtgaaacaggttttgttgccactagccagcccatgatttcatgcagggctaaggaggaggaatgtattaacattgtgactttgaagaatctgggatgagaatgtataaattgcttcctgcttggagttctttccactacattccataaactacataatgcagaatctccatgaatatcacattgggtattttctgtgagtagttcagcccctaaagtctatcaacctaggaatttcctttccacagggaaattacaattatcctcagcctcatccagattctggtagtctatatacttttccaacaaaattaagactttgggggcaaattatacctatgtactagacttcatgtcagcacaatgtacaatgaataccaatactatactcaaatgttgttgggaaccaaaatgttgaggccaagagctggcttattactgaaaatggggtgggacttatacttaagacagagtctgtgcatcttctgtaaagcgggtgaacatactaaaagtgggccaatctaaaggatcaaaaaatcatcaactgatcttccttttgccagaaaaagcaacaacaaattatcaaagacagtttgcaaaataacagagagataaggctgggttgagtatggcctgaatttccagagttcaaattcactagtgaattccaactcattattaatcaatggaatccaaattaaaacatttattttacatatcacatcagaaaaatattaaaaagaatgataatgcctggagatggagatgggagtgtggagatttaagatatgtaatagactagtgatgaggttatacattggtacaatatttatgaaatttaattataaaataactgaaaagttttaaaaatttggtatattccttaatacagacaatccacacctaggaaagtgtcctactggaaatatagatgtaggtataaacatagatattcagtgtaatattattgtgaaagaaaaaacaaaacctatatgatcatcattaggaagttaatttagtaaatcatggtctatccatctaattgaatgctataggtccactaaaatctatgatgtctgtttatataaataaacacaaaatgatgcctaaaacattatgtgaaaagttcagtttgcatatcattgtgtatagtataatccaatttcattaaaaatacctttaacatgtaaatataactatgcatgcatgtgcatatactacacaggaaaaagttttgagaaaacacattgaacattcatggtctccctagagatcaaggaactccacattatgaaatcctgccacatccacagtcccactaagttaggcattatacattatttgggcagattaaaactatttgtttttctcttgtcttcctcttcaaatttttcacactctagcatttgcaaaagtaaaagttttattttttccttctaaatttttaagaggtgttagcagtaatataaatttttacacataatgtttctgatatatgctaaggcagaaattatacaccaaaattcctgttttactcaccagatatcttgcacataatgacatagactgccctatgttgaggaaaattttaagatattcacagctaactactgagtcagcccatattcagaaagggaacaatgccaagcaatacatttatttgactatgtctcactggatatatggaccagaacatcagtgctaccactatcattttagcacagattattattatttttttcttttgagatggagtcttactctgttgcccaggctggagcgcagtggcatgatctcagctcactgcagcctttgcctcttgggttccagcgattctctcacctcagcctcctgggtagctgggattacaggcgcacaccaccacacctggctaatttttgtatttttagtagagatgggtttcaccatgttgaccaggctggtctcaaactcctgacctcaggtgctccgcccacctccacctcccagagtgctgggattacaggcatgagccactgtgctgggcctacagatcattttttttacaacacatgtggaactcactgaaaaaaatgcagtttcaatcaaatgggactgccaaacctcaaattgtatgtctttgacagggattaaatgatgtcagttgtattgaatttggtattagtgtttggtgggagtaatctcaaaagcctttttaagtagatccaatgtcactggtttaactaaagtatataaattcaggaggactagtcctagatttgttaccatagatattttcccaaatgtccctccttcataaaaatgtcacctttcgtaactctcagtaatttcttttcaggttgtaggcaggtctccatttagcaaatggtgttctcagtaaggttttttcttcttcaaggtactctggatgttgccattaattatatcctcacagtatacattgttaaacattttgggattcattttgcttatgggcataatttcacaaagcctcttctaatggctcttggttgggcattgagacaccagatttatttctctgaagaaaaagaatatccttaatatgccgtaagatgtggtttgggatatttgtatggtaaagatgattctgaggataaaggtgactttttcattcaagttgactacatattgattcatcttagagagagaaaaaaggaaaaatcagatccaagaaggctttcaaatgcattcccagcgcgtttcacaaagacagttttaagacattttgagaagaagtatattttatgtttgaagttaacttttcaataaggaattttgattgcttggaatttaattatctctttgaggtgcggtattcacagaaactgtaccatagcattggaaaaacagggaaagacaagatcatctcttctttatgttttgttaacacttgtcacccttaagatgtcttttgttgtaggagcttaacaaatatatctttgtgatggatggaggtaacccaagtgagtacaaataaattatgacagacaagataacttttcttacctcctcatgcaatggtaatatttgtagaatatgttgtcagtttccaaacaaaatatgtcaaagaataaacttccaataaatatccccagatattctaatcacggctttaaataggtaacatggtctttgtggaaataagagatccagttgatgacaaagcaacgaatgagactgaatgtcaacaaagttatatgaaaggtatttattcacctgaggacagattagaaaggtagcaaacacttgggaatattttatctttggaaaaataatgaagtatttgatcataaagatctgctaaagtaaaatagagcatatgcctcatgacatttaattaatcattaatttcatgcctgtgtattgtgggttaaaaagatgttttcaatatgaattgatccaaaacaactctttaagttagtattattaaaatacatcatttatataacaaattttcacagccagagaatgtggaagcataaaatgccaatggtcactgtatctcaattcattttctgccaacttattttctctctgattgctgtgaggctaatattagagtcggttacatcctctatttcctaagttgcctatgtgaatgttagtaaaaaaataataattttacttcactatctggtgaatgtttgaactatatgtttatgaatgaggaaagtgaaacaacaaaaatttcctttgtaggtaaaattcagggtgttcattggaaaaagggctattttagataagacatttttatttatgaaggataagttgaaatacagtattggaatttaaaatcattcatgtaaaagttaatgggtctgtcctttgattatatagccaaggctgagttcttaataaaaatgctaaaatgatcattaataacattctgtacactgatatcccatctggaagttatcacaaatgcatgttctggagtgctaagttcataattattttagagaactgatttaggtattgtagagaggcactagatattcttttatttacaggtgacatgattttattatccataactttccatccactgaatagtgagacattttttctgaatgaggacttatagtattaataattagctcaaggatattggtctaaaattctcttttttggttgtgtctctgcccggctttggtatcaggatgatgctggcctcatcaaatgagttagggaggattccgtctttttctattgattggaatagtttcagaaggcatggtaccagttcctccttgtacctctggtagaattcggctgtgaatccatctgttcctggactctttttggttggtaagctattgattattgcctcaatttcagaggctgttattggtctattcagagagtcaacttcttcctggtttagtcttgggagggtgtatgtgtcgaggaatttatccatttcttctagattttctagtttatttgtgtagaggtgtttgtagtattctgatggtagtttgtatttctgtaggatcagtggtgatatcccctttatcattttctatcacatctatttgattcttctctcttttcttctttattagtcttgctagcggtctatcaattttgttgatcctttcacaaaaccagctcttggaccaatatccttgatgaacatcgatgcaaaaatcctcaataaaatactggcaaactgaatccagcaacacatcaaaaagcttatccaccatgatcaagtgggcttcatccctgggatgcaaggctggttcaatatatgaaaatcaataaatgtaatccagcatataaacagaaccaaagacaaaaaccacacgattatctcaatagatgcagaaaaggcctttgacaaaattcaacaacgcttcatgctaaaaactctcaataaattaggtattgatgagacatatctcaaaataataagagctatctatgacaaacccacagccaatatcatactgaatgggcaaaaactggaagccttccctttgaaaactggcacaagacagggatgccctctctcaccactcctactcaacatagtgttggaagttctggcaagggcaattaggcaggagaaggaaatcaagggtattcaattaggaaaagaggaagtcaaattgtccctgtttgcagatgacatgattgtatatctacaaaaccccattgtttcagcccaaaatctccttaagctcataagcaacttcagcagtctcaggatacaaaatcaatgtacaaaaattacaagcattcttatacaccaacaagacaaacagagagccaaatcatgagtgaactcccattcacaattgcttcaaagagaataaagtacctaggaatccaacttacaagggacgtgaaggacctcttcaaggagaactacaaaccactgctcaatgaaataagagaggatacaaacaaatggaagaacattccatgctcatgggtaggaagaatcaatatcatgaaaatggccatactgcccaaggtaatttatagattcagtgccatccccatcaagctaccaatgactttcttcatagaattggaaaaaactactttaaagttcatatggaaccaaaaaagagcccgcatcaccaagtcaatcctaagccaaaagaacaaagccggaggcatcatgctacctgacttcaaactacactacaaggctacagtaaccaaaacagcatggtactggtaccaaaacagagatatagatcaatggaacagagcagagccctcagaaataatgccgcatatctacaactatctgatctttgacaaacctgagaaaaacaagcaatggggaaaggattccctatttaataaatggtgctgggaaaactgggtagctatatggagaaagctgaaactggatcccttccttacaccttaaacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaatggacaaatgggatctgcttaaactaaagagcttctgcacagcaaaagaaactaccatcagagtgaacaggcaacctacaaaatgggagaaaattttcgcagcctactcatctgacaaagggctaatatccagaatctacaatgaactcaaacgcatttacaagaaaaaaacaaacaaccccatcaaaaagtgagcgaaggacatgaacagacacatctcaaaagaagacatttatgcagccaaaaaacacatgaaaaaatgctcaccatcactggccatcagagaaatgcaaatcaaa

SEQ ID NO: 1056 - DNA, 662 bp, Homo sapiens
tgtgtttatgggtaagggaggggctttctaaatacacaaatactggtatacataaataattcctgaagagtcataattcctcggatttatgtatttatgctcaaactgtttccatccatgtttcatttattcttacaacctccaagcaaaagagataaggacagatattatcattgtcatttttccgaagaggaaatggattgagaagtgatgtgaacctgctcaactgcaaatggtatcccaatatccgagttgatgctccagccactagaacggtgtaacctgataacttacaccgaaagcaactcaaggaataaattctgctaaaaagcacacccttgacacagcagatctgctagaaagagggagatgatttcaaaaggagaaacttcctgtgatagcaaatggagctgccagcgtagtctttgaactctccttcaccatcagccaacgaaagacttcagttattcttcactaaaaatgacagtctgcaagtattttggacctccaggtcgaggctaagttggcaagaactaaatggagagaaaaccattttacagggtcactgctaaatccagaatcacgggatttctgaagaaactgtatatgggtgactaaatcaaaggcttctgttaggtcaataaaaatgtttctaataataa

SEQ ID NO: 1057 - DNA, 1373 bp, Homo sapiens
attcttttttttttttttctttcagccatttctttttatttacagtttgtgttcaatgcaaatcaattccataagaagttactatgaatcaaagcgtaaatacacaaacacaatatacaatccaaaatagatgtacagcattctggaataaagcaaaagagtgttcattcacacacacagtagcttcaaaacggttcgatctgtttgttctcatgtagttttgtaaagatggaaaaaaaggactttggtcatcaagactactgtggccatattagattactggaacatctaagcatcagtgtgtgaccatgcgaacaaaagacttcggggagtgtctatttttaaaaaggtttctgtgtttcgaggcagttgtaaaagatttactgcagaatcaagcccacttttaggcttaggaccaggttctaactatctaaaaatattgactgataacaaaaagtattccaaatgtggctattctgatccatagttgttttttaaagaaaaaaaagtatatacagaaagagtataaaagtttgtgaatttaatgcaaattagcttccagtcttcacttcccaaatacttgatttgtagttttgactcctttacatttttgccttcttaatttcaagatttgcaattttgccttcaaaacagatctttttttttaattgtaaaaagtattcaacatatgcagaaataaaaagcattttgatggctgggcgcgggggctcaagcctgaaatgcctaccatttgactcaatatggataatcaagagttgctcaggctgcttggatctgggggtagattctcattcatcattgccctggcacatgtcaattactacataaaaggtcaaacgcaatgtcaaatccaaagcctcaggaggaaagtgagttcagttcccaagagaacagcaatagctcaacaatgtaaaacttcatctagagtatatcggcattaaataagtgctgccgaaacaatacgttgaggaattacagtaacacctggaagttccttctcatgtacatataaatagaatcatggaagctttttatattacctgttttatggccttatagaattaatgaaccaaatgaaaactgaatctccattccacaatcacatcctttatttctattcttattttcaaggtagtattaagtgtccatatttctcaagccacattcaaggaaatcatgtcttaactattttggatgttgcctctccttcatcttgtacatgaaactccagcagatttaatattggcatccatcatctagtcaaacctctcacatgttcttcaaatcattccagacgccatttggattgggtttagaagatggggaagtttagaagacgtttcttggcctga

SEQ ID NO: 1058 - DNA, 1238 bp, Homo sapiens
attcttttttttttttttctttcagccatttctttttatttacagtttgtgttcaatgcaaatcaattccataagaagttactatgaatcaaagcgtaaatacacaaacacaatatacaatccaaaatagatgtacagctgtggccatattagattactggaacatctaagcatcagtgtgtgaccatgcgaacaaaagacttcggggagtgtctatttttaaaaaggtttctgtgtttcgaggcagttgtaaaagatttactgcagaatcaagcccacttttaggcttaggaccaggttctaactatctaaaaatattgactgataacaaaaagtattccaaatgtggctattctgatccatagttgttttttaaagaaaaaaaagtatatacagaaagagtataaaagtttgtgaatttaatgcaaattagcttccagtcttcacttcccaaatacttgatttgtagttttgactcctttacatttttgccttcttaatttcaagatttgcaattttgccttcaaaacagatctttttttttaattgtaaaaagtattcaacatatgcagaaataaaaagcattttgatggctgggcgcgggggctcaagcctgtaatcccagcactttgggaggccgaggcaggtggatcacctgaggtcaggagttcgaaaccagcctgggcaacatggtgaaaccctgtctctactaaaattacaaaaattagccgggcatggtggcaggtgcctgtaatcccagctacttgggaggctgaggcaggagaatcgcttgagcccgggaggcaaatggtacactgatctgagatcacaccactgcactccagcctgggcgacaaagtgagactgtctaaaaaataataataataaaaagcattttgaaattagtcgcggtcaatgcaattctactctttggaatccgtttagctaaatgaatgtagtgctcttgttgaatggaaataggtgataggaaatgcctaccatttgactcaataatgtaaaacttcatctagagtattgaatctccattccacaatcacatcctttatttctattcttattttcaaggtagtattaagtgtccatatttctcaagccacattcaaggaaatcatgtcttaactattttggatgttgcctctccttcatcttgtacatgaaactccagcagatttaatattggcatccattttctgtgtcaataaaaggtgtggaattag

SEQ ID NO: 1059 - DNA, 504 bp, Homo sapiens
attcttttttttttttttctttcagccatttctttttatttacagtttgtgttcaatgcaaatcaattccataagaagttactatgaatcaaagcgtaaatacacaaacacaatatacaatccaaaatagatgtacagcattctggaataaagcaaaagagtgttcattcacacacacagtagcttcaaaacggttcgatctgtttgttctcatgtagttttgtaaagatggaaaaaaaggactttggtcatcaagactactgtggccatattagattactggaacatctaagcatcagtgtgtgaccatgcgaacaaaagacttcggggagtgtctatttttaaaaaggtttctgtgtttcgaggcagttgtaaaagatttactgcagaatcaagcccacttttaggcttaggaccaggttctaactatctaaaaatgttcttcaaatcaatcaaatttgggattctcaacattttctgtgtcaataaaaggtgtggaattag

SEQ ID NO: 1060 - DNA, 504 bp, Homo sapiens; identical to SEQ ID NO: 1059

SEQ ID NO: 1061 - DNA, 569 bp, Homo sapiens
taaagcacaaagatatgctaataacgttaacaaaagaaaaaaatgtctttataagtacataccttttgtcgtcaaaaaaaatatagaaacacaatgtattcaaaaaaaatcaaaattatacagccatgtttatgaagtctacatttcccttgtcttggatatatatatatatggagatatatatacaattcaagcagttttaattaagggtaatcattgggtttttctgaaaccggaaaagtcacgagtctctctcttttttcactttcacatctccagcaaggatggttgcaatttccccttgcataaaggcccaggggacattggagcccacaagagggcatttttccccactgggacaatagacctctccactagctccctgctgtttgatgctttgtctggagcaagggaagcagaacttgtgcgaagggacggacgggcactgcacaaaatgggtgtcctccagccgctcgtggcagagggtgcagcacagcggggcactggttgccagagaggagtccgggaggctggcagggtgcactggctccagtcctcctgtgttgcct

SEQ ID NO: 1062 - DNA, 3969 bp, Homo sapiens
ggcggagggctggcgtcctcgcggacatccatctgcagcgaaccaggcagaggctttgggattagatccttgactccttgcgtcagtagttaagctttgtgatggtctgaggtccatgaagggattaaaaccaggaactggctccttctccaaccactaaagcctcatctgggcccacaagccctggctgttccctggagcgtgactggaagatgtgagcagctttgtgctggagccccatttccatgggtaaactgttcacctgatcaaacagctccccagagttccacagtaccacatatttattttctagaactttgtttttagctgaaagggatcttagaggctaaggcaatcctatcactttacaggtgataaaactgaggcccagagaagtgaagtaacttgcctaggcccacacagctcatcagtaaaagagccagaacacatggccgagacttctccctaatccagcgtctcctccacactcccagctcacccctagggtttgtgcccaggctgaggacactattttcagaggcactaatgtgaggcaaagggcatgttaccagacacagccccgcctaccccggtcccctgaggtggagctgtgcattccactggcttcacggttcccctctgccctggcggcttctggttggtattggcgccaccgactgctctgccatggctcctcagtgagtgctttgggtgtgattgacaagtttccatgacatctcccagggagtggggtcctgatgttggtgacatctctatcgttcatcttttcatggggctgatgaattcctagaaagggtagaaggagaaggagccactgaaagaggctctttaaaacttccctgagtgtcccccagtgcaaatgaacaggagccccaggacacttgaaggccctaggaaatcacacctcagagccacagatgcatcctaatgctctctgcagacggggcacgtgtcggaggtgagaacaacagctccagatgtctctgtctttgcaaataaggcctgtgacatttaatgatgtaaccacctaccttccacccattgttctggtggccatgagtagaaggaattataccaggatgtgataagaaggaattaggagctgggagtcttgctgggtgaggaccttggccccttgcttgcttgccatctaataggggcactcctggcctgtggggtcagggagaactagacccagagcatggttgtctctgtgactagttgagcctgtttctccttcaagggccctggcagtgggaaaacatattatgacaattgcactgttttatcagcccttggcactcctgaagttgccctgaaataaacatccctacctgtatgccaggccctgcctacttctggagctctcttaggtttacaacctacccccgctgtcccaaattgatagggtgagcccagggcattaaatgggtggtgcaagtcaggcttcaggactgacacgggtctatgtgcgctcagtgtgggttgaggggcactgggctgtctttctccctacagtgcatgctgctgccaaaccagagatcacttgtagacttgaaagggaacatgagctttgggtgaaggattcccagcccccaacagaggccaaaaagctaccacccagccaggcagaaggaacataaagtatgcattttatgatacgactcagcttggagggatgaagtagaaggtcctcactgcacctcatggcaggctgctgacggcagatattttaccgggctcactgaactgggcagtcagggaagggtcggctcctgctctgtccagctgtcttcataagggactctgtgacactttttataaaaatgactttgatttctgcataagaaggcttcccaagcttgctgtctagcagtggctgctacagggaattattcacatggcagcaagagagccctggctccctggaccaggacattccctttgtgtgtgttggaatgagagcaggaggagtgctggtcagaagcccctccccagggctctgggacttcagtgttctcagacaaactgggccgctcctctgagctgggatgctgacccacacttggccccggctctggcatccacaggacgctgccttatccgtcatctcgctggggctgggggctagaggctgagcaggtcacactgaacaaaagaagtgtgtccccatcactaggctaacatctgagtttcttccacagtatttggtaacacagtcagaaacaagactgaagatgattctggaggcaactgggaaccccccagaacgattctgcaggcttctgggaagctgaaaaaccccaaggccagactggcctcagaatgcctgagtccttttgattccactggaaaagccatccatctgtgccaagtgtgtggagagcttcaagagccatatagccctggccaccatgagcacagccacgtgggggagtagtcctgaaagtgtcctggtgtggcaaaggctttccactaagtggacctcagatggcacaggaagaccctcctggggatgtgggaggacactgcctagtgggtgaggggccgctctttcaggtgtgcacactaaatgcagagacagcctctcctggctgccaagaagcctgtgcatgatccaggaccacaaaacacttgcaaactcactgcccagaggccctgtgcctgtctggagtgtgcccagtgtgtctgcgccccacagcttgtcctggcccgccagcagagccgcagcactgcagggcccttctgttgtgagtgccagggcccttgctggctgcctgagcaaggcaaaaggttcaaaacaggaagtctctgggcagctattcccaggtgcagaggggagcagcggccacacaggtgccagtgtggcaggagctgcagtcagaggcagcatctcaagagccctgggagcaggggccagccacgtgaagcccacgagtgtcgctggcacagggaagggacacgaggatcacactgacccaagagaaggcccacagtgaggaggccccaccgaagcatccccagcaacagggactgaggcatctgaggcagccagcccactcggaaaggcctgctgactgcactccagatgtcaagagcacccttgggaaaaagaaaggcaggagtgcagcactttctagagcctcagctcacttctctccttctagctccagccggagtgatggaagaggctgcgctgggagctgcctccctgggagcctaccctgcccagcctgagagtggaggctaccagcatcacgcttcccctagtgaaatccatctgtcctgaagggaaccctgggacggggtcaaggaaaccctgttcacccccaccacggggtcaggtcttcaccaaagggaggccgcacggattcccagtcgcaaacccaaagccttgctgcctttgcctctgtttccatagttgtttcaatgtcttttttaaaaatcacatacactcgagtaagactgagtctcctcaccgaagagatctggctgtatcccgagtctctgaaacctttgctccagtcccgtgggagcgtgccgtcccgaggatgtggagccgcaagggctcgccagagggatctcaggagctaggcctcaaggagcgctgttgagtgacaggtctgatgcagtagcttttactattggtggaaatcgatgttttttccttgaaagtctacctttctaagttcagtaaaccaaattagatcatgtatgtgaaagcactttgtaaactatgcagtactccagaaaaggcagccaagcccttaattataactcaccaaacagccaactctcatctttaccttctaactggcaaaaatgattgagctcactttgaaggactagagaggaaagaaactgaaagacaaaaatcaggtgaatacacaggcacttcccctgcccacctctgttcctggccctgtcccctcgtgagtgagagcagag

SEQ ID NO: 1063 - DNA, 2679 bp, Homo sapiens
ggcggagggctggcgtcctcgcggacatccatctgcagcgaaccaggcagaggctttgggattagatccttgactccttgcgtcagtagttaagctttgtgatggtctgaggtccatgaagggattaaaaccaggaactggctccttctccaaccactaaagcctcatctgggcccacaagccctggctgttccctggagcgtgactggaagatgtgagcagctttgtgctggagccccatttccatggtgcatgctgctgccaaaccagagatcacttgtagacttgaaagggaacatgagctttgggtgaaggattcccagcccccaacagaggccaaaaagctaccacccagccaggcagaaggaacataaagtatgcattttatgatacgactcagcttggagggatgaagtagaaggtcctcactgcacctcatggcaggctgctgacggcagatattttaccgggctcactgaactgggcagtcagggaagggtcggctcctgctctgtccagctgtcttcataagggactctgtgacactttttataaaaatgactttgatttctgcataagaaggcttcccaagcttgctgtctagcagtggctgctacagggaattattcacatggcagcaagagagccctggctccctggaccaggacattccctttgtgtgtgttggaatgagagcaggaggagtgctggtcagaagcccctccccagggctctgggacttcagtgttctcagacaaactgggccgctcctctgagctgggatgctgacccacacttggccccggctctggcatccacaggacgctgccttatccgtcatctcgctggggctgggggctagaggctgagcaggtcacactgaacaaaagaagtgtgtccccatcactaggctaacatctgagtttcttccacagtatttggtaacacagtcagaaacaagactgaagatgattctggaggcaactgggaaccccccagaacgattctgcaggcttctgggaagctgaaaaaccccaaggccagactggcctcagaatgcctgagtccttttgattccactggaaaagccatccatctgtgccaagtgtgtggagagcttcaagagccatatagccctggccaccatgagcacagccacgtgggggagtagtcctgaaagtgtcctggtgtggcaaaggctttccactaagtggacctcagatggcacaggaagaccctcctggggatgtgggaggacactgcctagtgggtgaggggccgctctttcaggtgtgcacactaaatgcagagacagcctctcctggctgccaagaagcctgtgcatgatccaggaccacaaaacacttgcaaactcactgcccagaggccctgtgcctgtctggagtgtgcccagtgtgtctgcgccccacagcttgtcctggcccgccagcagagccgcagcactgcagggcccttctgttgtgagtgccagggcccttgctggctgcctgagcaaggcaaaaggttcaaaacaggaagtctctgggcagctattcccaggtgcagaggggagcagcggccacacaggtgccagtgtggcaggagctgcagtcagaggcagcatctcaagagccctgggagcaggggccagccacgtgaagcccacgagtgtcgctggcacagggaagggacacgaggatcacactgacccaagagaaggcccacagtgaggaggccccaccgaagcatccccagcaacagggactgaggcatctgaggcagccagcccactcggaaaggcctgctgactgcactccagatgtcaagagcacccttgggaaaaagaaaggcaggagtgcagcactttctagagcctcagctcacttctctccttctagctccagccggagtgatggaagaggctgcgctgggagctgcctccctgggagcctaccctgcccagcctgagagtggaggctaccagcatcacgcttcccctagtgaaatccatctgtcctgaagggaaccctgggacggggtcaaggaaaccctgttcacccccaccacggggtcaggtcttcaccaaagggaggccgcacggattcccagtcgcaaacccaaagccttgctgcctttgcctctgtttccatagttgtttcaatgtcttttttaaaaatcacatacactcgagtaagactgagtctcctcaccgaagagatctggctgtatcccgagtctctgaaacctttgctccagtcccgtgggagcgtgccgtcccgaggatgtggagccgcaagggctcgccagagggatctcaggagctaggcctcaaggagcgctgttgagtgacaggtctgatgcagtagcttttactattggtggaaatcgatgttttttccttgaaagtctacctttctaagttcagtaaaccaaattagatcatgtatgtgaaagcactttgtaaactatgcagtactccagaaaaggcagccaagcccttaattataactcaccaaacagccaactctcatctttaccttctaactggcaaaaatgattgagctcactttgaaggactagagaggaaagaaactgaaagacaaaaatcaggtgaatacacaggcacttcccctgcccacctctgttcctggccctgtcccctcgtgagtgagagcagag

SEQ ID NO: 1064 - DNA, 2679 bp, Homo sapiens; identical to SEQ ID NO: 1063

SEQ ID NO: 1065 - DNA, 1495 bp, Homo sapiens
cacaaaaagagaccaagagggagcgcggagacctgcaggggcggaataagagttctactaagaggctaaaggaagccgagctaccgcaggcagtagcgatttctgggaggccagggaaggaaggaggtccgcggcggtaaacagcacctctccccgagttcgaaactcctagacgaccatccacgcccgccgcccgggtgggggagggggtacatctttccccctcaacctcccactacagttctttatccactctgcgggaaccaccacagccgcggccgccatcttcctctcactagtagcagaagcccggatgtgtagcacgcgagcgaagggtcaaaggggagcaccgcccacgaggaatgccgggagctgagagttcgtttttcgatttcccgccccactttcctctccacccagcggaaacccgaggcaaggcagccaacgacgtggagactcgcgggcccctttgcgaggttactacacgggttgcgccctccgaagtcttcggccttacttcccattagaacagagaaatgccatccacaggccaacaatctccctctgatgccgagccaaagctggactgtactgccatctcggctcactgcaacctccctgcctgattctcctgcctcagcctgccgagtgcctgcgattgcaggtgcgcgccgccacgcctgactgtttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggggtgcagtggcgtgatctcggctcgctgcaacctccacctcccagccgcctgccttggcctcccaaagtgccgagattgcagcctttgcccggccgccaccccgtctgggaagtgaggagcctctctgcctggccgcccatcgtctgggatgtgaggagcccctctgcctggctgcccagtctggaaagtgaggagcgtctctgcccggccgccatcctgtctaggaagtgaggagcgtctctgcccggctgcccatcgtctgggatgaagtgaggagcgtctctgcctggccgcccatcgtctgagatgtggggagtgcctctgccccgccgccccgtctgggatgtgaggagcgcctctgcccggccgcgaccccgtctgggaggtgaagagcgtctctgcccggccgccccgtctgagaagtgaggagaccctccgcccggcagccgccccgtctgagaggtgaagagcgtctccgcccggccggccgccccgtccgggagggaggtgggggggtcggccccccgcccggccggccgccccgtccgggaggtgacgggcgcctctgcccggccgccgctactgggaagtgaggagcccctctgcccggccaccacccggtctgggaggtgtacccaacagctcattgag

SEQ ID NO: 1066 - DNA, 11102 bp, Homo sapiens
ctcaaggagaagtgtacaagctaaactggatcattctaattttcctgaacacttacaacctcgtaggaagacatacatacataagtaagtatgatacaaggaaaatttgtaagacaaagtaaataaaagtattataagaaacacagaagagggatagattactttaggctgagtgaggtggcttttgagttcctactagaagggtgtgtaggattgtgactagaagagagaggaaggtctggatggagcaacaagagtctgggctattaacacaggtttgagtcaggctgaccggagctgtaaagcccttctcgttctcactgtgtgttcttttcagttctgtcttcctgaggctgctgtttctgggcatggccaggggatcttcagactttacaaaccagttgtgcagagccaggcatttcaataaggaacaaaatgctgagtaacaacatgaagtcagagtgttgcttgccaagagctgggaggcctgggtggtttcccaatcttaaagaagcagaaggatattaaagtgagcctcccaaaggaaaacgtggatctacttaccaacgcagaaaatgatacacacggattcgatttaggcacgctacattcaaatgacttggaagagcaggttctctgagccaggatactaaagtccctgtttaggaaagagccacgttgtatgtttaccctaccacaaagatacagtcatgtgcctgggaaagattgatgccagctccagaaaggcatccgaatggtctaagtaatgccatccatctgtcagtaatagattcagaaatggtgctggcagaggaaacagcagcaatgatgctctgcgagcctgactcagggccagcagtgatggcagcccaagaattctggaggaaagtggctctgggaattgaacagtggctcagtgatgttggggccaccaagtctgcaattctccctacctgttcttcatggttgtaagatgactgctgcaattctcggcatcatgtgcatgttaatgtcaggaggaagaaaggaagagggagcactgggatgttacattcattttgtcaggaaaagcaaagcctttccagacagctccgaaacttgcttacctctcattggccagcaccatcacttgaccacttgtccactcctagctgcaaggaaagtggcaaagtagaaggtatttgagaatgtctgctgggttagccaaaacaatagtgacttctacacccaattttctgggcactgcagaagtatccttgagtcctatgtgatcagagggagagcaaacctcaataatgaaacagattcaatttccatcacccagtgagacaccatgggattagaataaatttttaaaaaaacaaattgaaaaaaatgcatttttaaaacaacaaaatcagaaaggatgaaaggtgatatttctagcatatcagtttgtggtggtaaattaattaccttatacaaaggcctcagtgactttcttctccttacctaacgaatcatctttaaaataagtaaaataaagaaacaagagcagcagcagatgcttcctaaaaagaagttaccaaatctgttcaccacaaacctgagaattcaactgtggacatttggacaccagcaatgaacatgaaactcagcttatgaggcatatttggctaaaggtcaaggtgacttaaagttcatcataggacatctacaatttgcaaagcaggtgactggatatggactccttccaagtctcatttaattggataatgcctacgttttaagtatcagaagtgagtctttctctattaaatgaagtcagttccactaaaacctaaatcttgtttggcaggcactccatgtttcttaatttttattccatgctgtatattcttttagacttgattttcacttttttttcttttttcctgtacatttatctttgctgtgaaacaaagtgccctgctttgaaggacaggtttgtgggctgctggtggtgagacaacagcagtccttccaagtcttcctcccatcactctgttagctctccctttgtttttaattagcattacaccagttaattctgttatctcttaaccctggttctgcatcctcttcttcttttctattccttactccgctcctgttttttcttgttctgcttttccaagaaatgtcttgtctcctcatcagttgactgtcttctctttccagagggaccataaaggtgccagcctaaggaacacgtaaaacgtgggaacagacaaacaagctgctgcctattacagagatagataattaactttggaccattacatgcaattcatcagcttatctttttcaaactttatataagaagtcatttcccaatggtaaccacttgccagctgcaactttgacgcatattatcaggataggtgagattgatgggggccctttgaactcttcccagggaattatctttataatgttacagttttctctatagcatggtcatattgttaacattggttataaggtcatatggttagtatggttagtattggtggctcacagctgtaataccagcactttgggaggccaaggtgggaggatcacttgagccctggtgttcaaaaccagctctggaaacatagcaagaccttgtctctacaaaaaaaaattaaataaattaaaagattagctgggcatggtggcacatgcctgtagtcctcactacttgggaaactaaggtgggaggatcctttgagcttgggaggttgaggctgcagtgagctgtggttgtgccatggcactccagcctgggtgacagagtgagagcctgtctcaaaaaaaaaaaaaaaaaaaaaaaaaagtacctgtaaggtctttgggattttgaagatgaaaggtgttgcataaattgaatgaattcacttagagagatagaaggcaactacagggaatattacgtacatcatggagcggaaagcactaaggcctgtggaattattctcagtgacacgtcgttgagggcagtggtccacatgttttgaacatggtttctcccaggtgaaaaggatgagtaatttgttctccttcacatgtgtgtatgtaggtcttatacacagcagatttgccacaaaacaaatgaagattacactttgggcccctctctcacatgagccccttccaaagttctgtttgctaattttacattttgtaatttcttattatttttcttaaagaagcctcctccaattgcataaacttcaagcctcacaaaatttggatccatacctgagccaacatacaatacaattttccatttctaacttttagttgtacctagtgttttattggaaatgatcaagtacatgagtggtgtctttttaaaaaatttactttatttgcttctctagcttcatcgttagttaggcagttaaatctaaccatttggaggtattttcatataacctccattgaggacaatttggcaatagcttttaaaattataaatatatttgtacagttataagctgccatatctataaaactatttgatagacaaaagttgaaaaccctccaagagctcatcaataaaagattaaattaattatgatacatccatatgagcactgagcagctgtgaaaaaaatgaggaagtaattcctgtgctgatatgggaagacttccaagacatgttgttaagtacagaatggtgtatacagtatgctatatagtgtggtaaaaggtttagggataagcatttatatttataactgtttatatttacataaagtaattctgaaaggatacaaaaaagctaacaaaagagattacctgtggtagtgtggggcttggggattggatgggtgagaaacagtagtggaaatgagatattgtacagtttaaggcattatacacctataaaaacatgggaatgtattacctactcaaaaagtgaaattaagagagatacaagaaactgtttggatgttccttcccgtttcaatgtatctatattttttcagccctcaaagttattataaatgtcattataataacttcataaagcttcccctataatgagaatcttaccattctcctaactccaatagcactgtaatccacctctgttaggacacatcactcttcatcatgtgtgattattatttgcagatatcatcttcaaggctcttctctatttaccacctgccattcttgttctcacctctacatgaccttcacattttatttctctcggttttttggacaagctacattcccttccacagagaaggcttccctgacccctttcacttggttggattaccttgctattcttttctatctttgtacattccttttcaaaatacttatctcccttgttgttacctataatgtctgtcttctttactcaagagtctagacaaaaagctccacgccagcctcggctgtgtttgtattgtttacgtctgtgttcctagtgcttaataaaatacctagcaagggttaataagtacttgttgactggaagggaatgacttccttcccttactagagagtgatttccttacaggcgagatgtgtcaaccttctatagcccacataaaataaaggacaatatctcctattggataaaagacaagaatttacatatgagttttgtcatttaccataccagctctgggatcttaactttttagcctctctgggcttcagagctctcatctacattaagtttttcattcattctgtcattcaataaatatttatggaatgcttagcatgtgccactagtctagcaactgtggatactgaagtacgcaaggcagaatagtacttgctatctgaagcacacggtttaattggggtggggaaagagttggtggggagggtctcattaaacatataagccaaataaaccaaaattacaggtagagttaaggccatggcagagcaactgaaggtgatgaattcagagaggccaggaagggaccctctgaagcgatcatatctgaactgagtttttgagtcaactaaatgagatagtgtctgtgaatgtcttagaatcatgtctggcatgtaataagtgtcataaatgataagtattactatttataaaaacttgtcaaaaaatgaaccaaaaatacaagcagcttgtctttcacatataaaatactatagttgcaacatgtatatgtctttgtatagtgagaaagcatattgtatgtatattatatttcatttgagtaagttattttttaactgaaggaatctcctattttggttctgaaatagttaacgttccttttaagtagtctcatttataccttgagagtgatttaattacccacagcatctgtttaacattgtactcacagagaaatcacagaaacgtatgcaacattggttgttcctaagtagattcaatgttctctaaggtctcattaacctgtaagttctcacatgtttgttacatctgagctaatgaagaaatagccaggggtaaggaactgagaaagagactatggctgtctcaacacaaacccattccaggactgtaaaaaatatctgacaagtcatatcttcccagtgtggtagtaaaatcactggagtgtattggatggtataagcaactgaagaggattaagaatggcctctgtggctgggcacagaggttcacgcttgtaatctcagaacattgggaggcttaggtgggagaatcacttgaactcaggagtctgagaccagcttgggcaacataggaagacccccacctctacaaaaaaaaattaaaaattagctgggtctcgtggtgcacgtctgtggtcccagctactcaagaggctgaggtgggaggattgcttgggcccaggaggttgaggctgcagtgagccaagatcacaccactgcactcaagcctaggtgatggagcaataaccactctagaaaaaaaaaaagaaaaaagaaaggaaaaaaaaaaagaatggtctctttgccaggcatttctcctttagtccctaaaaaacataggcagtaggtagctgcctcaagttggattcttcagaagctgacccttagacgcaggagagagaagtgtaagatggggataaaagtctcttttccaggtaaagtctctgcctgggctggggtattctagggtaatgtgtaaattacacattgaagtttgtccttatttgaggttagagaattaggctttcaaactcctgcaccagtcactcactggctatgaccccaagcagctccagtagcccaagggcagttccccaaagacagccacagatatgggctgggcaagcaaatgacagaggggctttctgcacagaaatgatgaaggaggcccacagaatcagggcagagccctacccgtgctctacggcattcatatccccaatttacatgggagaaaatccgacactcagagaggtcaagtacttcattaaaggtaactgtttaaggggcagagcttggctacaaacccagacagatttgactccacagttcatgctcactcttctctaccaaatgtgcctccctttcctgaccatcagttatatattcaggaacatattctgtatttatataaatagacattattaacctagcttcctgaggcagaagattctatcaggaattgtagtgaaatattatatttggggatctctagaagagcactacctaaaatcaatgcaatgaaagctacctgtgtaatttaaaatttactagtgctctcaataaaaaggaaaataaataagagaaattaaattaaataatatattttattttacccaacatacccaaaatattatttcaacatataatcaatattttaaaatgtaaaattttttatacaatgtatttttgtgtcctttacacttgtagcatgtctcaatttggttgtgaaatatttatcaaaaacattgccaggtgtggtggcttatggctgtaatctcagcactttgggagggaggcagattacttgaggtcaggagttggagaccagcctggccaacatgaaacctcatctctattaaaaatacaaaaattagccaggcatggtggcacatgcctataatcccagctacttgggaggctgaggcaggagaatcacttgcaccagggaggcagtggttgcagcgagcagagatcttacccctgcactcaagcttgggcaaccgagcgagattccatctcaaaaaaaatacttgatgtgaatttagatttcatacgatttacagctgaaaaagtagattcacatagccaagttagtccaagaacacttaaaactttctataactgcatcaagtatcatttttaaaatttaaaaatattaaaattaaatttaaaaaaattagttcctcagtcgcactagtcatatttcaaatgctcaatagttttacaaggctggtggctaccacattgaagagtacagaaaattttccctatgaaaaggtacaaggatgtgattcagtataccatcaagaatcaaaccagtcaaccaataggtaaatattgagtgtctctcacgtgttgcatgtagtagatatagtggcagctaaaacacccttggccaggacaagttagctataaggactttgcaattggagttacatggaaggaataagaattggccattctccaggcacagtggctcacgcctgtaatctcagcactttcagaggccaaggtgggtggatcacctgaggtcaggagtttgagaccagcctgaccaacatggtgaaaccccgtctctactaaaaaaaaacacaaaaattagccaggcatggtggcgggtgcttttgtaatcccagctactcgggaggctgaggcaggagaatcacttgaagcagggaggtggaggttgcagtgagccgagatcacgccattgcactccagcctgggggacaagagtgagactccatctcaaaaaaaaaaaaaaaaaaaaaaaaattggccatgttcatagctttggatcagagctactcaggaagaaggtaaagttggcttttatttgatctttggtaaacagcctatttgcaatacttgattttcatctcagtaatacatcctggaggcctagttacgtggtacattttgtaatctggtgagaagctctgcaacaaacccaagagcactgataagtggccactttaaccctgtaacctttcctgtacatgatggatagtactggaagcccagcaaggtgctagaatatgaaagcactagaaaaaatctgtcatccgtctaaacgtacatggaggtttatgctcaaaagaaaagagtatgtttccaaaaggcaagttcagagtgttcatgatagaactattgttagccaaaaactagacattattccaacacaaatagagagtagaattctttaataaacagtgggattttctggactattcatgatgtgaaataccattcagtgatgagaatgaaaaacctactgctatatccaataatatggatgaatctcacaaatattataatgagtaaaaaaagccaaatacgaaaaacaacaaaatgtagaattctatttgtacggagtttaaaaacagggaaagtgaatgttttattttaggagtcaggagagtcattatccctggcaaggaatgaggggtaataattagaaagcagcataacgagggctcccgaggtattggtaatgctctgttttgtaatctgaatgccagtcatacagatgttcacttaatgaagatacttattgtccacatacttttctgtatgtgtcatacttttaaaaaatgtatttaagcaatgaattcattcatccgtttattcactcatgtgttaattctcctgaagacgaacagagttctctattctagaactctaaaggtaagctaggcatgtaagaaagtcaaaggcatcatttcatgctgtgattccaccttctgaaaattcaaacatccttcttggaggcagaggaaggaaaaccaagcagatcacagagctggggactccatgagaattggaggtggtaaaaaagaacttttgtgcttattgaggttactttgcctggcctgtcctcccctcacctctgcctaatgaaatactaaccttcttcaagttccattcatgacgacttcttctcaaacaaaaattaccttgccttcttctaaatttttaggacatttgtctgtgctaatcatagtttattcccatgcattataataatttctagaaagcagtgtaatgttgtgtttaaaagcttgggctgcagagtcaagcagggttcaagaccttccatcacttgctgtgtgacctggagcaaattgcttaatcagtatgcatttttttctctgttgtaaaatgaaggtgataatagctggacctatctaataagctgttatggagatgaaaagagataatggatgtacagctgctggaaatcagtaaaatctcaggaaatgtttcctattatttttactgagtactatctactctagcagataataggttcctgaagaacatggaacatgactcagagaagttacagtgaataaactcattacagacatctcagattggcttgccttacatgtagtcatgttcttttttctcatacactagcttaaactcctctagaacaggacctacaacttattcattgtaatattcctcacacagcataacactgggttttaggttacatagatgggttataatctcattttattaatgagttgaagccactgaggaagtcttgccctttctcgtttagcgatgctcaaagcaaaccaaagataacttctataaactccccctatgaattctcttacttctagggtgaccaaccattctagttcatgaagggctgtcctggttttggcactgaaagttccgtgattccagaaacccctcagtcctagacaaaccagacctgttgatccccctacctgcctctgtgcccatatgctcaggctagcttgtttgtttgttcatttgtttgtttgtttgagatggagcctcactcttgttgctggagtgcaatggcacgatctcggctcactgcaacctccgcctcccaggttcaagtgattctcctgcctcagcctcctgagtagctgggattacaggcacctgccaacacgcccacctaatttttgtatttttagtagagacagggtttcaccatgttggccagactgctcttgaactcctgacctcaggcgatccacgcacctctgcctccctgggattacagtcgtgagccaccgtgcccggccacttgttgtttttattgatgaatcatccttgctcctatctaaagccaagtcttcattctggttggcattttctctacttattcaactactgggctcttgaaattctcctccctctttcctgcatcatcaatctttttccttctactgaaccacttccattagcatataaacacgctataatttttcctactaaaaaatgctttaagagacctggtatgttggctcacacctgtaatcccagctttgggatccctataatcccagcctgtaatccctcactttgggaggctgaggtgggcagatctcttgagctcaggagtttgagaccagcctaggcaacaaagtgagaccctgtctcaacaaaaaaaatagccagccatggtggctcatgcctatagtcccagctactcaggaggctgaggtcgggggatggcttgaacctgggaggcagaggttgcagtgagctgagatcatgccactgtactctagagtgagctacagagcctgaccaaaaaaaaaaaaaagccttaaaaattaaaaacatctgaacttgtttctagacacaggtaaaaaataataataatacaaaaattaaaacaacaacaaaatgtcccaagcctacatctccttcaacctaccaccccaattcttggctcccctttataacaaaactccttgaatgaattgtctatacacagtctccacttccaattccccttttctcattctttgttgaacgacttcaatcaggtttttattcccaactctccacagaaataggtcttgtcacaatttgccaatgatctggaattttcctaggctatggaattatgagaaataaactcctattgtaataaa

SEQ ID NO: 1067 - DNA, 5674 bp, Homo sapiens
tgggtgggtgaggttacagggtacctgacacatcacattccagtcctggttcaagaaggggaaaaagagaacccacactgaatttgagtgcaaaaaataaatataaaatttattaaaacacccacaatattttaaagataccaggagtaatacagttcacaaacccagttgtttgtgtaaattataataaaatacaaatcaaaaaggatacatacttgcaatttctaggcaccctaaattaaatttactgaaacactgagggagaagggagggtaaggaggggtagctcaggaggcaaaccaataaagtggaaggaaaaaatattaacaaaaaggtaaaaattatacaaaataaaattatcagcataaatttactgtactaagaatatctacagtttaatacacatcctattgccttgagacattgcaaaaatctaccattcatccatcaaccccagataaacttcatttcaagtagccacagtttacaaagtcaagacggaatattcaagtatggttgttaagttcacctccattggaagccaagtaaccaaacaggaattcaaagagataagaaataaaacacatcaaaaagctacaggggttctagattaagtctaatgtattaatatgccattatacgacctgcccttgtttctttaattggaatacatgaaaaagaaatgacatcactcctgtttttctcccctcttttcccctcaaaagaaaaaaaagggtattgaaaccaagaaaatttggaatgttcacatgagccaattagtttcttaatttaaatccccgtgtgaagagtgatgagttacccctgaatgacgggtagtcaaaacgcgaagagggagcaaacaataccactacaaaaagcatccctgatatcagaatagaagccaatgaggaagtaggccaaatcgctcgctgattcttaggcaaaaagcaactttagaccttgcatttctgtgctgcggtctctgctcaggggagaagcctattgctctgctcttgcctgcagctctgcaggaggaagggctgggagcaccagagggggccgcccctccccccgcactcgcggagtgcactcgcactctgtgcacctggatgtgggactgtgtaacttatgttgggggtatgcacctcaaaaatgttttggtccagggtatgttgaagttggccatgtactacagcagaggcagctggctaataaaactaggttttgagggagtcatttcaaatgacagcaacaatgactgagaaagctcaatgagatgggcataggaaattcacattttattcaaaagcaaaacttaaacatgaaatacagccaactacgctccttcctttcggcgttccgctatcttaactgctgaagaatgaaaaacaaaatgaccccagatttttcaaggtcaagtatgtcatcagacggacaacctgcaggtatcagaccctcatggaatctactttactgaagttgtcatgatgtcctgtttttgaggtatttaaaaaaattattgtgacagtggatgacacaaaatggagcttcctggtgagtttttaaaacatcaacttctgtggacccaagaagaaatttaggttagcaccaactaaaaagcagcctcagtggcatcgagtgagcaaagaaagctccttcctttagtccgaacataaggggttaccaatgagaggcagaagtacccaactccccttcctcaaaaacaaaaactcaaaaaacccttcgccctttctttcacatcaagcctgagaagacaggtgtggaaccaaaaagcacctgccaagccaggcaggcccactcccgatcacagaaagggagatagctgccttctcgacttgctttgtttggccaccaagggaagaacaatacaacacaacacaacactgctcagagcagattatagcacggtaaacgggtctaagacagcaccaaaagaggggagggaaaaaaaaaagccaagagactggagcccaccttgtttttggttggttgtggtttcagaacgttgatagcacctcagcaagacaggatcagggacagtcacattaaaacaccatagcaccattttatttagactatttcaattcataaaaatgcttcctagtccataaaacacacttcagtaacaaaaggaaagagatactggttgaggcacgtcagggatatcatatagttttccaccagctttgccttggtttgagatctcatggtgattaaacctctagaagcaagtctggctgggtttctctcaatgaaattaggttatcatcgactcattgtcaaccgtccttgcacatctactgctgtgtggtacaaagcagttaagctctgctacttctttccttgctttagcgctttaaaaatcccttgctctgcaaactactgttcccaaaagaggctggtggaaggaccaagagggggcggtggggtatcatctctttccacgcacaccatcgtcaccttggtgagaaggcaaagcagtacccatgaagccggggtgtgggaaacattggccctgctaaaagccagacccaaaaccaaaaaccgaaagacccccaaatccatgcaacacctttagtcaagatttctgatggtcagatgatgatttcttgagctagcaccagttattttgtgagaacctgctgcgaagcgatttttattttaaaaatctcgtagcacagaactttacaagcacttcccttgcacgcaacaggcagggaaaacaaaacagagcagaaaaggaaccaaatgtttgcactgcacgtggatggtgtccgtggacagggcacactggggagatgactaagacgccatcgatttccgttgctataatatgactcttcgaacttggtcatgctgttaggttctttagttgcaatggctttatttttcttctcatgataaaaatgtctgttaatcatctttaggacttaaaaaatgatagtgccagtaaaaaataaaaatttgatttttctctttaagaaagcttcagcagcaagggggggataaagagctgtgcatagttactttttaaatatatgtctaaagcatgctaattttaatgactgagatttgaggtaggttagacatgtagtgtacaaatcagcatgggcttgagcacggcaaccacaccgcctaactctggaaacgccattctgcggggagtggggacatccaatggagactgcctcttgactcacctctcagcagcctatctcctactgcagaaactgatgaaccaaggctgtttgggctgggggacagacgtcgcatgcttttagcttgtattggtttctcctttcatctaatggctttcctaccaaagggtgatgaggggaagagtttatttaacatacatcaggaagattcacacatgccaagtatcagaatcacctgggttacactcgggaccttccaaaccaacagccaacctggggcttccacgggtcatacagacggtcacattctccaaatgtttcgtaaaatattgtatttcttgcttaagatcatttaaaatgaagttttcaaggcacccccgcatctacctaagcacggagtcaaatgagacctgcataaaagtactgatgcgataagcaaaatagcatttaaaggacccaatttttcctcaaaactagaaaattagcatgctcattaaagactctgcttcctttagcttgtcaaactgaaggtcagaggttttcctataaatctgagttctgaataattctaagtcctgataagctcttgggtatttatttcaaaagcaataatatttcatttttttgtcctgtaaaataaatgcaactttacagaatatggtaaaagtggaggatagacaaagcacattaaatattcggctactatttacaatttctcccacaattacatgttaaaacatactttttttttcaagttgctgtttaaatctaggcaaaagtgcttaaaaaaatctttcactatttacagttaaaaccagaccacataaatgctcaggacatcttacaacgaccctccgccagtgcttccaaacagatacagtaaacacccagcaggccggttctcagctcttactcaaggcacccggaagctcaggaacttgcctatagcggtcatctgattgttaaacatgattcatgaagacccatatctgaatacaactgctcagtaaatacctgttcatctcagggcttggtggtcatccaccgtgtggccacattcccctctgtgtgtcctgatgaagccccccattcaccacacacacatccacatggctagcatgagatcatttctgctaatatcacaagaaaaaccaacactccaacaaagtttgacttggtgatgatgagtgttgctcccatcaggcccaacctctctcgacaacgtcacaaaaattaagcaccacattctcatttcaaagaaccgaatgaatgcaccagaatttcagaacagctatattaaagtggatgaagaggggagaaaggaaaaaaagaaaatgatcaaatggagaaatggcaccaattagggaggaaaattatagcaacctgttgaaaatgtttgactcttgcactttaaaattgttaagtgtaggcccccgaacccaatgacagcatggaggaagcaggctcaggtgtgaggcatgcaccattgtccaatgtggaaattcagggatcaggatagatgcattaactgttgttacactggtctgctgagctcctgtaggatgtgacctgcccaagagtcaagaaagtcccagcacaacactacagcaccaggctccgcacagcaccatgcacagagcaccactggcttttcacagcttgggttcaacttcctgtttttaaagatacagtagccctttttcagtatcagcatagactttgggggcattttttaaaaaactgccactaagacaaattccttcagctcagcatgcattggcttggcaacatggtgggcacggcccctaagaacctcgcactccagctccagcgtgaggtgctgcctagtgaaccatgacatcgtgtgactccataaataacggacagaggattcagtgtggagactagcaagcttgaagccatctacttccaacctggtttctggggaaagctatgccagcatctcgtggggctggcctggggtgcatctgcccttcgactccaagccggggactggaaaagggaccccagatggttttctgcagactctcccatcctatcagagaggacagaagctgtcctgaggctcccttccccaaagggaaggggtgtatgtcgggagggatgaactgggtggctaccgtccgcgcttggctctcgaggggcagatggctgaggacctcgccagcgcccgaggggcttggctcgccagacccagcgagactgggcgggggagcactactggcctttcctgcccatcctttaccattactattgtcgcttttaaaaaatccaataaatacacattttaaatggaatttaaaactactcctttgtgaaaggatactataaactttctttccattattgtgatatacaaggatagagttttaaaaacaaagagaaaataaaaataaaaaccccccagacaagggggggggacaacttggagatataaatattaagatcacggaaaaatcacccgacagccgtag

SEQ ID NO: 1068 - DNA, 5674 bp, Homo sapiens; identical to SEQ ID NO: 1067

SEQ ID NO: 1069 - DNA, 5252 bp, Homo sapiens
aatttgagtgcaaaaaataaatataaaatttattaaaacacccacaatattttaaagataccaggagtaatacagttcacaaacccagttgtttgtgtaaattataataaaatacaaatcaaaaaggatacatacttgcaatttctaggcaccctaaattaaatttactgaaacactgagggagaagggagggtaaggaggggtagctcaggaggcaaaccaataaagtggaaggaaaaaatattaacaaaaaggtaaaaattatacaaaataaaattatcagcataaatttactgtactaagaatatctacagtttaatacacatcctattgccttgagacattgcaaaaatctaccattcatccatcaaccccagataaacttcatttcaagtagccacagtttacaaagtcaagacggaatattcaagtatggttgttaagttcacctccattggaagccaagtaaccaaacaggaattcaaagagataagaaataaaacacatcaaaaagctacaggggttctagattaagtctaatgtattaatatgccattatacgacctgcccttgtttctttaattggaatacatgaaaaagaaatgacatcactcctgtttttctcccctcttttcccctcaaaagaaaaaaaagggtattgaaaccaagaaaatttggaatgttcacatgagccaattagtttcttaatttaaatccccgtgtgaagagtgatgagttacccctgaatgacgggtagtcaaaacgcgaagagggagcaaacaataccactacaaaaagcatccctgatatcagaatagaagccaatgaggaagtaggccaaatcgctcgctgattcttaggcaaaaagcaactttagaccttgcatttctgtgctgcggtctctgctcaggggagaagcctattgctctgctcttgcctgcagctctgcaggaggaagggctgggagcaccagagggggccgcccctccccccgcactcgcggagtgcactcgcactctgtgcacctggatgtgggactgtgtaacttatgttgggggtatgcacctcaaaaatgttttggtccagggtatgttgaagttggccatgtactacagcagaggcagctggctaataaaactaggttttgagggagtcatttcaaatgacagcaacaatgactgagaaagctcaatgagatgggcataggaaattcacattttattcaaaagcaaaacttaaacatgaaatacagccaactacgctccttcctttcggcgttccgctatcttaactgctgaagaatgaaaaacaaaatgaccccagatttttcaaggtcaagtatgtcatcagacggacaacctgcaggtatcagaccctcatggaatctactttactgaagttgtcatgatgtcctgtttttgaggtatttaaaaaaattattgtgacagtggatgacacaaaatggagcttcctggtgagtttttaaaacatcaacttctgtggacccaagaagaaatttaggttagcaccaactaaaaagcagcctcagtggcatcgagtgagcaaagaaagctccttcctttagtccgaacataaggggttaccaatgagaggcagaagcaacgctgggtcagagaatgaagcccctgcccaccatggtcccagccagtgccaggggaggaaggagatccatctggtctcccttggtgtgcccttgggactcccagagatgtctgcttagcaccctgggctgcaggagaaaatctgtccctggctatgagaatgcctatcatgctaggagaggcagaagtacccaactccccttcctcaaaaacaaaaactcaaaaaacccttcgccctttctttcacatcaagcctgagaagacaggtgtggaaccaaaaagcacctgccaagccaggcaggcccactcccgatcacagaaagggagatagctgccttctcgacttgctttgtttggccaccaagggaagaacaatacaacacaacacaacactgctcagagcagattatagcacggtaaacgggtctaagacagcaccaaaagaggggagggaaaaaaaaaagccaagagactggagcccaccttgtttttggttggttgtggtttcagaacgttgatagcacctcagcaagacaggatcagggacagtcacattaaaacaccatagcaccattttatttagactatttcaattcataaaaatgcttcctagtccataaaacacacttcagtaacaaaaggaaagagatactggttgaggcacgtcagggatatcatatagttttccaccagctttgccttggtttgagatctcatggtgattaaacctctagaagcaagtctggctgggtttctctcaatgaaattaggttatcatcgactcattgtcaaccgtccttgcacatctactgctgtgtggtacaaagcagttaagctctgctacttctttccttgctttagcgctttaaaaatcccttgctctgcaaactactgttcccaaaagaggctggtggaaggaccaagagggggcggtggggtatcatctctttccacgcacaccatcgtcaccttggtgagaaggcaaagcagtacccatgaagccggggtgtgggaaacattggccctgctaaaagccagacccaaaaccaaaaaccgaaagacccccaaatccatgcaacacctttagtcaagatttctgatggtcagatgatgatttcttgagctagcaccagttattttgtgagaacctgctgcgaagcgatttttattttaaaaatctcgtagcacagaactttacaagcacttcccttgcacgcaacaggcagggaaaacaaaacagagcagaaaaggaaccaaatgtttgcactgcacgtggatggtgtccgtggacagggcacactggggagatgactaagacgccatcgatttccgttgctataatatgactcttcgaacttggtcatgctgttaggttctttagttgcaatggctttatttttcttctcatgataaaaatgtctgttaatcatctttaggacttaaaaaatgatagtgccagtaaaaaataaaaatttgatttttctctttaagaaagcttcagcagcaagggggggataaagagctgtgcatagttactttttaaatatatgtctaaagcatgctaattttaatgactgagatttgaggtaggttagacatgtagtgtacaaatcagcatgggcttgagcacggcaaccacaccgcctaactctggaaacgccattctgcggggagtggggacatccaatggagactgcctcttgactcacctctcagcagcctatctcctactgcagaaactgatgaaccaaggctgtttgggctgggggacagacgtcgcatgcttttagcttgtattggtttctcctttcatctaatggctttcctaccaaagggtgatgaggggaagagtttatttaacatacatcaggaagattcacacatgccaagtatcagaatcacctgggttacactcgggaccttccaaaccaacagccaacctggggcttccacgggtcatacagacggtcacattctccaaatgtttcgtaaaatattgtatttcttgcttaagatcatttaaaatgaagttttcaaggcacccccgcatctacctaagcacggagtcaaatgagacctgcataaaagtactgatgcgataagcaaaatagcatttaaaggacccaatttttcctcaaaactagaaaattagcatgctcattaaagactctgcttcctttagcttgtcaaactgaaggtcagaggttttcctataaatctgagttctgaataattctaagtcctgataagctcttgggtatttatttcaaaagcaataatatttcatttttttgtcctgtaaaataaatgcaactttacagaatatggtaaaagtggaggatagacaaagcacattaaatattcggctactatttacaatttctcccacaattacatgttaaaacatactttttttttcaaaacagctatattaaagtggatgaagaggggagaaaggaaaaaaagaaaatgatcaaatggagaaatggcaccaattagggaggaaaattatagcaacctgttgaaaatgtttgactcttgcactttaaaattgttaagtgtaggcccccgaacccaatgacagcatggaggaagcaggctcaggtgtgaggcatgcaccattgtccaatgtggaaattcagggatcaggatagatgcattaactgttgttacactggtctgctgagctcctgtaggatgtgacctgcccaagagtcaagaaagtcccagcacaacactacagcaccaggctccgcacagcaccatgcacagagcaccactggcttttcacagcttgggttcaacttcctgtttttaaagatacagtagccctttttcagtatcagcatagactttgggggcattttttaaaaaactgccactaagacaaattccttcagctcagcatgcattggcttggcaacatggtgggcacggcccctaagaacctcgcactccagctccagcgtgaggtgctgcctagtgaaccatgacatcgtgtgactccataaataacggacagaggattcagtgtggagactagcaagcttgaagccatctacttccaacctggtttctggggaaagctatgccagcatctcgtggggctggcctggggtgcatctgcccttcgactccaagccggggactggaaaagggaccccagatggttttctgcagactctcccatcctatcagagaggacagaagctgtcctgaggctcccttccccaaagggaaggggtgtatgtcgggagggatgaactgggtggctaccgtccgcgcttggctctcgaggggcagatggctgaggacctcgccagcgcccgaggggcttggctcgccagacccagcgagactgggcgggggagcactactggcctttcctgcccatcctttaccattactattgtcgcttttaaaaaatccaataaatacacattttaaatggaatttaaaactactcctttgtgaaaggatactataaactttctttccattattgtgatatacaaggatagagttttaaaaacaaagagaaaataaaaataaaaaccccccagacaagggggggggacaacttggagatataaatattaagatcacggaaaaatcacccgacagccgtag

SEQ ID NO: 1070 - DNA, 5252 bp, Homo sapiens; identical to SEQ ID NO: 1069

SEQ ID NO: 1071 - DNA, 5252 bp, Homo sapiens; identical to SEQ ID NO: 1069

SEQ ID NO: 1072 - DNA, 5252 bp, Homo sapiens; identical to SEQ ID NO: 1069

SEQ ID NO: 1073 - DNA, 8833 bp, Homo sapiens
caccagctagcctgctagaaaacaagagacatggaaagcacagctgagcctccctagttgccacaatgctattactaaatcagatgacagccagttgactcctagacatgacagcaagcccaaaagagatcagcaaagccacaaagctgaccacccaagacacacaaggaaaaagcatatattgttgtgtgccactaaggttttgtggttgctggctacatgtcattattgtggcaatatagagctgattcagcagatacatcaggactgtgttggcactgttttataataaagtgaattaaagagctttggaacatcctgtacagaaagcaatgaagagagagagtctgaagtgattatgaaaagaatattgagcaagaagaggaacttcttgagtaagaagtggaactgagaggtgctcatcatgacatttaaatatttcctgagaattctcagaaatattaggggtgaggagaaagctaaatttcctatagccaaatgtagcttggtgacacaaaatactgtatttggttatttaaaagaagagggggaggtaaaacgtaagaaggccagagcacctgggaccttgttttactaaagcttattatgtttcagtggccctggttccccatgacaaaagtacaaagagtacccgcaagaagtaagttgaagataaggagtgaggagaaggaaggttagtggtaaggccaccagtgattctaacagcaaagggacaagaaaaaagactggaactttatttagaggataaagctgatgcctggcttgccatcttgcccagatgggacctcaggcataggttcctaactgtgaatatcctgattttgaagaaaacagtagattaatttcaactgctggcagctttcacttgaccttgcaaaggttacaattatccagaaatctcatacctatgagggaagccaacttctgtgtcatgaggacattcaagcagcactatggagccatccatgtggctaggagctgaaactgagccaagaagcagtgaggaactggctggtaacagccatgtgggtaaaagccatctgagaagtgcatgctctagtctcagtcaagccttcagaagactgtggcacctgacatctccactgcaacctcattagaaactcaagacagaactgccagagaagctcttcctgaatttctgacctacagaaacggtgtcaaaaagatatttattattgttttgagccctaagtttttggagtgacttgttgctccaaatatattagataatatattatatatgtaaggtaacatttcagttttgacattttcacatgcatgatcagttatttcagcactatttaaaaatttctttctatcttctgttatcagcaagatcagctgtgtcataaattaagtttccaattatatgtagatttgattctggactctttattctgtttcacaggtcacgttgcttattcttgagtgaatacttcattatttaattattatatatatatatttgataaggcatacagtttgctatagtcttacctatttttaaacctttggtcttttatatccttagaatcaccttgacattctttacaagaaaatccatcgggttttgagtggaattacactgagtataagtaccagttggggaaaaattgacatctttagtatgtcgaatcttttaatccatttgtaatccatgctgtgttactgtttttatttggagttgtctttcaaaatgttttacagttttctttgcaaaggtcacatacatcttttgttagttccattactaggtatttcatttttatacacaagaatgaaatattaatagatccttaaagaaaataacatttaaaatagcataagatatatcaaattgctcaagtcagaaactggcacataataaatacatcataaatgtcctaaaccagatgtatgaatgaataaataaatggatgagtggatgaatatgagacccagtatgcctatctataacctattatttcagataccattctgcttaggtattcagtattctcaagggatttttctccacaataagaaaacttgatgcttccagttcttacctcagtatgccactgataaagtaaaacagatctaaaagaatagtttcaaagagatgtaaaatgacaccttatgtcaacttgtcttttcctttttcatgactcctttttcttctttctaacttttggcatctgtaattgagatttccttccaagcatatttagctcaacttaaatatacttcattgaggctttggcaaaccttttcaagtataaggataatacagaattatctatttttctatagtttgttttattgctgctgttattgttgttttattttgtttgctataaagattagcctcttgttcaatggaaaatatgatcaaaaacagtgttcaaaaattatttaagggccccatcactacagcaatcattagtcctactgtgtatgaaatttctaagtatttctaaatgctcaaccctagacatgcccttcactgatatttttaatgtgctttcagtaccttggccatttaataacttatgttcttttttcaaaatcttaggaagaaattgtgttttggaattgggccaacagtatgtgtttctccggtggataagcaaaatttcataagaacaaagatgattcaagcagatgtttatcatgaaactgccataaaaagcacccgaagtcacaaagataaacatcaaatccagtccttggaaatttcccccaccctacctgagcatcttttgaagtagatattcaattattttgaaggatttttaaagaattttctagatttcatctaaaagacacttttgaaatctgcgttaaaattcatggaaatatatcctagatgaatttggaggaatgtaagcaagtaggtacaaacctttattttatccctcagtgactcactcagttgtgaataggaagggctctctgtgatctggccacagcttatttcttgccacattcctattttcagtcctcttccaatcatgtggaacttccagcatctccttacacatgccatgttatttcacacttttgtgactttgctcatatttttctctctccctggaaagctccccgacaacctccactgccattacccactaggcaagtacatcctgttttcagaatcagcccaatatcatctttcctagggaatcttgtcagactgcccttcattaccaacagacaaaataactaccttatctttggttctgtcttcactctagacctatgtagcatgctacttataacactgcattggtttgttggcatttgtattttccactgagcaaccataacttatgtgtagacaaaaattgtattgctcacctttggattactaggacctagcagtgttctgattcagagtatgtactcaataaattcatcttgaaaagtgaatgaatgaataaatgaacgcctgcatctccatcattgatttactatttaatcagtgaagtttttaaattatattcccccatatcttgagatttgatcttgtgttaaatcagttgcacatattagacattactttgtccttttcacttctccttagcacatatgggctatataatctttataaaggttaaagaaatatattgtaatatgttataacacaatcaagatacatctgaaacaacatagtgcaggcactatttccgatgttcaacatcatgctggagtaaaacttagagactcttggaaaaaagaaatacttaaataatgtcaccagtgtaatgtgctacattgtaatggtgttatgcttattacatgtgttatctagtaatgcacaaaaagcctaatggatttgctcatattttcctcatgtgcaaatgaaaacactgagtctcagagagattaaataaattgccaaatgtcatgtcaagcgattttgatcctggtatttctaatataaaagcccatgttttaatttattaactgtttgacatataacaataatagatcattacatgttaatataaataacctatgtatgaagactaattatatttttacttctgcattcaatcaactgcaacatgtcattttggttgatgtgtacagaaaatactcaacatctcgcagatattgggttggaaaacagaggacatttttatatctgtttcagataaatgtatatatttttctttgatagtacaccaaaatttgacaagtgactatttcttaaagggtagttgcagcatgaaatccaaaataacatcaataaacttttcattctctgttacactaaaattcattggttttatcttacacaaagtgtggatgattttgtaacatcatgtgttggtcatttagaaaacattattccactgggttatgcagattttctaaatgctgacacatttcattttataatttcaaaaatgaacatttattaatgtcaccaatatcatcaaaatgtttgaactactgggacgcatcaagttcattctggtagacacacatttttcaacatgtaactcttccttgaaaactcaaattttatcattgacaacaaatgcggtcagttgttttccttgaattatcaaactcactttgctcatttttgagaaaatatttgccaattatccaagtctgaatagacatggtttctttgtcaatgttcgttcttttaatggtgttttctgaagaaaagtgtagttcatttgcaactcactggcacaaatgcttttcttccagacaaccatcatagttgagtaagcagcagaagtgcctaatgcatactttccattttatcacgcagaatattagcagaacattttctcaagggttgagatttaataacacaaataattgtaactacttcatcaatgatatacttaagtgaaacaggcatgcaataaaatgtttttgaataaatgaataaactgccttgtattaggcccaccaaggtgaatttgaaggtatatatttgcctcatggaaacagaactaacacagtgtttcataaatgaaagttcacagatagatcacattaatttaactcagaatactttattgaaatgtagaactgaggccccattcccaaataatcggatttggtccatctagggtgaaaagagagacaatgcatattaaaatacgctccagataattttgaagaactgtcagttttggggactgcctgctaatgggactgtagttacagagtttctttgggcaatgatgaaaattctctcaaactttatcaaaggccaaaaaatgactggctaatattactaattagaattctactataatcccatagtacaagtttatagtttttaaatctcaagtgtgtcaaatgtatattcttgccaagcgtgctaccctccacgataacaaggagagactgcttccaaggacagggatcaagtgagtctctgagttaaatcctgtccttcctttcatattctccttgattaacttacaaaataattacattcttttaaagtgtgtcctcattaattacagtttttttgacataatttaaaagaattattttcttaaggtatgccaacagagggtaatagaggtgggctgggacatttattcttctctgatctttctctgatgcacccaaaggctatttaatgcacaactgccctctcattgcaacatcaaagcatgtaattcactatttaggttttactttcacagtagagaaattgtccagactaagcatattaaatcgtgttgcaaatgacttttttttgtgaggtaaaatataaataacacaaatttaccatttaaaaaatttttaagtatagagtccaatggcattaagtacatttatatcattgtgtaactatcataacaaatgacttttatataagtaagtcaatggaaaattcaagtatatcatatctacaaagtatcttcaattattaaagtaaaaccatagttttaataaaaaacattatcaaaagacttcatataaactaataatcctattgctaaattcctgacattgttatttataggactgtcttttaaaatatatttacatttgaattttttaataacccaaagattttcatccagatttcatattaaaaataaattcattgatccatcatgatacagattgcatataagtatattaaatgacagactttttatcctagtttcattttaaaaacaaactttcctatcaatcacgggcagatgttgataaggtaatagcagctgtggcagagaatacatttttattaaggaaaaatgacaatgtatgtctttaatgggtaagattattaatagctctttgcaagtatcagacagaagtttttatgagtattttaagcaaaagctttaataaccgataactcattcactgtgtttcttattggggtaccagctgctactgttccttctctcttcacaagaattcaaattccaaggctatgtgtacctgacaataccagacaggtcaaaacatagccaccaacttgactaagagaattaaccatttaaggcaaaatatcacgaggttttcccctctttccacatccttccttctttatgccctcttcttaagcattgctgtttcccatgtatccaacttcctactaaacccatataattggacaatacatctcaatacagttacaaaacccaactcattatttcctccccaaccttccccacaatgggtgggtgtttttgatctcagtgaaggtcaccacccctgaccagtctctctccccatgcagtgcctcagctccagaactagtttaccacaatggactctaatgagttttcctgtcactcaattctcttctctacactactagagttatctttctagtatttgaatctgattatgtttctcctttacttaaaaatccatcagtaagaaaacaaggagcagaaactttaaacattcctaaataccctcatactacttgcttcccactttccactacaccctccattcccattgttcccaataatcatccttctctccattcaaacagaattgactgaattctcccatggataaagcagttttctttttcttataacacgcttcacattgtctcttcttccattaaaagtaagctgaaacatcacttcccccataaagtgttctttgatcttaccccacctcacctctccagccatagccctaggccaatttaggcatcccctgtttgttcacctaaagctgtctctacacacctcttcccatcagagtacctcacaatcctagatttacttttatttcctctactagattgttgacttttgagagaaagggatgtcttactttcctctgaggtactagaaccaaacacagtattggctgcagtagcaagcaataaaagtttgttgaatggatgaatagctgaatgaatttaatcaactaaaatgtttagatttaaatatatagccaaccatactataacatgagaatccagaattattgtcccactattcaaaatgctcctctataaatccagtctactaaatgtttatgtttcattttggttaattcttagacaagagggtttagtgcactacagaaaccatctcattagattttcatatagttttatttttcctcatttatgtaatgtattacatatatatgtatactctagtgaaaatttttttgatcttgacttacacattcagttggtagacatttgtgtgggcatgaatataaacatgtctagtcacgagaatatcctgattcaaatagggaagcaaaagatgacacgctctcagacaggaagtgactgtcagcatcctttaaaaagaaacaacaggctgtggttcgtttatttccttgcttatttgtgacttgccctcagtgcctgatgatgcttggtacaaagaactgagtaaaactatcttttatattttctatttatatagcaatttacatttaaaagcactttcaagttaattctctcctttgaaacatttgttgatatgtcaattttagttaatattcctgaatatttgatgatttttaaaagaaaccaagttatagattcattttactgtatctaaaaattaaaattctattttggctcaattttgtaaaaatatctcaattatgtttcaactttgttttgaatttttaaaatggtctgtcagtccagtaatcccactgctgggtatatacccaaaagaaagaaaatcagtatactgaagagatatctgcacacctatgtttgttgcagtactgtttacaatagctaagtgtccatcaacagatcaatgggtaaagaaaatatggtacatatacacaatggagcactactcagccaaaaaaaagaatgaggtccagtcatttgcaacatgaatggaactggagatcattatgtgaagcaaaataagccaggcacagaaagacaaacattgcatgttctcacttatttgtgggatccaaaaatcaaagcaaatgaactcatgggcataagggtggttaccagaatatgggaagggtagtgggggtggggcagtgggggggaaaggtagggaaagttaatgagtacaaaaaatatataaataatgaataagacctactatttggtagcacaataaggtgactatagtcaatagtaacgtaattttacacttttaaaaaacttaaagactgtaattggattgtttttaactaaaaggataaatgcttgaggggatggatactccattcttcatgatgtgcttatttcacattgcacgcctgtatcaaaacatctcatgtatcccataaatacataaaccttctctgtacccacaaaaaataaaaataataaaaaaggtctgtc

SEQ ID NO: 1074 - DNA, 8833 bp, Homo sapiens; identical to SEQ ID NO: 1073

SEQ ID NO: 1075 - DNA, 7437 bp, Homo sapiens
caccagctagcctgctagaaaacaagagacatggaaagcacagctgagcctccctagttgccacaatgctattactaaatcagatgacagccagttgactcctagacatgacagcaagcccaaaagagatcagcaaagccacaaagctgaccacccaagacacacaaggaaaaagcatatattgttgtgtgccactaaggttttgtggttgctggctacatgtcattattgtggcaatatagagctgattcagcagatacatcaggactgtgttggcactgttttataataaagtgaattaaagagctttggaacatcctgtacagaaagcaatgaagagagagagtctgaagtgattatgaaaagaatattgagcaagaagaggaacttcttgagtaagaagtggaactgagaggtgctcatcatgacatttaaatatttcctgagaattctcagaaatattaggggtgaggagaaagctaaatttcctatagccaaatgtagcttggtgacacaaaatactgtatttggttatttaaaagaagagggggaggtaaaacgtaagaaggccagagcacctgggaccttgttttactaaagcttattatgttagtttcagtggccctggttccccatgacaaaagtacaaagagtacccgcaagaagtaagttgaagataaggagtgaggagaaggaaggttagtggtaaggccaccagtgattctaacagcaaagggacaagaaaaaagactggaactttatttagaggataaagctgatgcctggcttgccatcttgcccagatgggacctcaggcataggttcctaactgtgaatatcctgattttgaagaaaacagtagattaatttcaactgctggcagctttcacttgaccttgcaaaggttacaattatccagaaatctcatacctatgagggaagccaacttctgtgtcatgaggacattcaagcagcactatggagccatccatgtggctaggagctgaaactgagccaagaagcagtgaggaactggctggtaacagccatgtgggtaaaagccatctgagaagtgcatgctctagtctcagtcaagccttcagaagactgtggcacctgacatctccactgcaacctcattagaaactcaagacagaactgccagagaagctcttcctgaatttctgacctacagaaacggaagaaattgtgttttggaattgggccaacagtatgtgtttctccggtggataagcaaaatttcataagaacaaagatgattcaagcagatgtttatcatgaaactgccataaaaagcacccgaagtcacaaagataaacatcaaatccagtccttggaaatttcccccaccctacctgagcatcttttgaagtagatattcaattattttgaaggatttttaaagaattttctagatttcatctaaaagacacttttgaaatctgcgttaaaattcatggaaatatatcctagatgaatttggaggaatgtaagcaagtaggtacaaacctttattttatccctcagtgactcactcagttgtgaataggaagggctctctgtgatctggccacagcttatttcttgccacattcctattttcagtcctcttccaatcatgtggaacttccagcatctccttacacatgccatgttatttcacacttttgtgactttgctcatatttttctctctccctggaaagctccccgacaacctccactgccattacccactaggcaagtacatcctgttttcagaatcagcccaatatcatctttcctagggaatcttgtcagactgcccttcattaccaacagacaaaataactaccttatctttggttctgtcttcactctagacctatgtagcatgctacttataacactgcattggtttgttggcatttgtattttccactgagcaaccataacttatgtgtagacaaaaattgtattgctcacctttggattactaggacctagcagtgttctgattcagagtatgtactcaataaattcatcttgaaaagtgaatgaatgaataaatgaacgcctgcatctccatcattgatttactatttaatcagtgaagtttttaaattatattcccccatatcttgagatttgatcttgtgttaaatcagttgcacatattagacattactttgtccttttcacttctccttagcacatatgggctatataatctttataaaggttaaagaaatatattgtaatatgttataacacaatcaagatacatctgaaacaacatagtgcaggcactatttccgatgttcaacatcatgctggagtaaaacttagagactcttggaaaaaagaaatacttaaataatgtcaccagtgtaatgtgctacattgtaatggtgttatgcttattacatgtgttatctagtaatgcacaaaaagcctaatggatttgctcatattttcctcatgtgcaaatgaaaacactgagtctcagagagattaaataaattgccaaatgtcatgtcaagcgattttgatcctggtatttctaatataaaagcccatgttttaatttattaactgtttgacatataacaataatagatcattacatgttaatataaataacctatgtatgaagactaattatatttttacttctgcattcaatcaactgcaacatgtcattttggttgatgtgtacagaaaatactcaacatctcgcagatattgggttggaaaacagaggacatttttatatctgtttcagataaatgtatatatttttctttgatagtacaccaaaatttgacaagtgactatttcttaaagggtagttgcagcatgaaatccaaaataacatcaataaacttttcattctctgttacactaaaattcattggttttatcttacacaaagtgtggatgattttgtaacatcatgtgttggtcatttagaaaacattattccactgggttatgcagattttctaaatgctgacacatttcattttataatttcaaaaatgaacatttattaatgtcaccaatatcatcaaaatgtttgaactactgggacgcatcaagttcattctggtagacacacatttttcaacatgtaactcttccttgaaaactcaaattttatcattgacaacaaatgcggtcagttgttttccttgaattatcaaactcactttgctcatttttgagaaaatatttgccaattatccaagtctgaatagacatggtttctttgtcaatgttcgttcttttaatggtgttttctgaagaaaagtgtagttcatttgcaactcactggcacaaatgcttttcttccagacaaccatcatagttgagtaagcagcagaagtgcctaatgcatactttccattttatcacgcagaatattagcagaacattttctcaagggttgagatttaataacacaaataattgtaactacttcatcaatgatatacttaagtgaaacaggcatgcaataaaatgtttttgaataaatgaataaactgccttgtattaggcccaccaaggtgaatttgaaggtatatatttgcctcatggaaacagaactaacacagtgtttcataaatgaaagttcacagatagatcacattaatttaactcagaatactttattgaaatgtagaactgaggccccattcccaaataatcggatttggtccatctagggtgaaaagagagacaatgcatattaaaatacgctccagataattttgaagaactgtcagttttggggactgcctgctaatgggactgtagttacagagtttctttgggcaatgatgaaaattctctcaaactttatcaaaggccaaaaaatgactggctaatattactaattagaattctactataatcccatagtacaagtttatagtttttaaatctcaagtgtgtcaaatgtatattcttgccaagcgtgctaccctccacgataacaaggagagactgcttccaaggacagggatcaagtgagtctctgagttaaatcctgtccttcctttcatattctccttgattaacttacaaaataattacattcttttaaagtgtgtcctcattaattacagtttttttgacataatttaaaagaattattttcttaaggtatgccaacagagggtaatagaggtgggctgggacatttattcttctctgatctttctctgatgcacccaaaggctatttaatgcacaactgccctctcattgcaacatcaaagcatgtaattcactatttaggttttactttcacagtagagaaattgtccagactaagcatattaaatcgtgttgcaaatgacttttttttgtgaggtaaaatataaataacacaaatttaccatttaaaaaatttttaagtatagagtccaatggcattaagtacatttatatcattgtgtaactatcataacaaatgacttttatataagtaagtcaatggaaaattcaagtatatcatatctacaaagtatcttcaattattaaagtaaaaccatagttttaataaaaaacattatcaaaagacttcatataaactaataatcctattgctaaattcctgacattgttatttataggactgtcttttaaaatatatttacatttgaattttttaataacccaaagattttcatccagatttcatattaaaaataaattcattgatccatcatgatacagattgcatataagtatattaaatgacagactttttatcctagtttcattttaaaaacaaactttcctatcaatcacgggcagatgttgataaggtaatagcagctgtggcagagaatacatttttattaaggaaaaatgacaatgtatgtctttaatgggtaagattattaatagctctttgcaagtatcagacagaagtttttatgagtattttaagcaaaagctttaataaccgataactcattcactgtgtttcttattggggtaccagctgctactgttccttctctcttcacaagaattcaaattccaaggctatgtgtacctgacaataccagacaggtcaaaacatagccaccaacttgactaagagaattaaccatttaaggcaaaatatcacgaggttttcccctctttccacatccttccttctttatgccctcttcttaagcattgctgtttcccatgtatccaacttcctactaaacccatataattggacaatacatctcaatacagttacaaaacccaactcattatttcctccccaaccttccccacaatgggtgggtgtttttgatctcagtgaaggtcaccacccctgaccagtctctctccccatgcagtgcctcagctccagaactagtttaccacaatggactctaatgagttttcctgtcactcaattctcttctctacactactagagttatctttctagtatttgaatctgattatgtttctcctttacttaaaaatccatcagtaagaaaacaaggagcagaaactttaaacattcctaaataccctcatactacttgcttcccactttccactacaccctccattcccattgttcccaataatcatccttctctccattcaaacagaattgactgaattctcccatggataaagcagttttctttttcttataacacgcttcacattgtctcttcttccattaaaagtaagctgaaacatcacttcccccataaagtgttctttgatcttaccccacctcacctctccagccatagccctaggccaatttaggcatcccctgtttgttcacctaaagctgtctctacacacctcttcccatcagagtacctcacaatcctagatttacttttatttcctctactagattgttgacttttgagagaaagggatgtcttactttcctctgaggtactagaaccaaacacagtattggctgcagtagcaagcaataaaagtttgttgaatggatgaatagctgaatgaatttaatcaactaaaatgtttagatttaaatatatagccaaccatactataacatgagaatccagaattattgtcccactattcaaaatgctcctctataaatccagtctactaaatgtttatgtttcattttggttaattcttagacaagagggtttagtgcactacagaaaccatctcattagattttcatatagttttatttttcctcatttatgtaatgtattacatatatatgtatactctagtgaaaatttttttgatcttgacttacacattcagttggtagacatttgtgtgggcatgaatataaacatgtctagtcacgagaatatcctgattcaaatagggaagcaaaagatgacacgctctcagacaggaagtgactgtcagcatcctttaaaaagaaacaacaggctgtggttcgtttatttccttgcttatttgtgacttgccctcagtgcctgatgatgcttggtacaaagaactgagtaaaactatcttttatattttctatttatatagcaatttacatttaaaagcactttcaagttaattctctcctttgaaacatttgttgatatgtcaattttagttaatattcctgaatatttgatgatttttaaaagaaaccaagttatagattcattttactgtatctaaaaattaaaattctattttggctcaattttgtaaaaatatctcaattatgtttcaactttgttttgaatttttaaaatggtctgtcagtccagtaatcccactgctgggtatatacccaaaagaaagaaaatcagtatactgaagagatatctgcacacctatgtttgttgcagtactgtttacaatagctaagtgtccatcaacagatcaatgggtaaagaaaatatggtacatatacacaatggagcactactcagccaaaaaaaagaatgaggtccagtcatttgcaacatgaatggaactggagatcattatgtgaagcaaaataagccaggcacagaaagacaaacattgcatgttctcacttatttgtgggatccaaaaatcaaagcaaatgaactcatgggcataagggtggttaccagaatatgggaagggtagtgggggtggggcagtgggggggaaaggtagggaaagttaatgagtacaaaaaatatataaataatgaataagacctactatttggtagcacaataaggtgactatagtcaatagtaacgtaattttacacttttaaaaaacttaaagactgtaattggattgtttttaactaaaaggataaatgcttgaggggatggatactccattcttcatgatgtgcttatttcacattgcacgcctgtatcaaaacatctcatgtatcccataaatacataaaccttctctgtacccacaaaaaataaaaataataaaaaaggtctgtc

SEQ ID NO: 1076 - DNA, 7646 bp, Homo sapiens
ctcaatatctttagatacttgttatcttcctaaatttatctttcactccatagccttttccatgtgaatttgaagtgtccttttattctgatgctggggtctgccagcattctggcaatgggagactaggtgatgggatacagcagatcttgaaaagcactcatgcgagtgtgcatgcctgtgcttgccctcttcctctgccatgagaacatgcaccagctagcctgctagaaaacaagagacatggaaagcacagctgagcctccctagttgccacaatgctattactaaatcagatgacagccagttgactcctagacatgacagcaagcccaaaagagatcagcaaagccacaaagctgaccacccaagacacacaaggaaaaagcatatattgttgtgtgccactaaggttttgtggttgctggctacatgtcattattgtggcaatatagagctgattcagcagatacatcaggactgtgttggcactgttttataataaagtgaattaaagagctttggaacatcctgtacagaaagcaatgaagagagagagtctgaagtgattatgaaaagaatattgagcaagaagaggaacttcttgagtaagaagtggaactgagaggtgctcatcatgacatttaaatatttcctgagaattctcagaaatattaggggtgaggagaaagctaaatttcctatagccaaatgtagcttggtgacacaaaatactgtatttggttatttaaaagaagagggggaggtaaaacgtaagaaggccagagcacctgggaccttgttttactaaagcttattatgtttcagtggccctggttccccatgacaaaagtacaaagagtacccgcaagaagtaagttgaagataaggagtgaggagaaggaaggttagtggtaaggccaccagtgattctaacagcaaagggacaagaaaaaagactggaactttatttagaggataaagctgatgcctggcttgccatcttgcccagatgggacctcaggcataggttcctaactgtgaatatcctgattttgaagaaaacagtagattaatttcaactgctggcagctttcacttgaccttgcaaaggttacaattatccagaaatctcatacctatgagggaagccaacttctgtgtcatgaggacattcaagcagcactatggagccatccatgtggctaggagctgaaactgagccaagaagcagtgaggaactggctggtaacagccatgtgggtaaaagccatctgagaagtgcatgctctagtctcagtcaagccttcagaagactgtggcacctgacatctccactgcaacctcattagaaactcaagacagaactgccagagaagctcttcctgaatttctgacctacagaaacggaagaaattgtgttttggaattgggccaacagtatgtgtttctccggtggataagcaaaatttcataagaacaaagatgattcaagcagatgtttatcatgaaactgccataaaaagcacccgaagtcacaaagataaacatcaaatccagtccttggaaatttcccccaccctacctgagcatcttttgaagtagatattcaattattttgaaggatttttaaagaattttctagatttcatctaaaagacacttttgaaatctgcgttaaaattcatggaaatatatcctagatgaatttggaggaatgtaagcaagtaggtacaaacctttattttatccctcagtgactcactcagttgtgaataggaagggctctctgtgatctggccacagcttatttcttgccacattcctattttcagtcctcttccaatcatgtggaacttccagcatctccttacacatgccatgttatttcacacttttgtgactttgctcatatttttctctctccctggaaagctccccgacaacctccactgccattacccactaggcaagtacatcctgttttcagaatcagcccaatatcatctttcctagggaatcttgtcagactgcccttcattaccaacagacaaaataactaccttatctttggttctgtcttcactctagacctatgtagcatgctacttataacactgcattggtttgttggcatttgtattttccactgagcaaccataacttatgtgtagacaaaaattgtattgctcacctttggattactaggacctagcagtgttctgattcagagtatgtactcaataaattcatcttgaaaagtgaatgaatgaataaatgaacgcctgcatctccatcattgatttactatttaatcagtgaagtttttaaattatattcccccatatcttgagatttgatcttgtgttaaatcagttgcacatattagacattactttgtccttttcacttctccttagcacatatgggctatataatctttataaaggttaaagaaatatattgtaatatgttataacacaatcaagatacatctgaaacaacatagtgcaggcactatttccgatgttcaacatcatgctggagtaaaacttagagactcttggaaaaaagaaatacttaaataatgtcaccagtgtaatgtgctacattgtaatggtgttatgcttattacatgtgttatctagtaatgcacaaaaagcctaatggatttgctcatattttcctcatgtgcaaatgaaaacactgagtctcagagagattaaataaattgccaaatgtcatgtcaagcgattttgatcctggtatttctaatataaaagcccatgttttaatttattaactgtttgacatataacaataatagatcattacatgttaatataaataacctatgtatgaagactaattatatttttacttctgcattcaatcaactgcaacatgtcattttggttgatgtgtacagaaaatactcaacatctcgcagatattgggttggaaaacagaggacatttttatatctgtttcagataaatgtatatatttttctttgatagtacaccaaaatttgacaagtgactatttcttaaagggtagttgcagcatgaaatccaaaataacatcaataaacttttcattctctgttacactaaaattcattggttttatcttacacaaagtgtggatgattttgtaacatcatgtgttggtcatttagaaaacattattccactgggttatgcagattttctaaatgctgacacatttcattttataatttcaaaaatgaacatttattaatgtcaccaatatcatcaaaatgtttgaactactgggacgcatcaagttcattctggtagacacacatttttcaacatgtaactcttccttgaaaactcaaattttatcattgacaacaaatgcggtcagttgttttccttgaattatcaaactcactttgctcatttttgagaaaatatttgccaattatccaagtctgaatagacatggtttctttgtcaatgttcgttcttttaatggtgttttctgaagaaaagtgtagttcatttgcaactcactggcacaaatgcttttcttccagacaaccatcatagttgagtaagcagcagaagtgcctaatgcatactttccattttatcacgcagaatattagcagaacattttctcaagggttgagatttaataacacaaataattgtaactacttcatcaatgatatacttaagtgaaacaggcatgcaataaaatgtttttgaataaatgaataaactgccttgtattaggcccaccaaggtgaatttgaaggtatatatttgcctcatggaaacagaactaacacagtgtttcataaatgaaagttcacagatagatcacattaatttaactcagaatactttattgaaatgtagaactgaggccccattcccaaataatcggatttggtccatctagggtgaaaagagagacaatgcatattaaaatacgctccagataattttgaagaactgtcagttttggggactgcctgctaatgggactgtagttacagagtttctttgggcaatgatgaaaattctctcaaactttatcaaaggccaaaaaatgactggctaatattactaattagaattctactataatcccatagtacaagtttatagtttttaaatctcaagtgtgtcaaatgtatattcttgccaagcgtgctaccctccacgataacaaggagagactgcttccaaggacagggatcaagtgagtctctgagttaaatcctgtccttcctttcatattctccttgattaacttacaaaataattacattcttttaaagtgtgtcctcattaattacagtttttttgacataatttaaaagaattattttcttaaggtatgccaacagagggtaatagaggtgggctgggacatttattcttctctgatctttctctgatgcacccaaaggctatttaatgcacaactgccctctcattgcaacatcaaagcatgtaattcactatttaggttttactttcacagtagagaaattgtccagactaagcatattaaatcgtgttgcaaatgacttttttttgtgaggtaaaatataaataacacaaatttaccatttaaaaaatttttaagtatagagtccaatggcattaagtacatttatatcattgtgtaactatcataacaaatgacttttatataagtaagtcaatggaaaattcaagtatatcatatctacaaagtatcttcaattattaaagtaaaaccatagttttaataaaaaacattatcaaaagacttcatataaactaataatcctattgctaaattcctgacattgttatttataggactgtcttttaaaatatatttacatttgaattttttaataacccaaagattttcatccagatttcatattaaaaataaattcattgatccatcatgatacagattgcatataagtatattaaatgacagactttttatcctagtttcattttaaaaacaaactttcctatcaatcacgggcagatgttgataaggtaatagcagctgtggcagagaatacatttttattaaggaaaaatgacaatgtatgtctttaatgggtaagattattaatagctctttgcaagtatcagacagaagtttttatgagtattttaagcaaaagctttaataaccgataactcattcactgtgtttcttattggggtaccagctgctactgttccttctctcttcacaagaattcaaattccaaggctatgtgtacctgacaataccagacaggtcaaaacatagccaccaacttgactaagagaattaaccatttaaggcaaaatatcacgaggttttcccctctttccacatccttccttctttatgccctcttcttaagcattgctgtttcccatgtatccaacttcctactaaacccatataattggacaatacatctcaatacagttacaaaacccaactcattatttcctccccaaccttccccacaatgggtgggtgtttttgatctcagtgaaggtcaccacccctgaccagtctctctccccatgcagtgcctcagctccagaactagtttaccacaatggactctaatgagttttcctgtcactcaattctcttctctacactactagagttatctttctagtatttgaatctgattatgtttctcctttacttaaaaatccatcagtaagaaaacaaggagcagaaactttaaacattcctaaataccctcatactacttgcttcccactttccactacaccctccattcccattgttcccaataatcatccttctctccattcaaacagaattgactgaattctcccatggataaagcagttttctttttcttataacacgcttcacattgtctcttcttccattaaaagtaagctgaaacatcacttcccccataaagtgttctttgatcttaccccacctcacctctccagccatagccctaggccaatttaggcatcccctgtttgttcacctaaagctgtctctacacacctcttcccatcagagtacctcacaatcctagatttacttttatttcctctactagattgttgacttttgagagaaagggatgtcttactttcctctgaggtactagaaccaaacacagtattggctgcagtagcaagcaataaaagtttgttgaatggatgaatagctgaatgaatttaatcaactaaaatgtttagatttaaatatatagccaaccatactataacatgagaatccagaattattgtcccactattcaaaatgctcctctataaatccagtctactaaatgtttatgtttcattttggttaattcttagacaagagggtttagtgcactacagaaaccatctcattagattttcatatagttttatttttcctcatttatgtaatgtattacatatatatgtatactctagtgaaaatttttttgatcttgacttacacattcagttggtagacatttgtgtgggcatgaatataaacatgtctagtcacgagaatatcctgattcaaatagggaagcaaaagatgacacgctctcagacaggaagtgactgtcagcatcctttaaaaagaaacaacaggctgtggttcgtttatttccttgcttatttgtgacttgccctcagtgcctgatgatgcttggtacaaagaactgagtaaaactatcttttatattttctatttatatagcaatttacatttaaaagcactttcaagttaattctctcctttgaaacatttgttgatatgtcaattttagttaatattcctgaatatttgatgatttttaaaagaaaccaagttatagattcattttactgtatctaaaaattaaaattctattttggctcaattttgtaaaaatatctcaattatgtttcaactttgttttgaatttttaaaatggtctgtcagtccagtaatcccactgctgggtatatacccaaaagaaagaaaatcagtatactgaagagatatctgcacacctatgtttgttgcagtactgtttacaatagctaagtgtccatcaacagatcaatgggtaaagaaaatatggtacatatacacaatggagcactactcagccaaaaaaaagaatgaggtccagtcatttgcaacatgaatggaactggagatcattatgtgaagcaaaataagccaggcacagaaagacaaacattgcatgttctcacttatttgtgggatccaaaaatcaaagcaaatgaactcatgggcataagggtggttaccagaatatgggaagggtagtgggggtggggcagtgggggggaaaggtagggaaagttaatgagtacaaaaaatatataaataatgaataagacctactatttggtagcacaataaggtgactatagtcaatagtaacgtaattttacacttttaaaaaacttaaagactgtaattggattgtttttaactaaaaggataaatgcttgaggggatggatactccattcttcatgatgtgcttatttcacattgcacgcctgtatcaaaacatctcatgtatcccataaatacataaaccttctctgtacccacaaaaaataaaaataataaaaaaggtctgtc

SEQ ID NO: 1077 - DNA, 5209 bp, Homo sapiens
gtgaaagctctatttaactgctcccattgcttgatccagacacttctgacagtctgtttttacagacatggcaaaacaacacttggaagtcatttgagaaaatattcctggtatcacagagggagtgtcctctagctgagtgaagtcatttttccttgaatgactgacagaatggctttggttcacctgtaattcacagtttagctgatccagtgtactgtaaagtctgtttcactccaccagccaacaaggagcaggcggccgtggttttctcatgttctgggggaagctgtttgtcagtgttaacctggctaactttggacagctgcaacaacaacatctatcccttggcatatggtgtgtttagatgctaaacactgcctcatctcgaaggactctcgccatgttgcccagactcatctcaaactactggacccagacaatcctcacactttggcctcccaaaatgctgagattacagcttacctaaagttaacatctgatgacatgatcgcaactccatatcctgagttgatttcaacctatgatgttggaattttccacatggagataaacactgggaagcagctaatcattctctctggatttataaggaacaaatggataagtgaaacttgaaaacaatggccaaagtactaagaactaatgtttcttcaacaaaacaaatacttttactttaagaacagaagataaaaggccaaagttgtaatataagacaaattacggaaatatacacttatacatataaaaccactcctctttttaaaaaatcatgctttttaagaagaatcttctcatatcagtgagaaagaaagttatcttaacaaacaaaaagtattttgaaaaaaagcgttcacatgtataagaaagaaaatgaacaaataaataggaaaaaagatctctggttcaaccatatcaaagcttcttcatgtttgttattttactctaaaggacacctccctgatcttgaactgataatacagttaaaagaattaacagaaagagagagggatagaaatggtcacgtacagaatgaaaaataaaggaaatttttttcttattattttcctaatttgtcttaattcaaatgagcagaatagagtgctccaaatcagaactgtgactcactagaactaatatattttgtcaacatatttataattgaacatatcagtaatctttcatttgaacaattaattgtgtcagtaatcatttatctgcataatagttataattaatttgttacatttatttaattattcataatttattacaaaatgcaacatcaagaatcatctaataacaaaacttatttgacagtgtttgataaatatgtttatgaatgtcccactgagatatgttaaaaaccacattgatagcaaaattactttaaaatacatgctttatcattatggcaatagatgctgtttatgactcatcttgtttctattctgtacgacaaactctcagatcttcttttttcaaacttcgatttgatctctgagtttctgactttcccctctctctttcttacttatttttgaaaaaggacattttgacactaccaataatgataaaaaaaagagagacgaaaaagtgagattagcaggtaatttttaaagttaaagaatagttatatttaggcagggcacagtgcctcacgcctgtaatcccagcactttgggaggccaaggtgggcagatcacatgaggtcaggagtttgagaccagcatggccaacatggtgaaccatgtttctactaaaaatacaaaaattagcctgctgtggtggcacatgtctgtagtcccagctactgatgaggctaaggagggagaatcacttcaacccagggagcagagcttgcagtgagctgagatcgtgccactgcactccagccttggcgactgaatgagtctctgcctcaaaagaaaaaaaaacagtgatatttattcattattgccacaataggataaaatgatttaagtccatataaatctaagtaaacctgcaattgtttatatcctaaaaggacacacaaggaagtacgtttgaaattaatcatgtggctttcttcccaccccaaatactcccccactctccagattctttagagttcacttttcaaaaggattgaaaaaacatatatttcaaagtttttttttttaatttaaggaattgaaagagcagaaaatatatactaatcattcttcttaagccctgtgctctgtttcattttccaaaggcgtctactctcagtggtttgtttttgctctttttgtggttatggttataactaaatatggtaatcatttacctcgctttgttgctgcatttacctgctatgaagtatgaggaatttagtttacttgcacttctactttcaaaattattgtttatagcctcaatattagttctccttgaatgatgcatttgaactccctatttgtattgaaatagctactatcttctactctgaaagatgaataaattaatgcacttactttggacttctttccatctctgttcttgattgtcttttagttatataattgttttacactgtcaagaattataattcttatatttttgctgaaactatttttcatatctcaaattataagtattgagtatttgacttcaatttgtataatcaacttatgtacaaagcatggaaggattaatccactgtagaattcatggtgtcatgtgattgatgtcaaagaaaagagaaaatatgataccatgtcatttaaactttaccacttgaagaaaaatttcacaagtgcctgaatataataaattttattttaatatttttctagctttctttacttcttttgagtcatactcaggtgctggcattttggggacaacactttggtttgtttggggttatatattttatttttctgtagtctagcctagtctacttttatttatggtatatgggtagtttgctctctaagttcttgcatgctaacagatctttgatttttgctcatatctgattaattatttggatgaatagagaattctaggtataaatggttttctggagtctgtcttacagtatacttatgagaaatctggcctctcagttattttatttctccttcaatgatcttgtcctccacctcatgccaacttcccacttctatggtcttagacattgccatgaccaaccgtcccataatcatattctcagatattccattctctccatttagctatctataattatcatatatagatataaattatcatatatctccacaactttctagggcacacattataatattttcataaaatgccttattttcttttatgaatatgatgggaaatgctagatcaaggaataatgaacaaaacaaaggaatatagatgtttcatgtatttattcaacatttattgagtgctgaccaagtaacagacacaatgcagactctgagcctgtagaggtaaatgatcaacaacagcaataacaaatctcaggtctcaaatcctagtaaagaatttcacaatctagtacgtcaaaacattagtatgcttaacaactattgtattcatggtgcaaacagaaataggcctctacgctgaaaaataataaaaatatgagaaagatttttcaggatatatagcgttgttaagtttcttgaaaaagtttggggaaatattttgagaataagataaattacctattactagaattttaggtttatgttaaattttctttacaataagtaagggataaagtaagtaatactttagtggtttaacaatatgtccacatatttttggcatccttccctttaataattggagcctaatttcccttctcttgaaaataatctagaattagtgactagcttctaacaagaatgtggcagaagtgacagcatccgacttctgagactaggtcatagatgacattgctgatgccacgctcctctctcttgtattgtttgccctggggagagtcagccatctgctatgtcatgaggacactcaagcagcccgtggagaggctcacatggggataaagggaggcctcctgccaaaatccagccacaacgtggcaatcatgcgagtgagccacctctgaagtggaacctccagcccagtcaagccttcagatgactggcactcactttcctgactgcaacctcatgacagacccaaagccagaattgtccaactaatgtgttcccaaatgttttgacccacagaaactgtgagaacaatcaatttctattgttttaaagtcgcctaagttttggggtaatttgttatactgtgatgaacagctacatacaaatttaagtttattaaattagaagttgaaggagagaaatgaaagtcaaattctagtactcagtaaattctaaaagcttatgataccagttagtttttacatcataacataatcgcttcttttttttttttctgaacaaaattgctatggaaaaacccaactcaaaggttagtgaaagagaaatatagttttcatttaaaagggaaagtacaactttgctgtaggtcttagataaaaatagattgtataatctgaaaacctccccacaacttttttgtgagtttatattattttctccttttaaaagatggttaaactgctaactaaaaggaatttcagaagagaactgccataaaaaattttaacttcttatacaatggatagacttatttgctatttgtacaatatacatactatgaaatacaatggtttgcatgatttagaattgtgtaagtttttttgaaaataactgtggaggtataagtggaagcttgactccaaaatcagacttttcctaactcatcctctttcaactgagaaaactgcctatcggaactgggtgcatagggaaatatcagacagaatatggacaactgccaggacttgtggtttttttttaaaggacttgggcaatgaccatggttggtgtcataataaagcacatagatttttcttttaaaaaacatttgtaaaagggaatggattaaagaagttctttgatctcagaaatggcatatatctatgtaggttgttttttgttatattttcaattgactacctttcatacttgggattccctcaaagaaataaagttctctgaaaaagcttttgatactttattaaaaaatccatcgtctgggcgcggtagctcat

SEQ ID NO: 1078 - DNA, 5209 bp, Homo sapiens; identical to SEQ ID NO: 1077

SEQ ID NO: 1079 - DNA, 5209 bp, Homo sapiens; identical to SEQ ID NO: 1077

SEQ ID NO: 1080 - DNA, 4778 bp, Homo sapiens
tttcatgtgacagagccagagtctgagatctgcagttgcagaatatttagcttacctaaagttaacatctgatgacatgatcgcaactccatatcctgagttgatttcaacctatgatgttggaattttccacatggagataaacactgggaagcagctaatcattctctctggatttataaggaacaaatggataagtgaaacttgaaaacaatggccaaagtactaagaactaatgtttcttcaacaaaacaaatacttttactttaagaacagaagataaaaggccaaagttgtaatataagacaaattacggaaatatacacttatacatataaaaccactcctctttttaaaaaatcatgctttttaagaagaatcttctcatatcagtgagaaagaaagttatcttaacaaacaaaaagtattttgaaaaaaagcgttcacatgtataagaaagaaaatgaacaaataaataggaaaaaagatctctggttcaaccatatcaaagcttcttcatgtttgttattttactctaaaggacacctccctgatcttgaactgataatacagttaaaagaattaacagaaagagagagggatagaaatggtcacgtacagaatgaaaaataaaggaaatttttttcttattattttcctaatttgtcttaattcaaatgagcagaatagagtgctccaaatcagaactgtgactcactagaactaatatattttgtcaacatatttataattgaacatatcagtaatctttcatttgaacaattaattgtgtcagtaatcatttatctgcataatagttataattaatttgttacatttatttaattattcataatttattacaaaatgcaacatcaagaatcatctaataacaaaacttatttgacagtgtttgataaatatgtttatgaatgtcccactgagatatgttaaaaaccacattgatagcaaaattactttaaaatacatgctttatcattatggcaatagatgctgtttatgactcatcttgtttctattctgtacgacaaactctcagatcttcttttttcaaacttcgatttgatctctgagtttctgactttcccctctctctttcttacttatttttgaaaaaggacattttgacactaccaataatgataaaaaaaagagagacgaaaaagtgagattagcaggtaatttttaaagttaaagaatagttatatttaggcagggcacagtgcctcacgcctgtaatcccagcactttgggaggccaaggtgggcagatcacatgaggtcaggagtttgagaccagcatggccaacatggtgaaccatgtttctactaaaaatacaaaaattagcctgctgtggtggcacatgtctgtagtcccagctactgatgaggctaaggagggagaatcacttcaacccagggagcagagcttgcagtgagctgagatcgtgccactgcactccagccttggcgactgaatgagtctctgcctcaaaagaaaaaaaaacagtgatatttattcattattgccacaataggataaaatgatttaagtccatataaatctaagtaaacctgcaattgtttatatcctaaaaggacacacaaggaagtacgtttgaaattaatcatgtggctttcttcccaccccaaatactcccccactctccagattctttagagttcacttttcaaaaggattgaaaaaacatatatttcaaagtttttttttttaatttaaggaattgaaagagcagaaaatatatactaatcattcttcttaagccctgtgctctgtttcattttccaaaggcgtctactctcagtggtttgtttttgctctttttgtggttatggttataactaaatatggtaatcatttacctcgctttgttgctgcatttacctgctatgaagtatgaggaatttagtttacttgcacttctactttcaaaattattgtttatagcctcaatattagttctccttgaatgatgcatttgaactccctatttgtattgaaatagctactatcttctactctgaaagatgaataaattaatgcacttactttggacttctttccatctctgttcttgattgtcttttagttatataattgttttacactgtcaagaattataattcttatatttttgctgaaactatttttcatatctcaaattataagtattgagtatttgacttcaatttgtataatcaacttatgtacaaagcatggaaggattaatccactgtagaattcatggtgtcatgtgattgatgtcaaagaaaagagaaaatatgataccatgtcatttaaactttaccacttgaagaaaaatttcacaagtgcctgaatataataaattttattttaatatttttctagctttctttacttcttttgagtcatactcaggtgctggcattttggggacaacactttggtttgtttggggttatatattttatttttctgtagtctagcctagtctacttttatttatggtatatgggtagtttgctctctaagttcttgcatgctaacagatctttgatttttgctcatatctgattaattatttggatgaatagagaattctaggtataaatggttttctggagtctgtcttacagtatacttatgagaaatctggcctctcagttattttatttctccttcaatgatcttgtcctccacctcatgccaacttcccacttctatggtcttagacattgccatgaccaaccgtcccataatcatattctcagatattccattctctccatttagctatctataattatcatatatagatataaattatcatatatctccacaactttctagggcacacattataatattttcataaaatgccttattttcttttatgaatatgatgggaaatgctagatcaaggaataatgaacaaaacaaaggaatatagatgtttcatgtatttattcaacatttattgagtgctgaccaagtaacagacacaatgcagactctgagcctgtagaggtaaatgatcaacaacagcaataacaaatctcaggtctcaaatcctagtaaagaatttcacaatctagtacgtcaaaacattagtatgcttaacaactattgtattcatggtgcaaacagaaataggcctctacgctgaaaaataataaaaatatgagaaagatttttcaggatatatagcgttgttaagtttcttgaaaaagtttggggaaatattttgagaataagataaattacctattactagaattttaggtttatgttaaattttctttacaataagtaagggataaagtaagtaatactttagtggtttaacaatatgtccacatatttttggcatccttccctttaataattggagcctaatttcccttctcttgaaaataatctagaattagtgactagcttctaacaagaatgtggcagaagtgacagcatccgacttctgagactaggtcatagatgacattgctgatgccacgctcctctctcttgtattgtttgccctggggagagtcagccatctgctatgtcatgaggacactcaagcagcccgtggagaggctcacatggggataaagggaggcctcctgccaaaatccagccacaacgtggcaatcatgcgagtgagccacctctgaagtggaacctccagcccagtcaagccttcagatgactggcactcactttcctgactgcaacctcatgacagacccaaagccagaattgtccaactaatgtgttcccaaatgttttgacccacagaaactgtgagaacaatcaatttctattgttttaaagtcgcctaagttttggggtaatttgttatactgtgatgaacagctacatacaaatttaagtttattaaattagaagttgaaggagagaaatgaaagtcaaattctagtactcagtaaattctaaaagcttatgataccagttagtttttacatcataacataatcgcttcttttttttttttctgaacaaaattgctatggaaaaacccaactcaaaggttagtgaaagagaaatatagttttcatttaaaagggaaagtacaactttgctgtaggtcttagataaaaatagattgtataatctgaaaacctccccacaacttttttgtgagtttatattattttctccttttaaaagatggttaaactgctaactaaaaggaatttcagaagagaactgccataaaaaattttaacttcttatacaatggatagacttatttgctatttgtacaatatacatactatgaaatacaatggtttgcatgatttagaattgtgtaagtttttttgaaaataactgtggaggtataagtggaagcttgactccaaaatcagacttttcctaactcatcctctttcaactgagaaaactgcctatcggaactgggtgcatagggaaatatcagacagaatatggacaactgccaggacttgtggtttttttttaaaggacttgggcaatgaccatggttggtgtcataataaagcacatagatttttcttttaaaaaacatttgtaaaagggaatggattaaagaagttctttgatctcagaaatggcatatatctatgtaggttgttttttgttatattttcaattgactacctttcatacttgggattccctcaaagaaataaagttctctgaaaaagcttttgatactttattaaaaaatccatcgtctgggcgcggtagctcat

SEQ ID NO: 1081 - DNA, 4778 bp, Homo sapiens; identical to SEQ ID NO: 1080

SEQ ID NO: 1082 - DNA, 5016 bp, Homo sapiens
ttggaggaatccttaattcaaggagtgtcctctagctgagtgaagtcatttttccttgaatgactgacagaatggctttggttcacctgtaattcacagtttagctgatccagtgtactgtaaagtctgtttcactccaccagccaacaaggagcaggcggccgtggttttctcatgttctgggggaagctgtttgtcagtgttaacctggctaactttggacagctgcaacaacaacatctatcccttggcatatggtgtgtttagatgctaaacactgcctcatctcttacctaaagttaacatctgatgacatgatcgcaactccatatcctgagttgatttcaacctatgatgttggaattttccacatggagataaacactgggaagcagctaatcattctctctggatttataaggaacaaatggataagtgaaacttgaaaacaatggccaaagtactaagaactaatgtttcttcaacaaaacaaatacttttactttaagaacagaagataaaaggccaaagttgtaatataagacaaattacggaaatatacacttatacatataaaaccactcctctttttaaaaaatcatgctttttaagaagaatcttctcatatcagtgagaaagaaagttatcttaacaaacaaaaagtattttgaaaaaaagcgttcacatgtataagaaagaaaatgaacaaataaataggaaaaaagatctctggttcaaccatatcaaagcttcttcatgtttgttattttactctaaaggacacctccctgatcttgaactgataatacagttaaaagaattaacagaaagagagagggatagaaatggtcacgtacagaatgaaaaataaaggaaatttttttcttattattttcctaatttgtcttaattcaaatgagcagaatagagtgctccaaatcagaactgtgactcactagaactaatatattttgtcaacatatttataattgaacatatcagtaatctttcatttgaacaattaattgtgtcagtaatcatttatctgcataatagttataattaatttgttacatttatttaattattcataatttattacaaaatgcaacatcaagaatcatctaataacaaaacttatttgacagtgtttgataaatatgtttatgaatgtcccactgagatatgttaaaaaccacattgatagcaaaattactttaaaatacatgctttatcattatggcaatagatgctgtttatgactcatcttgtttctattctgtacgacaaactctcagatcttcttttttcaaacttcgatttgatctctgagtttctgactttcccctctctctttcttacttatttttgaaaaaggacattttgacactaccaataatgataaaaaaaagagagacgaaaaagtgagattagcaggtaatttttaaagttaaagaatagttatatttaggcagggcacagtgcctcacgcctgtaatcccagcactttgggaggccaaggtgggcagatcacatgaggtcaggagtttgagaccagcatggccaacatggtgaaccatgtttctactaaaaatacaaaaattagcctgctgtggtggcacatgtctgtagtcccagctactgatgaggctaaggagggagaatcacttcaacccagggagcagagcttgcagtgagctgagatcgtgccactgcactccagccttggcgactgaatgagtctctgcctcaaaagaaaaaaaaacagtgatatttattcattattgccacaataggataaaatgatttaagtccatataaatctaagtaaacctgcaattgtttatatcctaaaaggacacacaaggaagtacgtttgaaattaatcatgtggctttcttcccaccccaaatactcccccactctccagattctttagagttcacttttcaaaaggattgaaaaaacatatatttcaaagtttttttttttaatttaaggaattgaaagagcagaaaatatatactaatcattcttcttaagccctgtgctctgtttcattttccaaaggcgtctactctcagtggtttgtttttgctctttttgtggttatggttataactaaatatggtaatcatttacctcgctttgttgctgcatttacctgctatgaagtatgaggaatttagtttacttgcacttctactttcaaaattattgtttatagcctcaatattagttctccttgaatgatgcatttgaactccctatttgtattgaaatagctactatcttctactctgaaagatgaataaattaatgcacttactttggacttctttccatctctgttcttgattgtcttttagttatataattgttttacactgtcaagaattataattcttatatttttgctgaaactatttttcatatctcaaattataagtattgagtatttgacttcaatttgtataatcaacttatgtacaaagcatggaaggattaatccactgtagaattcatggtgtcatgtgattgatgtcaaagaaaagagaaaatatgataccatgtcatttaaactttaccacttgaagaaaaatttcacaagtgcctgaatataataaattttattttaatatttttctagctttctttacttcttttgagtcatactcaggtgctggcattttggggacaacactttggtttgtttggggttatatattttatttttctgtagtctagcctagtctacttttatttatggtatatgggtagtttgctctctaagttcttgcatgctaacagatctttgatttttgctcatatctgattaattatttggatgaatagagaattctaggtataaatggttttctggagtctgtcttacagtatacttatgagaaatctggcctctcagttattttatttctccttcaatgatcttgtcctccacctcatgccaacttcccacttctatggtcttagacattgccatgaccaaccgtcccataatcatattctcagatattccattctctccatttagctatctataattatcatatatagatataaattatcatatatctccacaactttctagggcacacattataatattttcataaaatgccttattttcttttatgaatatgatgggaaatgctagatcaaggaataatgaacaaaacaaaggaatatagatgtttcatgtatttattcaacatttattgagtgctgaccaagtaacagacacaatgcagactctgagcctgtagaggtaaatgatcaacaacagcaataacaaatctcaggtctcaaatcctagtaaagaatttcacaatctagtacgtcaaaacattagtatgcttaacaactattgtattcatggtgcaaacagaaataggcctctacgctgaaaaataataaaaatatgagaaagatttttcaggatatatagcgttgttaagtttcttgaaaaagtttggggaaatattttgagaataagataaattacctattactagaattttaggtttatgttaaattttctttacaataagtaagggataaagtaagtaatactttagtggtttaacaatatgtccacatatttttggcatccttccctttaataattggagcctaatttcccttctcttgaaaataatctagaattagtgactagcttctaacaagaatgtggcagaagtgacagcatccgacttctgagactaggtcatagatgacattgctgatgccacgctcctctctcttgtattgtttgccctggggagagtcagccatctgctatgtcatgaggacactcaagcagcccgtggagaggctcacatggggataaagggaggcctcctgccaaaatccagccacaacgtggcaatcatgcgagtgagccacctctgaagtggaacctccagcccagtcaagccttcagatgactggcactcactttcctgactgcaacctcatgacagacccaaagccagaattgtccaactaatgtgttcccaaatgttttgacccacagaaactgtgagaacaatcaatttctattgttttaaagtcgcctaagttttggggtaatttgttatactgtgatgaacagctacatacaaatttaagtttattaaattagaagttgaaggagagaaatgaaagtcaaattctagtactcagtaaattctaaaagcttatgataccagttagtttttacatcataacataatcgcttcttttttttttttctgaacaaaattgctatggaaaaacccaactcaaaggttagtgaaagagaaatatagttttcatttaaaagggaaagtacaactttgctgtaggtcttagataaaaatagattgtataatctgaaaacctccccacaacttttttgtgagtttatattattttctccttttaaaagatggttaaactgctaactaaaaggaatttcagaagagaactgccataaaaaattttaacttcttatacaatggatagacttatttgctatttgtacaatatacatactatgaaatacaatggtttgcatgatttagaattgtgtaagtttttttgaaaataactgtggaggtataagtggaagcttgactccaaaatcagacttttcctaactcatcctctttcaactgagaaaactgcctatcggaactgggtgcatagggaaatatcagacagaatatggacaactgccaggacttgtggtttttttttaaaggacttgggcaatgaccatggttggtgtcataataaagcacatagatttttcttttaaaaaacatttgtaaaagggaatggattaaagaagttctttgatctcagaaatggcatatatctatgtaggttgttttttgttatattttcaattgactacctttcatacttgggattccctcaaagaaataaagttctctgaaaaagcttttgatactttattaaaaaatccatcgtctgggcgcggtagctcat

SEQ ID NO: 1083 - DNA, 5016 bp, Homo sapiens; identical to SEQ ID NO: 1082

SEQ ID NO: 1084 - DNA, 5016 bp, Homo sapiens; identical to SEQ ID NO: 1082

SEQ ID NO: 1085 - DNA, 5016 bp, Homo sapiens; identical to SEQ ID NO: 1082

SEQ ID NO: 1086 - DNA, 1507 bp, Homo sapiens
ggactccagaccgtggaaaagcagatggctgccctcccttgcacagacctgctctgggtagcattgctgggactctgggaagtcatgagtacccacactctctccttccacggacctcagaagtatctgtgatagcttaactgttatgggctgaatcacatccccccacaattcgtatgttgaagtcttaactcccaggaccccggaatgtaacattatttggatacaggatctttacagatgtaatcaaattaaaaggaggtcaccagggtgggtcctcattcaatatgactggcatcctcataagattaggatacggacccacatagaggaacaaccctgtgaaaatgtgaggagaagatgctgtctacgagccaaggaaagagactgcagaagaaccagccctgccacaccttgatctcagacgtctagcctccaggacggtgaaagaagaaacatctgtttgtaagcagtccagtctgcagaactttctggcagccaggttgtgacagcctgtgaggacctcttggctcccggagccttctctctcctggaatagagatgacaccgtgctgccattgaactcaacccgaaaaaatgatctgttgcaaagctcacaggaaataatggagcaatgttacacgataaactgtaaagtgtggtgagcatgtgaacaagcgtccaggacccagcgaagccccaggctactgggctaggcgtcagatgagaagaggcagagggcaacctcctgtaggatctgaggccttcatgtgctcagcccatggctgtcgtcacggtgacgtgtgcatgcgatgtatctgggccatccttgttcttgaacgcgggcagtgagtcccacggtgatgtggcatgtcacgagctgaaggaggggcacctgcattcaggcttgcgaaccagcgagacagcctttggacctttcggagcctcactttcccacactaagaattggagtggaattcccaaggtgctggaggttgaaaggcattgagaatctaaaacgctttgcagacagcaagaccctctgtgtaagttaagaatgctcactcagtcccagcaggtactcagagggatccttttatttctccagaacattctgcaggtgagctggggaagcccactggccctggcctcacccccgagcccgagccttcagcctgggaatggtctggcctcttccttgctggctctccagcctggcctcgcaggaccctgggcgggaccccaggaaccctcacccgctatgtgcttccccaagaagcgctccctgtggcctaatttgagaaaacaatgggcctcaatccatattaatgaccctagagggaccctttgtcctcggtgcacaggctgtaatcagcggggctccgggggctctggcctaatttggagggacaggttttatcatcacccttgattcgggtgacccaatctgacaggcccacgaccccctgtatgcggggtccacgtcagagatgggcttcctcccagc

SEQ ID NO: 1087 - DNA, 1663 bp, Homo sapiens
gtttaaatcgcaaacatttatttctcacagttctggaggctggaactccacgaccaagtcactggcagattcaatggctgtttgcaggtggccgtcttcttgtggggtcctcgtgcgacagagagcagagacagagccggttctctgggcctcttcttatcaggccactaatttcatcacggggccgcaccctcaggactcaactacattccacaggtcccctctcctaatgccatcacattgggagttaaggcttcaacatatgtatttagggaggacgcacacatttggtccgtagcgagaattcagactcaagcccttgcctcaggctctaatgcacccaaacccagcagccacgcaccgcacaccctggagagcgtgcaggggacccctgggtgggtgaggacaggttttgggactcaggagctagtccctgggtttgtctcgtcagccttcgcccaccccttgacctcgaatgggcctcctgacccagaacatggggatcggggcctgggaaggttgagggaagcattaaatgaggtggccctttgtcatgtatctggcaccccataggcgctcaaatggtgcaacgaggatgccacggccctaacctgcaaacacgtttccacgacttcacgccggaggcagccaaaacgcttcccggctccccttccctggggccctcctggcagtccctggagccagccccttggctcctgcctggcccctcctaggcagccggcctgtcccagagtccccacccagccctggcaccggcaggcaacagacgcttgctggtgggtggtcgggagcacgtgcctggggagagctgcctccacaccattcactgatctaatcaatatcctgctcctcccgagaacccgatcacaggcccatccaagtgggggtctggctgtgaccccttcttcaccccgaacttcccccatggccaccacctcccccttccctctccccagcccgctggggtgggccgctgggaggaagcccatctctgacgtggaccccgcatacagggggtcgtgggcctgtcagattgggtcacccgaatcaagggtgatgataaaacctgtccctccaaattaggccagagcccccggagccccgctgattacagcctgtgcaccgaggacaaagggtccctctagggtcattaatatggattgaggcccattgttttctcaaattaggccacagggagcgcttcttggggaagcacatagcgggtgagggttcctggggtcccgcccagggtcctgcgaggccaggctggagagccagcaaggaagaggccagaccattcccaggctgaaggctcgggctcgggggtgaggccagggccagtgggcttccccagctcacctgcagaatgttctggagaaataaaaggatccctctgagtacctgctgggactgagtgagcattcttaacttacacagagggtcttgctgtctgcaaagcgttttagattctcaatgcctttcaacctccagcaccttgggaattccactccaattcttagtgtgggaaagtgaggctccgaaaggtccaaaggctgtctcgctggttcgcaagcctgaatgcaggtgcccctccttcagctcgtgacatgccacgtcaccgtgacgacagccatgggctgag

SEQ ID NO: 1088 - DNA, 1663 bp, Homo sapiens; identical to SEQ ID NO: 1087

SEQ ID NO: 1089 - DNA, 930 bp, Homo sapiens
gcggtttaaatcgcaaacatttatttctcacagttctggaggctggaactccacgaccaagtcactggcagattcaatggctgtttgcaggtggccgtcttcttgtggggtcctcgtgcgacagagagcagagacagagccggttctctgggcctcttcttatcaggccactaatttcatcacggggccgcaccctcaggactcaactacattccacaggtcccctctcctaatgccatcacattgggagttaaggcttcaacatatgtatttagggaggacgcacacatttggtccgtagcgagaattcagactcaagcccttgcctcaggctctaatgcacccaaacccagcagccacgcaccgcacaccctggagagcgtgcaggggacccctgggtgggtgaggacaggttttgggactcaggagctagtccctgggtttgtctcgtcagccttcgcccaccccttgacctcgaatgggcctcctgacccagaacatggggatcggggcctgggaaggttgagggaagcattaaatgaggtggccctttgtcatgtatctggcaccccataggcgctcaaatggtgcaacgaggatgccacggccctaacctgcaaacacgtttccacgacttcacgccggaggcagccaaaacgcttcccggctgaaggctcgggctcgggggtgaggccagggccagtgggcttccccagctcacctgcagaatgttctggagaaataaaaggatccctctgagtacctgctgggactgagtgagcattcttaacttacacagagggtcttgctgtctgcaaagcgttttagattctcaatgcctttcaacctccagcaccttgggaattccactccaattcttagtgtgggaaagtgaggctccgaaaggtccaaaggctgtctcgctggttc

SEQ ID NO: 1090 - DNA, 930 bp, Homo sapiens; identical to SEQ ID NO: 1089

SEQ ID NO: 1091 - DNA, 666 bp, Homo sapiens
atctcccacaacagcccatcctgaggcgcgcccccacctccttcccttccccctccattcaatccccggtttctgcaaagtggagcgggggtggggcggggtagcggaactcatgcgctgggcgtcagaaacccggcaggggaatggggtcccagattccgggcacgtgcacatgggtgaagaagctgttgaaaatacagctacaatctttttctgctctcctcccaactcatcttgcccctccctacctctgaacagtcgccttccaacacaagcaacaataaagtttagtctacggtcctcagagctgccggaagagaagaatcaatggatgataaaataactagacaatgatgggtaggagtgatggaagttcactgtaagctcctataaccccccatcaccatcaccacatgcctaatacaacctgcagacacacttactcgcaacagacctgcaatctgggctctcttttccttcttgatggaggcctcaaaacctcagcagttgtacccattaaactaaaatgctttttccctcttagtatttcttggtttcccgtgtgtactttacttccaaagagttgcaaatgcatttgcatccccatagttctgcagtcggtgaaccctggaattttgatggactcccacgggggtgctggatgcc

SEQ ID NO: 1092 - DNA, 2950 bp, Homo sapiens
aacagaacagggcagggagtttcacagtgttcttctatacaatgtctggaatctatgaataacatcagtttctaagttatgagttgatttttaactactgggtttaggccaggcaggcccagacctggtttcgggcctggcgtcaggctgcctgtctttggttttacttccttgttgttttttcttaaaacaggtactgagtataaaacaatataaaacagtacgagagggtctctctcttccctcatttacatctgtgtaaccactatcctaatcaacatatagaatattttatcaccttttaagttcctatgtgacttactgttgtcaatgtccttcttccattcccaatacctggaaactactgatctgatttttgtcaccatcgatcagatttgcttttttctaaaatttcgtatgtatacaattatatggtaggtattcttttgtgtctagcttatttctttcagaataatgctttaaaatttatccatattggtgaaagaatcagtactttatttcttttggttgctaagtactattcagttttatgacttgtgatattatgaagtatatattcaatctttgaccccttttcctgacatacgactcctaaaatacttagaaactctgaagcgatgtcttatctttgttaatgattgactgaacggatggctggcagcccctgggtaacttcaggatgggggatgggagagacaaaggcatgattagagagttgggactttcagctccatccccaatatctgggaaggggagagagtctgaaggttgactaccaatggccaatgatttaatcaattatgcctgtttaatgaatcttccataaaaacctaaaaggactaggttcagagagcttccagatagctgaacacatggaggttccttgagagcggtgtgccccaagacagtgaggacgctctgcacccctttcccccataccttgccctttgcatctcttcatccttatgctttgtaatatatgtatgcctttataataaactagtaaatgtaagtaagtgtttctctgagttctatgagatgttctagcaaattaattattaattgaactcaaatggggggtcatgggaatctcaatctggaaagaaaaataaaatctgaaaaccacaaagttattatgccaaggggaaaattaaggttggaaacggagtcacacaaaacactgccttccttctgttcccaaacaggtaactctaatttcacatgcttactctatcgtatgtaaaatgtagatttactgaggatgagatgaatgcttaattgattttttcctctactctctttttttcacacacaaaatgtggattcattgagtgttaatcaaagccttataagaatgtaaccacttgtctcattgcctactgtccctccttttttcccctttccctcctgcttgctcttacaccttaaatagttaagtttccaaaaccctctttggaaaaacacaggtcaaggatcctactgtgacttatgtttctatttcccaggcatatcctcgactggcaaaataaacctctaatcaatagagatctgcctcagtcactttttggtttacatgttggtgaccacgaagggactctgagtggagtctggctcttggcctccagcaggtctcctattggggccctggtaccggctggagctctttattactcttacagattggatgatttgctatgtaagttctgggaacttctccctccagagatccctgatctcccccaaattttcaattgggatctgaggtttattctgctgtaaaactccttttctggtagtttctgcttccatgatggcagacagcagtcttcagcttgggtccatctccagtgggatttggtagctgaagggcaaggtttattgtcagttggctataacttacccttatgctgagagatcgcaattatatgtgaattctgtgatcactttttctggtttttcttttcagttttggtccaccttctgttagactttaccaactcctggccccctctaatgttgaatgaaactctgcagctggagaaagtcaattttcacttctaaaaaccctggctggctttttgtttcctgtcttttttcatctgttgggggcacatgaggctttggggcctttgtgtgcatatggtcagctgagaagtaatatcatcaggaagacgggtgcttcaccatgcttctgcctgtaccagtgtacagaatataaagccttggaggaactgcagttgatgacagcatcttccccttctcggaggatcacggcttgaggactctgcactggttgttggcttctcacccctgatcagaaagacaatcgaatgagatgctcaatctcgtgaagggaagggtgattttctctcttccttccttatttaaaacattaagcatcaccacataattacggtacattttcctcacttcttaggtctggttcttaaaagggcccttcccaagacagaaagctattgtcattaagatgctgtcatatcacaacctctcccagactgaatcgtgtactcacaggtcaactgccacaacaaggtgcctgaaagcactttcaggagagtctccatccttggcctgccagaatatccagtcagcttctgaatgggcttccttaacaggagttgctttgaactcagaatgaggcctgttgcaattgcttccaggatattgcaactttgggggcaaccaatcagagacacatcacaacagtttaactgcagagaactaaatgcatctacctagaatactttttaaacagctctcccctgtggccagactgaggaatgttgattaaactgtggattttggcttttcttgagaaaccatcaagatccggaaaacaaaacaaaacttctccaattatctcccagccttgtagtgttccttgtagcttttcttactatattcaaac

SEQ ID NO: 1093 - DNA, 2950 bp, Homo sapiens; identical to SEQ ID NO: 1092

SEQ ID NO: 1094 - DNA, 1343 bp, Homo sapiens
tctaaatgacacagtctcctggacttgccagctgatgacaggatctgcagatacgtctcaggctctgctccaattctgagcaactctgggccacactgagtgagaaagagaatgataccacctacactgtatcgctttgtttcaaagaccaatagagttataatatatcaaagtatttgtaaagtacaaattaccatacaaatgccaaggactgctgtaataaacctaagcaaacttttccctgataatgaaatctggatagttttagaaaatatatgttgtttgtcaagacttgtgcaataggccatgtgtggtggctcacgcctgtaatcccagcactttcagagactcaggcaggaggatttcttgagctcaggagttcaacactagcctgggaacatactgagacctcatctccacaagaaatcaaaaaattagctgggtgtggtagtgcacaactgtagttccagctatatgggaggctgaggtggaaggattacttgagcccagaagattgaagctgcagtgagccttgaccatgccactgtactccatcctgggcaaaagagcgagaccctgtcttgaaaaaaaaaaaagaaaaaagaaaaaaagacacgtgcaatgatggctctgatgctttggttacgtggcattttgttcttctgcttctaattatgcttctaattgcaccaggtgtgggattcagtttctgtctcctcgagtctataaatctgactttaaataggtggaaaccaaaacctacagatgttactttagcaaatgctgtgtcatcactgtttactttgaaagagtggttcccaacctagggtaggcatcagacttaccttggaagcattttaaaaagtgagatttctaggctctagccctagggattccgattcagtgtatctggagtaggatgcagaaaagctctatttttttccaaaagctttctaggtaatctcaacaagcaatcagttcagttttggagacatattactttgccctcaatttcttctctattttagtagctgctagtttgtttgtttgttttcagtataaaaatttccccttgcattaatcagaagtacacttagaaaagatggcccatgattttggcatagatccacagagagctagtcattacacttctttacaataaaatttaaaaatggtaaattaacctcagagctaagacaatgcatgtagacgccgaagggtggctggttctgtgattacaggccaactgttttctgctttacttgtagtcaagtcactgataaacatgaagaccatattacagctgtcactaccgaataaaagatggcagaactcctccaaat

SEQ ID NO: 1095 - DNA, 1343 bp, Homo sapiens; identical to SEQ ID NO: 1094

SEQ ID NO: 1096 - DNA, 1343 bp, Homo sapiens; identical to SEQ ID NO: 1094

SEQ ID NO: 1097 - DNA, 12087 bp, Homo sapiens
ctcgcttggagataccaaggccggtcggaccccccgctggccgaatggagcgagcagatccagcctgtttggacgtggtgaggacccagccgtggggtttaaggccaagttagcctctcccttcactgattacaagagccattgttacaggtgctcacatgccaggagaaataagctggtgatttatgtggcacagcaccatcgatcgacctacaaaggaagcttcagtgcagccgtgttgctatacagacctctctcaccaaggcgtcatgaactgaagggctgggagaggcctcgtggaggaggaagagtttcgctcagctgcttgggtgtgggactgaatgtggttccagaactggtcgctgccttcacccgctgactctggtctcggcgatgacaagcccatggaacagacttacggcgtatgacctcatcggagacttgtacatggggccaacccccattttcccacaggaaacccacactctaattaagggctgaccctgaacttgaatctgagtcttctctttcttcaacagagagccatctctccagcccagctggcaaggagacaggtgatgttacaggaaaaaatacacagcttgtgcccttggaattaccagagttcaaagcctgttcagcatctacccaccatgtgacccgggtcgaattcttcagtttctctaagcccattttctcatctgtaagatggggaagtgtaatcagttctgaacccacatatacctcactgggcttgaacaggcctgagcaggcatgtggggctttactagctagccatcctttctgccgctctccctcattctccttcaagccccccaaagtccttggtggaggaggaagtggagacagaacgtttggtgttgggtgaggtacgtgaggaggctgatttcagaacctccaggaaacaaagctttagtgttccgagggcagtgcccgcctgtgcctcctcctcacagggggtagtaggagtggggtggggccgaggcatttcccagcacagctcaatcacatctcctgcgcctgcccttgtgacctgctcactggaaaggaagaaatgaccgagggagaagggagggcatttgaggggagaagaagaggatggagaaaaaaactggatcatctcgtgacatggaaagaaaggtctgagctctgacgatcccctcacgtgattataggcatgaggactcactcttcgaattgtttgaaaattgaatggactggctcacaccttctgaaatttcttggaagctctggagtaactattccactaaagaacagcgtgtttttggctgaaatctgtgactgtttgtttttgagttattttaatctctgtgtcaagcatgaaaacctcagcagcctgggatttataattagatcccactggcatgccctctcacctctcaaacatgccacagtgctttggctctctccttgtgcaaacctccctttgatatttttggatatcgataccaagtgtatctgcatattttaaccaactgatatgcatatcctgtgatctgaggcattcgctcaatgtggggcatcaggccagctgtgaacttcctttaaaatttattttgtgtcaaatgattccctaatgctatagctcccttgaactgctagatttatgaaaattctgcacaacacatagctcagagaaaaaaaaaaaagagtgttgcaagaccagatataggatatcatttgatttgtttaaaacactctgtccagggggttttgacttgctaatttaaaaataattctaaaattaggtacagttgacccttagtatccatgggggattggttccaggatgccctgtggataccagaatccaaggatgctcaagttcctgacataaatggcttagtgtttgcatataacctactcccctcttcctatatactttaaataatctctagattacttataatgcctaacacaacgcctgtgcatcacttcattcatgtggattcaatgtagtacttggtgtgaagaaaatttaagtcttgctttttggaactttgtggatttttttttctggaatgtttttgatctgcagttggttgaatccacaggtgcagaactatggacacagggggctgactatgtatatttatatccacttgcaaaattaagaataaaaataatgtgcatcagcaggtgcagattctgatgctcggtggacagtatgaagtcttccatttttaatgaagtctcaggcgatgctgctgttgcagtcctgtccaatagaatgttctgtgatggtggaaagattctctatcggctctatccaatacctaagccacacctttcacacatgggggagtgggatgggcaatggaagagcccaggcagggtagggagggggcagaaggaaggacagcagcacaggtaggcttactaagatccctaacatttatttagtgcctgtaatgggcaaggcagtgtgctgggtgctttacacctgttcagccacattcttacatcagcttgtgcagagcatttactcttcctggaacaatcctcggtgcagcgggtacaacaatgtaaaaagatccagtccttgctgctgggaaatttatagacacgttaactgaaactgtggagtaggatgaagtttctgagagaggagtctgcatttttaccctggcctttctatttcgtctgcaacattaagcaaggtgcttcattgctctcagtttcgatttctttgtttctaaaatagagttaatcatagtacctactgttggcttcttgggagattatatgatgagatacattgtaaaggttcaggacagtgtctggcacccagcaagctctctgaaaagaccagcacctatgatggtattggtcctacccgtgaagacaagtgtatgctggcaccaagaactctgatccaagtgccatagttaatttcaaaatacctaataagcctcaactatgtgcaatactttaaatggtggagacgggaggatcgtgacaaaggggaataaaatggaagacctcaagaaacttactttagaaagggactcagagtgcttggtggtttaatggagttctctcagttactggggatctgggaagtcttcatggaagaggtggtgtgtgagctgcccccaaaaagcagatagaggaagagtacaaaactccataagcagaggcaaagggccttctggatagaggaggctctggaagccacagtgaggactagaggaattgaggtctttttggaaatattaaatattccagttttcctggagcacaggacaggggttgttggggagcacaggagaaaagattgaaaaagtagattaaggttaggctgcagaaggcattgatgccaggctgttgagtttatatgtgaatttgtgggcaacgaggggcttctgaagttatttttcctccgcaattttcatttattttcacctgaaatgtaatatgctcattttaaatttaattgtaaatgtagaggtctatgaatagttaaaaactcttgaagaagacaaagtgagagaagttccaaataaggtgtaagaaatgaatgggctttgcctggcagctcacgcctgtaatcccagcactttgggaggccaaggtgggcagatcacctgaggtcaggagttccagaccagcctggccaacacagcaaaaccccatctctactaaaaatataaatattagccaggcacagtggcacacgtctgtagtcccagctactcgggaggctgaggcaggagaatcccttgagcctgggaggcagaggtttcagtgagccaagatcatggcactgcactccagcctgggggacagagcgagattctatcttaaaaaaaaaaaaaaagtattagaattaagacaccatgataatggtacagagttagaaaaactgaccagtggaacagaatagagagccatgaatctactcaaaaaaggagaaaatttgatacacgagagagggttgatattgcaattatttttatcaccatatatatgcatatttatattaaatacatatgtaacttttaaaataacatctcaattttagaatagatttacagagccattgcaaaaatagtacagagagttcccatatacccactgatatggtttggctgtgtccccacccaaatctcatcttgaactgtagctcccataattcccacgtgttgtgggagtgacccagtaggagataattgaatcatgggggtggtttcccccatactgtcctcctggtagtgaataagtctctgatggttttgtaaggggttttctcttccgcttggctctcattttttcttgctgccaccatgtaagacgtgaccttgctcctcctttgccttccaccatgattgtgaggcctccccagccacatggaactgtgagtccattaaacctccttttctttataaattacccagtcttgggtatgtctttatcagcagcgtgagaacaaactaatacaaccacactcaatttcccttattattacatcttacattaacatggcacatttgtaacaattatgaatcaatattggtacattactattgactaaagtcccacactttatcagatttccttagttttacctaatgtcccttttctggtccaggattccatccagaagaccacgttcagtcatcaagcctcagccttctctgagctgtgacagtttctcagactctcctgggttttggcgaacttgacagttttgagggttattgatgaggtgttttgtagaccatctctcagttggggtcactgtgtgcagccaacgcttaagaaatggggagttatactccacttcctggagggcagtgtatttacatacattttttgaaattcttctgcacagatttcttttcctctgtgtatttatttttccaatcacctaattatatcaatatgaactcatgaatttttttattactttggttataatctaataccactttacttaagttgttgttcaaatggttcccccactttggcgattaagagctctttcagttggtttctatgtccttctctcgtggccccaccattgtatggtgtgtatgcttgtgtgtcagtgtgttttagcactttcttactttctgacactacgaggtgctccaggctcatcttgcatatttcctgccccagtcctagaatcagctgtttctccaatgagctctggttccttctgttggacaatagtataaaaacaaacctaggtgctaaatgatcgcttagatccagtgctcattgctactgggctgccattgcttctggaccctcttagcagagagagaaaggagatatatgtgtgtgtatgctaatgcatgtacacatacaattcttatttttacctctatctagctatgtatgtatgtatgtttgtatctgtcatctctatgttatgctaaacatgggtttatacctctctggatgttttaggagcaaggaagagacatgattccagctttacctggggaaaatcaatctcacagcaatgagaagaaataaatgatgagttaaaattaatttctatatttttctaattattcaagtgactaatgtttggtgtgcagaaatttaagaagactgaggactagaatgaattataacgcaggagaaaacaataaccatgcatagtcagcaagaggcactgataccattttgagacgactggatgccctttcgtatgctaggaatatgcagcccgtgttctggaaagtggggagaaggtcaggcggctcctagcagcaaagctgcgttatcctcaatatcctgtaggggagggtttagggagttcggatatccctgcctttgacattcatcttggcctcagtttttctcttacctggaagcaagagaggagttgattgtgagttcagagtggaaatggtggccaatccagaccctgcactgccactgactctccgggaatgtcagcgccaggtgagagccaggattccagggccagacctgagcttgtccatagcctgggacttgaatggggggaaacttgggcacagtggcaggtggaaaatcaagtctgtgcttcaggggcatctaggaatgccctgtctatcttctcccctccccaaccccatttacccaggtgcctcctgttactttcaatactaatgccttctttttttttttttgagacagagtctcactctgttgctcaggctggagtgcagtgacgcaatctcggctcactgcaacctccgcctcccgggtccaagcgattctcatgcctcagcctcctgagtagttgggactacaggcatgcaccaccacgcccacctaattttttttgtattttcagtagagatggggttttgccatgttggccaggctggtctcgaactcctgacctcagtggtgggattacaggcatgagccaccacgcccaacctgatgccttctttttctgaccatttcctctccagcaatcccaccgtggccacaggaaaacctggcccaggagattccaatgttcttggcttcccctcctgtcacagcctcagtgattttgtgatttcatcttgcttctcagggcttgcttttatcaaaagggttggttagtcacaatggctgttaataggtgcaacaaggcatagaagacctgttaggggttgaacttttccccctacaactccaaaatattaatatattgcagtcctaatcttcaggacctccaagaatgtaaccttatttggaaatagggtcgttgcagatgtcattggttaatgatgaggtcgtactggatcagggtgggccccttatccaatatgactggcatccttgtagaaacaccacagtgtgaagagacagagattcacgcagagggaaaactatgtgaaaagatacacggagaagaccgtgtaaaaggtggaggatgaaggtaaggcagttgcaagccaaggaacgcctaagataaggaacgcctaagatagccaatgaccaccaggtctcagagaggcccgggacagattctccctcactgcccctagaagcaagcaaccccgctaaccccttgatttcggacctctggtctccagaagtggggcccagctgggataacctgactctagggccaccaaggtttgtcatcctgggcggcattcggggctggtgtgacccaccttatgcacaaaggccagaatagacctagcggcattgacaataggactggaatgccagctttgtctgtgaaggaagggcgcaagggaggacagctgtggtgggcaaaccctaaccatttccatccttgtttagcttttgttctgactacgacaggactacgtagtcgaactacgactcccaggaagccgttcggccttccccaccccctccccgcccaccccgctccgccccgtcccggcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagagaagatcaggttcaagttgccagccagactctgggcttccaggaggagtgggctgtggatggcctggcctcatttgcatgtccctctcctcccggccctgcaggtgccacctcctgagtcctggttcctgcggctccgtcgaatctgcagtgaaggcctttgggaagcgtgggttatgtgggtccaggggtcccatcctcccgtggaggcccttgacctgaggatcactaactcacaccccaccgacttccggcccccaacaagggcagtgttcctcttgctccattctgctctgaagtcccccaaaccgcttcctggggctgcttagtgaaatacaaggctcatctctgaggacctctacagggctggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgctgtgcttgtatgaccatttagtgaatttggtgtcttctaaatagaacagtggagtccttgtggacatctcagattcatcacaaaatgattgaggagaacctcttgaagatgtttagagctattgaaatttacagattgttgatgggttttcaccttttccttcctttcttgacacacagttacaggcattgtattccttggattcctacaggtgtcaaggaacagagatccacttacgttaccttcataaatcctggtttattcaaaagtcacagtaaggtagacaggaaatagtcccagccactgcctagctaagccttttcaaaaagcccaaggtcattcagcagatgcagaagcactagttggttttcaaagataacaagagcaataccatcatggtcgttttgatcctctgttcagcagcagggttcgctgcccctgactttagaattctgccatcgtgatgagctgaaggtcaccaacggtcccagtttgcccaggactaaagggtttcttgggatgaaggacattcagtgctaaacctgggacagtcctgggcaaactgggaaaactggtcaccctcctgggtgactcaacgaccatgcctctactttgttacttactattaactgactgatgctgttgactggtttagccaatctgcattcagagcttttgcgtctggttacttcgttggccttcaggcagccacagatggatgctattggatcaggcaccaatgctgaccaaatcaattgtttccaggatggtagggttgtatgaagaaccaactgagaccatgtccttctgagtgttgtggatggtgggcatggcaggccttcaaggtatcagggattcctctccaatacagccttacttacaaaggagaaactaactttctcatgaaaaacaaaacagttcattaagaaacaaaactaacacagccactgggaactgaggaagagagactgtaacatgtgtgcaagcacacacacacacacacacatgcatacacatgctgtctgtagaatcatgagccaggattccaaatctgcatctttgctagacagagatcaagaactaaaacctttgggatggtgttgtctgggaagcaaaggagttggctagaggacttcctgaaattcctttaaactctagaatcctttaaaatatcaagggtgtgtaaactggggctaagtatgtacattctctctaaaggctcctagataacctttgagttcaattcagtgtggagtggggcctcccagcttatacttacctttctagacactgacttttatctgggatgagggagcagaatttggaggtggtagtcagggcgggggtagggaggggagtgggtaagggatagttgcaccagcccaacttttttggtcttaagaacaacctgaacgcaaattacagggtcttttgtggactagaaaaagccaggttttcaggatcacgtggcgtcctgaagttgttgctgcttgtcagggcatctgacctccatcttctctgctgaaagacaggcatgagtgtttgcagtgccggaacaggggccttcagataatttcattcatctggcatggcaagaccacagggagggaattacatgctagggtagagatgaacttatggacgtatcatgcaccttggtgtttgcccctgtagtgattctcactaccttcgctaccattggagggatgctcacccacctccttgggtgccatttttcttttttaaaagatgaaggcatttcagatgatcccttcatttatgttctactttcattctttggtttcaaaagaagtcctgatcttatgtcaaaggcaacaatctcttctctcaatctctctctctctctcactctctctctctggctcactctgtcacccaggttggagtacagtggcatgatctcagctcactgcagcctcgacttcctgggctcaagaaatcctcctgtctctgccttccgagtagctgtgatcacagttgtatgccatcatgcccag

SEQ ID NO: 1098 - DNA, 955 bp, Homo sapiens
ataaggagtgcctctgggttggtgaacacatcagatgctgggcaggtggtgtgttgcctccctccataccatgcatctcttccctttggctgatcctgaggtgtatcccttagaaataagctggtaaatgagtctactgctaagatttcagcatgtcctgtggctgagttaatcagagttatgacaggaaggtaccgggcacaccatcgcaatgctccatcaatgctagtatgttgtgttctttccttcatatcaagtcaactcaagcttgctctacttacctggtgtacacagtctaagaactgtaagaagactggagcaaaaccactcccctgacagttgagggtcaagctgctcctctgactgaatttgtgaccaaaagagagccactctttttcaaccaacatctggaagccttcaagtgtcctataaaagggatcactgagtaactgaaccagggatgtcacctagggcataagcaggatggattgtcattaattttagttctgaaaaaggcctattactaagataaaagcacttccttctgatgatagctaattcacaaatttacctggacagcaaatttgttcactaaccattccaggatggccaataaaattaattttgtaaacttgccagtaaaaactaaagctcaaattcattttggctacaagtttactttcagggaattgagactttaatccttaactggccagtttgctgacagcaaccttttcctaagttaatcagaggccagaggatcagttaaaatcaattctactttttggcagatgcagattaatgtcttaatgtagtctgaactcacacttttcactctggagtgagttaaggcggggcttatagagagccaggggatggactgacaaaacccaggaaggatggtccacgcctcacactgctggtcaagggctccatccgcaagcctgcatggtac

SEQ ID NO: 1099 - DNA, 1210 bp, Homo sapiens
ataaggagtgcctctgggttggtgaacacatcagatgctgggcaggtggtgtgttgcctccctccataccatgcatctcttccctttggctgatcctgaggtgtatcccttagaaataagctggtaaatagcacggaccatggaagcatcttttggcagcaccagagaactgagcatctcaaagcatgagttcttctgtttcttctgcgtgggttgaccatgggcatcaggcatcagagatacaactctggatcttgtccatccattgctgggcactctgtccatcctgggcgcagaagttatacacacgtttgctggtcttgagctacaaaaccaaatgacagtgaaccagagatgaagggcagggctgttttatggatttgggagtctactgctaagatttcagcatgtcctgtggctgagttaatcagagttatgacaggaaggtaccgggcacaccatcgcaatgctccatcaatgctagtatgttgtgttctttccttcatatcaagtcaactcaagcttgctctacttacctggtgtacacagtctaagaactgtaagaagactggagcaaaaccactcccctgacagttgagggtcaagctgctcctctgactgaatttgtgaccaaaagagagccactctttttcaaccaacatctggaagccttcaagtgtcctataaaagggatcactgagtaactgaaccagggatgtcacctagggcataagcaggatggattgtcattaattttagttctgaaaaaggcctattactaagataaaagcacttccttctgatgatagctaattcacaaatttacctggacagcaaatttgttcactaaccattccaggatggccaataaaattaattttgtaaacttgccagtaaaaactaaagctcaaattcattttggctacaagtttactttcagggaattgagactttaatccttaactggccagtttgctgacagcaaccttttcctaagttaatcagaggccagaggatcagttaaaatcaattctactttttggcagatgcagattaatgtcttaatgtagtctgaactcacacttttcactctggagtgagttaaggcggggcttatagagagccaggggatggactgacaaaacccaggaaggatggtccacgcctcacactgctggtcaagggctccatccgcaagcctgcatggtac

SEQ ID NO: 1100 - DNA, 1216 bp, Homo sapiens
gggggttccctgagctggtggagcggcgtggcgtggcctaggaagtccctgggcgagggaggcggggcgcggcgtggtgggggcgactgggtggtgcaggcctgcgcacgcgcgcagccgtgggcgggacgggcggcctgggggcttcgccgccaggtggcaggcgtgcgccacgcccgcaggttccagccccgacccgggcgcgcggggccgactagggtcgggtccagtgtgcggtggtcgctccgctccgggccgctccgctctgggcgtcagggcgcggggagctgccccggggttctgtccaccggggaggaaagccacgagcactgagcgcctcctgagagccagccctgacgtgaactcattttatctgccacgacccagaaggagtctactgctaagatttcagcatgtcctgtggctgagttaatcagagttatgacaggaaggtaccgggcacaccatcgcaatgctccatcaatgctagtatgttgtgttctttccttcatatcaagtcaactcaagcttgctctacttacctggtgtacacagtctaagaactgtaagaagactggagcaaaaccactcccctgacagttgagggtcaagctgctcctctgactgaatttgtgaccaaaagagagccactctttttcaaccaacatctggaagccttcaagtgtcctataaaagggatcactgagtaactgaaccagggatgtcacctagggcataagcaggatggattgtcattaattttagttctgaaaaaggcctattactaagataaaagcacttccttctgatgatagctaattcacaaatttacctggacagcaaatttgttcactaaccattccaggatggccaataaaattaattttgtaaacttgccagtaaaaactaaagctcaaattcattttggctacaagtttactttcagggaattgagactttaatccttaactggccagtttgctgacagcaaccttttcctaagttaatcagaggccagaggatcagttaaaatcaattctactttttggcagatgcagattaatgtcttaatgtagtctgaactcacacttttcactctggagtgagttaaggcggggcttatagagagccaggggatggactgacaaaacccaggaaggatggtccacgcctcacactgctggtcaagggctccatccgcaagcctgcatggtac

SEQ ID NO: 1101 - DNA, 1216 bp, Homo sapiens; identical to SEQ ID NO: 1100

SEQ ID NO: 1102 - DNA, 1216 bp, Homo sapiens; identical to SEQ ID NO: 1100

SEQ ID NO: 1103 - DNA, 522 bp, Homo sapiens
aaggattcaaagtcatcttcagcaattaaaatggttatatatacaaaatttctttttttttttttttttttttttttgcatgtgttttaacaatcccccaccctccagagccctaggtctatatccgtatgaaatgcattgatcggtaaccttatgagttagtgttatgaaagccattaaaaagtagacctggttgagttaattattagcactttgacccctaaaaaatgttcctggttacagaaaagtcctccattcaggcctttcttgtaagtgaagaaaaaggaatgcagcaaagaagagttctaattttgtgtcaggagataaagagggaggctcagttatgtgaaggtattcctcacttgatggtttgaaagtcgcttcaatatttacatgaatttccttaaaagaatcctgtggggacattacagatgagccgacgtctattcctggcagagcactgggctgggggatctctgtgtgtccagaggcttcactgcctgagtagatagtgaggggaga

SEQ ID NO: 1104 - DNA, 522 bp, Homo sapiens; identical to SEQ ID NO: 1103

SEQ ID NO: 1105 - DNA, 522 bp, Homo sapiens; identical to SEQ ID NO: 1103

SEQ ID NO: 1106 - DNA, 522 bp, Homo sapiens; identical to SEQ ID NO: 1103

SEQ ID NO: 1107 - DNA, 1059 bp, Homo sapiens
gggcggggcctggagggaccaatcagcgggcgaggctgtggccgagccgcgattggtccgccccgcgggttccaacctgcaccgcccgctcggtcctttgagccactgcatcccctagcggcgcccgggtggctgcagccgctggcccgaaaatgctgctcgggcgagcaggggtcaggcgggaaaagaagactccaaatccactctctgctcgcccccagggcaatgctgccaggagagggagtgggttcccccgcaggctatcccaccgatggggctgagagcttaatttggggttttatttgaattggagacattgttccctcttcgctcctctaccccataaaattccctacaaatgcaaaaattcgagatagaagaagccgtccctgaaattgctgtctaacattcaccggaaacctctccataaacaaggagaaacgaatgcacacgcatttttgctaagaagcccgggattaagatttaaggatacaagctgaaagaaaaaatgaaaaatgcttctccgcgcgtcaatcgaggggtggatgcgccacgcagcgtgagcccagctcacagccacgcgtaagaccaaaagctgccatgggttctgcgcgcggagacctcagagccgaagagagaagtccccgcgtcagaaacgctgcggatgccaggtcttgaaaatgctgacttctgaggctaagaattatttcaaagacaaaaagaaaagactggtgaggaggccttccggtgcaagggcgcctatccgctaattttggatggggaagtagggattattcgtttaaattcaatcgcgagcaccaagtcggactggccggggatggagaagggcaacccccacctttagaaaaataaaagatctcgaaggcccttcttggtctgggtggtttgaggctggcagagaggggtggggggcctggggctggatgtcccgggtaatggagccagccggtagggggtatttagcatttaattcccagccggcccgccccagttcccggactgacagtgggtaattgggagagaggacgttgctctttt

SEQ ID NO: 1108 - DNA, 1059 bp, Homo sapiens; identical to SEQ ID NO: 1107

SEQ ID NO: 1109 - DNA, 1059 bp, Homo sapiens; identical to SEQ ID NO: 1107

SEQ ID NO: 1110 - DNA, 1059 bp, Homo sapiens; identical to SEQ ID NO: 1107

SEQ ID NO: 1111 - DNA, 4620 bp, Homo sapiens
agggagcgaggctggagaggctgcggcgcgtggcctgaggcggagagccgggctgcgggggtccgggccaggccaggcgccggcctgacccgcctcgccggcaagagcaggccgggcttcctcctcccttggcgggcgggggagggaaagggggatcctggccgggggtaagggggaaaggtggtcctgattctccctgtgccaccgccacaaagctgatcctggcctcctgcggagaagcctgagcgccttcccgcagacctgacgcgaccccctcccaggtacctgggcctcggcctggtctagcgagtccccttcctcccaaggagcagccggcggagctcgggtggaggaaagcgaggaggcgaccaggaggatgccgccgccgccgccgcagggcccggggcttctgcagggcgcaaggcctccctcaccagggtaaggggctggcgatcaacctggacgcctgggaccttgggagcaagcatcccgcagccgagcaggcgacggcgcggccaccgcctagagaggagccggggcccggggcggcgtgcgggtcggcagcagccggcttggcctatccgaaaccccaggcctggaagcggctgctttaggcgtcaagttgagcggggtatgtgtgtcctcttgggaaaaaggtgagaaatggagccggactttctccactcggtaggggttaagctaccacacacacccccaaacacatgcccacgtgcaagtccctcccacccgccctcccaggggcgaagagaccctgtcccagtggaagtggggaaacccagtcgggtacagaaagcagaggccatggcgcagagcggaggcgcggctttctggggctcagccctagggctacagacccagggcgcggagatgctcgcggccgggccacccaccagagccaggcaaccggcgcttccaggcgagctccgcggggccgaggtgccgggagaagcggccccgggcgcccgcgcgctgcccgacctgggtaacaggcaaagcggagccccggggtcgaagtcctaaagttactaatcccgcggagggggagagagcgtgcctcgggccgcccggggcggtcatttgagcgtgtttacttaaagactttgcaagcagagcgcgcgcgaaatcgtcggatttccagcgaggcagcaaatatttgcaggcagaagaaagaagcggagccgagccgagccgccgagtccctccccccggagccccggagccccggcgcctgcctgggcggtcccggccgcgcagacagaaaagaagccgggaatctgcggggctggggggcggggagcgacaccaaaggccagaaactgcagcacggcccgaggccctggcgagctgggcctgggggaggagaagtcccttcccattccagctcgatcaatcttgctgggctgcgatcggtcaataaaaacggtgtgaagcggccgctgtcgctgtgagtctggggaggaagtggaggccaaaggtgtcgaggccggcgccagtaccccgcaccagccgggtccgcggccccgcggtctgcacgtcgcaggccgggggccagagctttgccggcagccgagagcggcccggcggggcctttaattgggtgtctccattttaatagaggccattgttggagcaattagagaaagacaataaccgcccagagacgtttaattcgattccctgcgcccgccgcagtacgcaccggggcgctctggaagagtggccgaggctgcgcggaagggagggtccgcttggggaggcgccggcttctttccttgcttgctttgccttcggtgtgggaattgtaaagggcgactggggcaagatgaaagcggggcgagggcgacctgagccaggccagggccggcctctctagcccacgccgggcgcccgcgggaccgccgcgcctttcgcggcgcgcgtccagctgtggccgccgcggaggtccccagcgcctgttcaaaggagagaagccggaggaccgggccgtgaaaactggcctccttcctccttagccccgggtccccatttctgtcacccgaaccatgtccatatttccttccctatggtgggaggaggggcaaaggagagatcccgggtattggagcgcgcacacctccgtctccaacccagccagcctcaccgccccctcctccgcctcggcccctggattaggttaccctggccgcgcaagggtttctactggataggactatagcacaggtaaagctgtataaacagctcgccggctgccgggcgggagggttatgccggggacacggctccaggcgccgccgctggccccggctgcgcgggccacaccgcggggagcccgctgcggcagggcgccccggaccgcgcaggttaaatacatattatctctgtctctgccactcgggcccccgttttctttcccttgcgagctgaaatgcggagagcggggagcaagacctaaacgggaagaaaaggcagtcgggcagtgggcaatactggttgaggatcccggcccagcaaggctggctctcttcaaacaaaacccagagagcagggaacttgggggaaagcagagaaagagggaccctaaaactcactggcaatgggaagatgatggaggcgggtgcgtccaaggggcaactctcctcgcggctcccacgcccacgcgccccgggccaggagtctaccttccccgtgaaatgagctatcgttttggggatggtatgtgatttgatttacccttttttcttttccttcctttagttcttttttctttttcttttttctttttttttctgtttgtttgtttgttttgcttattcatcgatcaccgtttaaaactcggaaggaaacccgcccaggccaggagagccgcgagccgtggggagagtcaaaaaagaggagatgcgctgggagattccccccgcccccgcactccgcccccagcccggccccggcctccacttcgagggatcctgaccctcccaccgccactaccaccttttccccggttgagaaaacccctgattgtagcgagataaaaattgggtaggtaggggtgcagcggaaagggggagacaggaagggagagggcaggggatttctgctttcgggtttaacaactcacacgtgaggcgagtggcagttggggggagccccgggttgggtgggagagaaggaactcgccttgagggtgagtggaaaggaattggagtcaccctggaggaaaagtgcccttttcagctctctccctccctcctggccttggcaggtggggggacaggtgggtgccacgggaggaaaagaaggggtggaggcagcccagccggcgtccctgggtctcccgggctttggacatcttaccctgcccccagtggcatcagtgactcctagccaggggcttgctacttctagacccgacctctcctccgtcccagggggccgctcagccacaccgctatagcacccaggactccggcccctgcaccaaggaaaggctccagcctggcagaaattcacccatttcaaggcttggcccaccaggccttagcattgccgggtgaggtggggtgcacgcggtgttcagtctggccagtcggagtcacctgctccactcccccggcctggtcacccacatcctcacagccacccagctcctgagccccctggccaaccacagccccaacccccagcgctggcctcagccgagtctcctccgtctgcttcagtttggccttttaggaggagaaggagggctttatctggggactattgtgttttgactcatctagattagcctaggagctggagtgtgattgtagcgggacactctggcaggggatgtgttcacagcacggataggaaaagagggggagggggactccattcagatcttggagacagtagaggcgcgcttttaaaagcacaaaccgttcttgtcttcctttggacatgctagagaccacctggtgaaaaaaaaaatccatgtttgtgcccgactcagaggtgcaaaggaggaggtttggcatgcgcacccttctcccggcctcccttggtcccggactgccccctacccgcagcccctccctccgggcagctcagctctaggctgccttccacctcgcggaccctaagcaatttgttatataaaacaaaacagcaaccagacgcatgtgcctgttcttcactaacgccagcagaccggcagcgacggatacccggtggacctcagccgggacgcctcgggcagcagcttcttgcccgctgccgcacccacctctgcaccccagctcgggtcagcccagcagccaaagcaaaagggggattcctcagtttgctcccttggaggctacaaagcctctctctggttattccaaccgttaagtaaaaaagaggtgatgggaaagatttggtctgcacacaaagatataccaggagaagaatgcacatttatgtgtaaaatggcttaggcaccaagaatgagacatcacttcagtgcagcctagaaatagttaaaaataaccgaatgctagaggacagaggtggttttgggatctgccccacactccttatcaggatccctaattccctgccacctcctatggttcc

SEQ ID NO: 1112 - DNA, 4620 bp, Homo sapiens; identical to SEQ ID NO: 1111

SEQ ID NO: 1113 - DNA, 4613 bp, Homo sapiens
cagcgggcgaggctgtggccgagccgcgattggtccgccccgcgggttccaacctgcaccgcccgctcggtcctttgagccactgcatcccctagcggcgcccgggtggctgcagccgctggcccgaaaatgctgctcgggcgagcaggggtcaggcgggaaaagaagactccaaatccactctctgctcgcccccagggcaatgctgccaggagagggagtgggttcccccgcaggctatcccaccgatggggctgagagcttaatttggggttttatttgaattggagacattgttccctcttcgctcctctaccccataaaattccctacaaatgcaaaaattcgagatagaagaagccgtccctgaaattgctgtctaacattcaccggaaacctctccataaacaaggagaaacgaatgcacacgcatttttgctaagaagcccgggattaagatttaaggatacaagctgaaagaaaaaatgaaaaatgcttctccgcgcgtcaatcgaggggtggatgcgccacgcagcgtgagcccagctcacagccacgcgtaagaccaaaagctgccatgggttctgcgcgcggagacctcagagccgaagagagaagtccccgcgtcagaaacgctgcggatgccaggtcttgaaaatgctgacttctgaggctaagaattatttcaaagacaaaaagaaaagactggagcagccggcggagctcgggtggaggaaagcgaggaggcgaccaggaggatgccgccgccgccgccgcagggcccggggcttctgcagggcgcaaggcctccctcaccagggtaaggggctggcgatcaacctggacgcctgggaccttgggagcaagcatcccgcagccgagcaggcgacggcgcggccaccgcctagagaggagccggggcccggggcggcgtgcgggtcggcagcagccggcttggcctatccgaaaccccaggcctggaagcggctgctttaggcgtcaagttgagcggggtatgtgtgtcctcttgggaaaaaggtgagaaatggagccggactttctccactcggtaggggttaagctaccacacacacccccaaacacatgcccacgtgcaagtccctcccacccgccctcccaggggcgaagagaccctgtcccagtggaagtggggaaacccagtcgggtacagaaagcagaggccatggcgcagagcggaggcgcggctttctggggctcagccctagggctacagacccagggcgcggagatgctcgcggccgggccacccaccagagccaggcaaccggcgcttccaggcgagctccgcggggccgaggtgccgggagaagcggccccgggcgcccgcgcgctgcccgacctgggtaacaggcaaagcggagccccggggtcgaagtcctaaagttactaatcccgcggagggggagagagcgtgcctcgggccgcccggggcggtcatttgagcgtgtttacttaaagactttgcaagcagagcgcgcgcgaaatcgtcggatttccagcgaggcagcaaatatttgcaggcagaagaaagaagcggagccgagccgagccgccgagtccctccccccggagccccggagccccggcgcctgcctgggcggtcccggccgcgcagacagaaaagaagccgggaatctgcggggctggggggcggggagcgacaccaaaggccagaaactgcagcacggcccgaggccctggcgagctgggcctgggggaggagaagtcccttcccattccagctcgatcaatcttgctgggctgcgatcggtcaataaaaacggtgtgaagcggccgctgtcgctgtgagtctggggaggaagtggaggccaaaggtgtcgaggccggcgccagtaccccgcaccagccgggtccgcggccccgcggtctgcacgtcgcaggccgggggccagagctttgccggcagccgagagcggcccggcggggcctttaattgggtgtctccattttaatagaggccattgttggagcaattagagaaagacaataaccgcccagagacgtttaattcgattccctgcgcccgccgcagtacgcaccggggcgctctggaagagtggccgaggctgcgcggaagggagggtccgcttggggaggcgccggcttctttccttgcttgctttgccttcggtgtgggaattgtaaagggcgactggggcaagatgaaagcggggcgagggcgacctgagccaggccagggccggcctctctagcccacgccgggcgcccgcgggaccgccgcgcctttcgcggcgcgcgtccagctgtggccgccgcggaggtccccagcgcctgttcaaaggagagaagccggaggaccgggccgtgaaaactggcctccttcctccttagccccgggtccccatttctgtcacccgaaccatgtccatatttccttccctatggtgggaggaggggcaaaggagagatcccgggtattggagcgcgcacacctccgtctccaacccagccagcctcaccgccccctcctccgcctcggcccctggattaggttaccctggccgcgcaagggtttctactggataggactatagcacaggtaaagctgtataaacagctcgccggctgccgggcgggagggttatgccggggacacggctccaggcgccgccgctggccccggctgcgcgggccacaccgcggggagcccgctgcggcagggcgccccggaccgcgcaggttaaatacatattatctctgtctctgccactcgggcccccgttttctttcccttgcgagctgaaatgcggagagcggggagcaagacctaaacgggaagaaaaggcagtcgggcagtgggcaatactggttgaggatcccggcccagcaaggctggctctcttcaaacaaaacccagagagcagggaacttgggggaaagcagagaaagagggaccctaaaactcactggcaatgggaagatgatggaggcgggtgcgtccaaggggcaactctcctcgcggctcccacgcccacgcgccccgggccaggagtctaccttccccgtgaaatgagctatcgttttggggatggtatgtgatttgatttacccttttttcttttccttcctttagttcttttttctttttcttttttctttttttttctgtttgtttgtttgttttgcttattcatcgatcaccgtttaaaactcggaaggaaacccgcccaggccaggagagccgcgagccgtggggagagtcaaaaaagaggagatgcgctgggagattccccccgcccccgcactccgcccccagcccggccccggcctccacttcgagggatcctgaccctcccaccgccactaccaccttttccccggttgagaaaacccctgattgtagcgagataaaaattggggggccgctcagccacaccgctatagcacccaggactccggcccctgcaccaaggaaaggctccagcctggcagaaattcacccatttcaaggcttggcccaccaggccttagcattgccgggtgaggtggggtgcacgcggtgttcagtctggccagtcggagtcacctgctccactcccccggcctggtcacccacatcctcacagccacccagctcctgagccccctggccaaccacagccccaacccccagcgctggcctcagccgagtctcctccgtctgcttcagtttggccttttaggaggagaaggagggctttatctggggactattgtgttttgactcatctagattagcctaggagctggagtgtgattgtagcgggacactctggcaggggatgtgttcacagcacggataggaaaagagggggagggggactccattcagatcttggagacagtagaggcgcgcttttaaaagcacaaaccgttcttgtcttcctttggacatgctagagaccacctggtgaaaaaaaaaatccatgtttgtgcccgactcagaggtgcaaaggaggaggtttggcatgcgcacccttctcccggcctcccttggtcccggactgccccctacccgcagcccctccctccgggcagctcagctctaggctgccttccacctcgcggaccctaagcaatttgttatataaaacaaaacagcaaccagacgcatgtgcctgttcttcactaacgccagcagaccggcagcgacggatacccggtggacctcagccgggacgcctcgggcagcagcttcttgcccgctgccgcacccacctctgcaccccagctcgggtcagcccagcagccaaagcaaaagggggattcctcagtttgctcccttggaggctacaaagcctctctctggttattccaaccgttaagtaaaaaagaggtgatgggaaagatttggtctgcacacaaagatataccaggagaagaatgcacatttatgtgtaaaatggcttaggcaccaagaatgagacatcacttcagtgcagcctagaaatagttaaaaataaccgaatgctagaggacagaggtggttttgggatctgccccacactccttatcaggatccctaattccctgccacctcctatggttcc

SEQ ID NO: 1114 - DNA, 4613 bp, Homo sapiens; identical to SEQ ID NO: 1113

SEQ ID NO: 1115 - DNA, 4613 bp, Homo sapiens; identical to SEQ ID NO: 1113

SEQ ID NO: 1116 - DNA, 638 bp, Homo sapiens
gtggcctcctccgtggcccccacttttgacagcacagcctgcttggctcctgagaagtgcccacgtggcacacctcacccctgcccctgctctgcctgccacctctcatggcaccaaaggagcctttgtcccttcctcatgggggctctcagcagatgctgacgttctgactgaaacagatttgtagaatcatggattttgaagtggggacccaggtcccagtgtttcagtgggtctttaaaaaagagagaaagggagagagagatggagagagagagagagaaagtgagcaacagcacgagaggtcattccggactcctgacgccgccagtcccgcggtgagacgtgagcgccattggcgtccgtggcctctgtttccgtggcaacctagtaaccattaattttcaattaaaggagacaaaaagctcgatgacagctccaggtctgctgaagatgtcaagaatctgtattaatatacagcaagagagcataattgtgtgtccatcttccagagcagcgaaaaatggagggataattaccagctcgaaagccactctgtaatttagttcttactgtcaccacagccctacacattagcataaattaaaagcagagtttattgttatcaaagtgcattg

SEQ ID NO: 1117 - DNA, 674 bp, Homo sapiens
cagacctacaaataacttatgtatttccctattcttcttccttccctgttacttactccttgtgtgcgttcagggaaacctttatcccttggtttcctgcagggaaataatcttcagtgttgcactgacttggtccagctggaatctatatcacacagaggaatgccggcccctgccgatggtcgggctggcttcgtggctccatcctccttggcctccaacacatggagctcatttttcctgcataactttgcctgctgttcccactgcctggaatgctgatccccacgttttgtgtagctcatcctgattcaggtctcagttcacaggacccctcccctcatgccaccccttcgtcgccaccaccatccactctttctttcaggtccttatttggttttctcatggcatttactattgtttgggatttttttgttagtatatttgtgtgttgtctcctatatcagactctgttccttgaatgttctatttacattgtatcctccatgtctaagacaaggggcccaggaggtgtgtgtgtatgtgtgtgtgtgtgtgagagagagatttttgcatttgaaatctcccaaatttttaatgttagcaatttaaaaactaactatacaggtagaatgaatgataaaatgcaaaaataaataaataaatcaataaac

SEQ ID NO: 1118 - DNA, 8558 bp, Homo sapiens
actaaatcttcagtatgataaggttatgcaggactaaaaactgggtagcaataaatgggctttagaaaacaaagcatgcaggttttcccaggcactttcaactaatgcaaacatatacagtacagaaaagagaagatgtaacttttctctgaaaaaaaggtttattgcatatggaaatcaatagatatcttttacaaaaaaaggttagaataaagatctcacatttgtaaaggcacatatgaaacattttatagcaagcacaagggcagtgagaacatcaacaaggtccaatatctaaataagactttataaaaacagataggaaacagtgcaaaaaatactgtcaaagtcagttctatacacctcataactgtgtatacaactggcaagcataagcttatttactgatataaaatagcacatagaatagcatgcatagttttattttaggcttttcatattattaaattgatagggagtctataccaaagtacagttgacatgaatagtgataaaaatcactccccagcttagggaatgtcctataaacatctcacccctccctctgcttacaactacagtttggtagtaaggagactgggcttccatcttgcaaggtggcaagcggccaccacagggggcgaatgtgctctcaggatcccaagtcccaacctggaatgcatttcttacggcaacaacataagagatggtgattaaatgtctgggtcagcccacaaaagccaaccagatctggctatcacagccctccatttgggctgtggtggaggtcagtgggcttctatgggctgacgcaagaaccttaagaacaaaccggtttctaagttggggacttgtctgtacatcgtttcaaaatgaaacctaataaatgtcatttgttttgaatgataccaaaattcacaacattttgtgaaacaaagatcaaggaaagcatcaaaatactgaagtagggagcacaagcctagtccagtgaaacaaactagattagcttgttacttgatgtaacacaagttacataaggttacacatttattagtaatttgcatatttaaacctttttttccactgaagtatcctcaagcacattaattagctattgaaggaacaaaggacatacataggaactcatctctgatgaagagtagctttatgtcagaaaggagaaggctaatgaatttttaagattccaaacagtggcaagaaagttcaaaggaaattgcagtaaaattgtacaatgttcaagttgaaaaaaaaaatggctctgaattacagcattcagttctatgctcaaggtatgtattagctaacactgcagttgtcagaggtgggaggcccctgagaaatgctgagaatgccaggcaccccagttctgagagccaccctagctaaactcaaagcagcattcttgagattttagcaaaaggctccgccccaagccacaaaaagatcccaatccaatcttttcagctttatcctctaaaaccttttgtcagatgagatagcatttgtgtttcccaggaggagaaggttggggaagaaaatgaagatagcttacatacagattttggatgacccgctaatctttccccttcctaggtaagtgaaaacagataaaatgtttctgggcagcccaaaggtttaccacctgtttcactagaatggccagtctgtgtaaagaggctataatgacgaaagcattttccctgcagggagaagctagaaacaaatgggtcttcctatacatcagtctgccaaatgcagcctctctcaatctatataagttcacctcgaaatacatattaagtactgctgtcatcattgttttaaacagagcgtctttcattttttctaatagtgactgattctatcggcaagggaacaaaagggtgagaaagggagcttcctgcttgctgagttttctagctattttcattctggttattttcatccgccagatctttttttttttttttttttttttttgagacaaagtctcactctgttgcccaggctggagtgcagtggcatgatctcggctcactgcaacctccacctcccgggttcaagcaattatcctgcctcagcctcctgagtagctgggattacaggcatgtgccaccatgcctggctaatttttttttttttttttttttttgtatttttagtagagacgggatttcaccatgttggccaggctggtcttgaacgcctgacctcaggtgatctgcctgcctcagcctcccaaagtgctggtttgattacaggtgtgagccaccacatctggccatttgccagatcttattctttgaaactatacaagcaatttttaaaaaattaaaataagatttcctaattacatatttctgagaggtttaaggcaatgattctctgacgaggattaactcttacatctgggttgcactcatagggtaggtaaagaaaagaaaaagtgtactgttgagagttgatccataaagcagatggggaaatatgaaaaggcagcagaggctgggtgtaatcccagcactttgggaggccgaggggggtcatcacgaggtcagaggtttgagaccagtctggccaacatggcaaaaccccgtctctactaaaaatataaaaattagccgggtgtggtggtgcacgcctataatcccagctactttggaggctgcactccagcctgcgcaacaggagtgagacacgatctcaaaaactaaaaaaaaaaaaaaaaagaaaaagaaaaaaaaaaaggcagcagaccctaagtgaacaaggtgctcatggaatgaagagggtgacagcacacaacagtcccacccgttcccctgaacaagacaaggaacaccaaagtcactgcatgtacatcccagttttgtggcctgaatagaaacatgacttgctctaaaggggaatgtcctctgcagcacctctgagatcacaggggagaagaatcaagaaatccaagagccggggctgctaactctgggagccacatgggtaagcagaatgctctgctaacaagcaaggcaaggaaaggctgcccagtagctccagccctcctgccttgtaactcaatgtccttgaatttatttttaaaatgggaaggctaaaaacaaagctgcaaacggtaggaactgatgcacatcctcttctttactgtaccaaacaacaatcattttccagtctatgaaattgatggatgccagacactcaatgctaggctcatggacattttaatagagaatatcttagtttggctttgagaaagaagatgcagctatattaagctgaaaagataagaaaggtagtctactgaataaaaatacttacctatctgagtttctaacagaaacacaaaagctgagagcaggctggataaaggctgagtgttgatggcgcaagctggtggtcaagtttcacagggccccctgaataacactgacttctggacaacacatttgaggtggcagaatttgatgagatttcccccacatttctccctggcacgttgctgttactttcaacagacgccatctgtaaggtcctttgccccaaaatgtcttagaagcttaagtaaagacaagaactattttgcttccttgctcagcgttcaagagaagtatcaaatgcagtttaacatcttacagctttatttccaccctatagggccaactagtgtgccaaccataaggctgtaggccattggagaatttgtgtggtttctacagaagacccaaatttctccatttggaaaccatgctggatgagctgttgctctgctcatgaaaagaaatcactaaataagagcatgatgagtgtctcaaaaccattggcaatataataaaacacagcagcagaataattgttggtaaaacatgggaatgctcaattccctaaaagggctaccctaagagcccaacagtaattatgtggtgcttccggaaatgtcttactctaggagctccacagagttatttctgacactgagtaagaacacaggtctgactcaatcccatcccttgaatctgtgctccctggcacacatcctagaatgccctgtaccctccatccccccaacccccgcacctcaagggattgacagatcttccccaaacgaaaatcagtaacgaaatagttgtcctttaccaaagggggcaatcaaggaccctctgagaataccagaatccatggatgttcaagtcttttatataaaatagcacagtatttgcatataacctatgcacatctcttgcatactttaaatcatctctagattatttacaatacctaactcaatgcctacacatcacttcatttgtgtgaattcaatgtagtattcagcatgtggcaaattcaacttttgctttttggaactttgtgggtttcccctcttccccaaatatttttcaatctgtacttggttgaatatagggatgtggaacccacagataggggtggtcaactgtactcatcttcaccatcgaatacaccattagatggggaaagggagactagaaggcacattctgctttttgacaaaggacacttttgggacccatacgtcacgtaacaagtaggctgaggtcagctaatacagactgttcatcgggaaaggacagcagctaaaaactccagagtgatatgcctgatggccaatccggcttaagagaagctgcagtgcactatctacctctgcaacttccatgtcccaggagatggcccattcaccaagtgatgcaaggatcactatgagcagggcagcacgttcgtgaaaagagctgggccacccagggtataccttttgtgttcattagcactgctctggagaaatgacatctggtgttgggacccacagtgtatcagggggaagatataggtgatccatgcgagtactgtctatttgcagaaaatatggtccattattggaaatttcatatgggtcaatctatattaagctggaaaaataatcagctggatgaaaaggccagcctgctgtacccactggagtttataactgaaaagcacaagctgaaagaaagcaggataaaggttaagtaggtgtaagccatggtcaagtcctacaaggcccaccctcagcagtctacaaagaccctctcttcaggctgatgaaagagggggccagagatggccaagtgactcttaggaaaacaatgacagtttagctataattttaaaaagcggttcctcttctcaatctacaaaattaaaagtaaaattctctcaatttaagctcctcaaaagcttacgattcaaaatattccacataggtatttttaccttccctgatcttattgtttagctccgactgaatattgcagctcattcatctttactcctatgtaatcaatgtttaacatccttttttcatgcaactaaatcctcctttacttcctatctggggaaagaagtgcataccaatgtctatgctatctgtaaatgctaccagatactcttgctaaaagatggtatatccagtatatccttagaacccaaggaaacctaagaaacctcagcaggacattcctcagctaagccagcaggctcatctcaaggatgaagacatcaaattcagcccccatgattcagggaccacagtaaacaaggatgaatacctcgggtcaatgtatccaaatgagtgtggatgaaagaaaccaaacagttcaactggaaaacctcgaaaacagcggctggaaaatgtttgatggctttgttgtgagatggtaacttttttttcctccattttacattttctcccttcaaatccaaactgcagcaatagacactgacagctccagcttcagacttgatacatcatcaggaaatcattccaaaagctctaactagataactaatttaatacactttgcttcaaggtttattccttggcttgcttcccagatataaagcatctctgggcaattattatgcagatgccaccgaaaggactttaaatggctgctgctaatttaacaggagatatgttggcatttactggagatgtgaaaaggaatgcaaaatgtgctaaagaaccaaaggcatttgtttttaaaagtgaaatatgtggaacaactcttaaatgttttcttttgggtttcaatataaactttggctagaaagttgaatattaaacctacttcctccctgcattttgtacactaatgaatattcccgtagcatacggcagggacagtggatgaatttcagggaagcccatgagctctgacgacctcaaagacgcaccagatctatatgctgtccacatgagacatattctaacagtgcccaccttggggcttagagataaaagataaatactgatgttgttcatcacgcaataaaccagtaactgagaccacttgctaaaacatccctaacagcagaatatcccaaggatggaaaaacctccaaggaaaggaaacaagtatctttttgcttattgatgagcttcttataataagggttataagctctgttcactgaaaatacatgtaatactaatgggtttctttccaggacatacaacaaaactccagaatctacaaagatcagcagattatactccttcactgagccttcagaccttgaagtagaagacacaggggaagccctccatccccagatattccgagtctaactagagtacagccaccacaacacctggccaggttgaaacagaggattcctattccgaagaacttaatggggaatatatacctgttggcatgtggtgatgggatgtcacaaaggcatactttttctggttgatttgatgtcactccatctttttagctcacgggggacaaaagcagcaatgaagaaaggcatatggaactctcacagcagtcaattctaagaaaaaaaactgcaattaaattttcctttctcctaacatctagtttttcttgacaaccttttttccttttttttttttttttttggaggcagggtctctccgtagcccagcctggactacagtggcaagatcacggctcactgcagtctcgaattcttagaatcaggtgatcctcctgcctcagcctcccgagcagctgggactaccagggcataccaccacgcctggctaatttttgtactttttgtagagacggggtttcatcatgttgctcaggctggtctcgaactccttagctcaagcaatctgcccgccttggcctttcaaagtgctgggattacaggtgtgaaccaccgtgcctggctgactacagttttttaattgcacgtttgttctttgaactgaccactgtgggcattccatgccttcctccactgccgcctttttcccaagctgaaaagacaaggaagatgtggcatcaaattaactagaaagagcacgcctgtgacttcccatcaccacgtaacaacaggtgcatatcaaagctgtactcaagaaaaggtagacatagaatgataaatcccccaaaatgcagtaagaggaaaaaagtacaaaacatgatttattgtgtaccatccttggaaattcagaaggacactgaccaatgaagccataggaagaaactaagaactgggcttcaaagtgaagataactgaccagcgagtggattttatgaagaaaaggaaagaagcacagggctctgccaatgacaattctaccatcgttcatcaagtggccccaagtttggactatggggtcccgagtgggattaattctgatcttgcagaccaaagcctgaagatgatatcagcacagcgggggtcacatttgatgtgtttcctggccaggacccctgttatgtagctaaatgccttacagctcccataaatcagcttccccatctgtttccttgatggcctttccaatgacttagtgacctcaacttttaggtctctgtccagcacacacatcttatttaaataaaaaacaatgatcatcaaggccctgcctgaaaaacacaatcctcaaaggccctgcccaactcctttctctttctaggtctgctatcctctctcaatcagggtagagccttaactgcacagatggtctggtccagagcctcaatgccaccagacagggtcctactgagcaaacaggagaggtagcaacaaatacccaaggtacagtcgccagcagggaaacacaagctccagagcccaggataaggggtggtcaagaaaagcacaacacagagcttgtctttcggccccaaagatggcaattactgcattgtaaaggcagcactgtctttagctattctgtctttaactcaagcttgggggggaagttggggtggggcgtgggggagaggagactactgaggatgaggggtggaaatgaagacgagaggaaactgtctatcaaggctcatgagccccaaaatataagagaatcgtgtttgttccttcagacccttttctttatatttcaggatgaattcattttcttaccgtctttgctttggatataagcaatgaatgatgaatgaatcaagctgataaatgaattaagctgatgaatttcagggttggttacaaatctggct

SEQ ID NO: 1119 - DNA, 8558 bp, Homo sapiens; identical to SEQ ID NO: 1118

SEQ ID NO: 1120 - DNA, 8558 bp, Homo sapiens; identical to SEQ ID NO: 1118

SEQ ID NO: 1121 - DNA, 8558 bp, Homo sapiens; identical to SEQ ID NO: 1118

SEQ ID NO: 1122 - DNA, 8558 bp, Homo sapiens; identical to SEQ ID NO: 1118

SEQ ID NO: 1123 - DNA, 8558 bp, Homo sapiens; identical to SEQ ID NO: 1118

SEQ ID NO: 1124 - DNA, 8558 bp, Homo sapiens; identical to SEQ ID NO: 1118

SEQ ID NO: 1125 - DNA, 8749 bp, Homo sapiens
actaaatcttcagtatgataaggttatgcaggactaaaaactgggtagcaataaatgggctttagaaaacaaagcatgcaggttttcccaggcactttcaactaatgcaaacatatacagtacagaaaagagaagatgtaacttttctctgaaaaaaaggtttattgcatatggaaatcaatagatatcttttacaaaaaaaggttagaataaagatctcacatttgtaaaggcacatatgaaacattttatagcaagcacaagggcagtgagaacatcaacaaggtccaatatctaaataagactttataaaaacagataggaaacagtgcaaaaaatactgtcaaagtcagttctatacacctcataactgtgtatacaactggcaagcataagcttatttactgatataaaatagcacatagaatagcatgcatagttttattttaggcttttcatattattaaattgatagggagtctataccaaagtacagttgacatgaatagtgataaaaatcactccccagcttagggaatgtcctataaacatctcacccctccctctgcttacaactacagtttggtagtaaggagactgggcttccatcttgcaaggtggcaagcggccaccacagggggcgaatgtgctctcaggatcccaagtcccaacctggaatgcatttcttacggcaacaacataagagatggtgattaaatgtctgggtcagcccacaaaagccaaccagatctggctatcacagccctccatttgggctgtggtggaggtcagtgggcttctatgggctgacgcaagaaccttaagaacaaaccggtttctaagttggggacttgtctgtacatcgtttcaaaatgaaacctaataaatgtcatttgttttgaatgataccaaaattcacaacattttgtgaaacaaagatcaaggaaagcatcaaaatactgaagtagggagcacaagcctagtccagtgaaacaaactagattagcttgttacttgatgtaacacaagttacataaggttacacatttattagtaatttgcatatttaaacctttttttccactgaagtatcctcaagcacattaattagctattgaaggaacaaaggacatacataggaactcatctctgatgaagagtagctttatgtcagaaaggagaaggctaatgaatttttaagattccaaacagtggcaagaaagttcaaaggaaattgcagtaaaattgtacaatgttcaagttgaaaaaaaaaatggctctgaattacagcattcagttctatgctcaaggtatgtattagctaacactgcagttgtcagaggtgggaggcccctgagaaatgctgagaatgccaggcaccccagttctgagagccaccctagctaaactcaaagcagcattcttgagattttagcaaaaggctccgccccaagccacaaaaagatcccaatccaatcttttcagctttatcctctaaaaccttttgtcagatgagatagcatttgtgtttcccaggaggagaaggttggggaagaaaatgaagatagcttacatacagattttggatgacccgctaatctttccccttcctaggtaagtgaaaacagataaaatgtttctgggcagcccaaaggtttaccacctgtttcactagaatggccagtctgtgtaaagaggctataatgacgaaagcattttccctgcagggagaagctagaaacaaatgggtcttcctatacatcagtctgccaaatgcagcctctctcaatctatataagttcacctcgaaatacatattaagtactgctgtcatcattgttttaaacagagcgtctttcattttttctaatagtgactgattctatcggcaagggaacaaaagggtgagaaagggagcttcctgcttgctgagttttctagctattttcattctggttattttcatccgccagatctttttttttttttttttttttttttgagacaaagtctcactctgttgcccaggctggagtgcagtggcatgatctcggctcactgcaacctccacctcccgggttcaagcaattatcctgcctcagcctcctgagtagctgggattacaggcatgtgccaccatgcctggctaatttttttttttttttttttttttgtatttttagtagagacgggatttcaccatgttggccaggctggtcttgaacgcctgacctcaggtgatctgcctgcctcagcctcccaaagtgctggtttgattacaggtgtgagccaccacatctggccatttgccagatcttattctttgaaactatacaagcaatttttaaaaaattaaaataagatttcctaattacatatttctgagaggtttaaggcaatgattctctgacgaggattaactcttacatctgggttgcactcatagggtaggtaaagaaaagaaaaagtgtactgttgagagttgatccataaagcagatggggaaatatgaaaaggcagcagaccctaagtgaacaaggtgctcatggaatgaagagggtgacagcacacaacagtcccacccgttcccctgaacaagacaaggaacaccaaagtcactgcatgtacatcccagttttgtggcctgaatagaaacatgacttgctctaaaggggaatgtcctctgcagcacctctgagatcacaggggagaagaatcaagaaatccaagagccggggctgctaactctgggagccacatgggtaagcagaatgctctgctaacaagcaaggcaaggaaaggctgccagcagcaggcgagggaagatggtgcttttgatcagcaaatccaggcaaatatgataaaccacacatcataatccatgacattcatcaagctctacctcaacagtgaagacagtttaaaactatgagctagggtgaaatagactccaacactgctgcaggctttccctagcatgccacttggtggtttccatcactctgacattacagaaagggaggcagggagtaggagaggcattccagagttcagaaaattatttgtgaaacagagaacttttggatagcaacttcaggactgatgcaaaaatccttcctctccctcttcccatttatagaaacttttgagcaagtttatggcacttctgggaaagaatgatcctgatggcccaaagtgtggcagaaggagcaatgactttccacacaaatgcttgtcatattcaggctgcccagtagctccagccctcctgccttgtaactcaatgtccttgaatttatttttaaaatgggaaggctaaaaacaaagctgcaaacggtaggaactgatgcacatcctcttctttactgtaccaaacaacaatcattttccagtctatgaaattgatggatgccagacactcaatgctaggctcatggacattttaatagagaatatcttagtttggctttgagaaagaagatgcagctatattaagctgaaaagataagaaaggtagtctactgaataaaaatacttacctatctgagtttctaacagaaacacaaaagctgagagcaggctggataaaggctgagtgttgatggcgcaagctggtggtcaagtttcacagggccccctgaataacactgacttctggacaacacatttgaggtggcagaatttgatgagatttcccccacatttctccctggcacgttgctgttactttcaacagacgccatctgtaaggtcctttgccccaaaatgtcttagaagcttaagtaaagacaagaactattttgcttccttgctcagcgttcaagagaagtatcaaatgcagtttaacatcttacagctttatttccaccctatagggccaactagtgtgccaaccataaggctgtaggccattggagaatttgtgtggtttctacagaagacccaaatttctccatttggaaaccatgctggatgagctgttgctctgctcatgaaaagaaatcactaaataagagcatgatgagtgtctcaaaaccattggcaatataataaaacacagcagcagaataattgttggtaaaacatgggaatgctcaattccctaaaagggctaccctaagagcccaacagtaattatgtggtgcttccggaaatgtcttactctaggagctccacagagttatttctgacactgagtaagaacacaggtctgactcaatcccatcccttgaatctgtgctccctggcacacatcctagaatgccctgtaccctccatccccccaacccccgcacctcaagggattgacagatcttccccaaacgaaaatcagtaacgaaatagttgtcctttaccaaagggggcaatcaaggaccctctgagaataccagaatccatggatgttcaagtcttttatataaaatagcacagtatttgcatataacctatgcacatctcttgcatactttaaatcatctctagattatttacaatacctaactcaatgcctacacatcacttcatttgtgtgaattcaatgtagtattcagcatgtggcaaattcaacttttgctttttggaactttgtgggtttcccctcttccccaaatatttttcaatctgtacttggttgaatatagggatgtggaacccacagataggggtggtcaactgtactcatcttcaccatcgaatacaccattagatggggaaagggagactagaaggcacattctgctttttgacaaaggacacttttgggacccatacgtcacgtaacaagtaggctgaggtcagctaatacagactgttcatcgggaaaggacagcagctaaaaactccagagtgatatgcctgatggccaatccggcttaagagaagctgcagtgcactatctacctctgcaacttccatgtcccaggagatggcccattcaccaagtgatgcaaggatcactatgagcagggcagcacgttcgtgaaaagagctgggccacccagggtataccttttgtgttcattagcactgctctggagaaatgacatctggtgttgggacccacagtgtatcagggggaagatataggtgatccatgcgagtactgtctatttgcagaaaatatggtccattattggaaatttcatatgggtcaatctatattaagctggaaaaataatcagctggatgaaaaggccagcctgctgtacccactggagtttataactgaaaagcacaagctgaaagaaagcaggataaaggttaagtaggtgtaagccatggtcaagtcctacaaggcccaccctcagcagtctacaaagaccctctcttcaggctgatgaaagagggggccagagatggccaagtgactcttaggaaaacaatgacagtttagctataattttaaaaagcggttcctcttctcaatctacaaaattaaaagtaaaattctctcaatttaagctcctcaaaagcttacgattcaaaatattccacataggtatttttaccttccctgatcttattgtttagctccgactgaatattgcagctcattcatctttactcctatgtaatcaatgtttaacatccttttttcatgcaactaaatcctcctttacttcctatctggggaaagaagtgcataccaatgtctatgctatctgtaaatgctaccagatactcttgctaaaagatggtatatccagtatatccttagaacccaaggaaacctaagaaacctcagcaggacattcctcagctaagccagcaggctcatctcaaggatgaagacatcaaattcagcccccatgattcagggaccacagtaaacaaggatgaatacctcgggtcaatgtatccaaatgagtgtggatgaaagaaaccaaacagttcaactggaaaacctcgaaaacagcggctggaaaatgtttgatggctttgttgtgagatggtaacttttttttcctccattttacattttctcccttcaaatccaaactgcagcaatagacactgacagctccagcttcagacttgatacatcatcaggaaatcattccaaaagctctaactagataactaatttaatacactttgcttcaaggtttattccttggcttgcttcccagatataaagcatctctgggcaattattatgcagatgccaccgaaaggactttaaatggctgctgctaatttaacaggagatatgttggcatttactggagatgtgaaaaggaatgcaaaatgtgctaaagaaccaaaggcatttgtttttaaaagtgaaatatgtggaacaactcttaaatgttttcttttgggtttcaatataaactttggctagaaagttgaatattaaacctacttcctccctgcattttgtacactaatgaatattcccgtagcatacggcagggacagtggatgaatttcagggaagcccatgagctctgacgacctcaaagacgcaccagatctatatgctgtccacatgagacatattctaacagtgcccaccttggggcttagagataaaagataaatactgatgttgttcatcacgcaataaaccagtaactgagaccacttgctaaaacatccctaacagcagaatatcccaaggatggaaaaacctccaaggaaaggaaacaagtatctttttgcttattgatgagcttcttataataagggttataagctctgttcactgaaaatacatgtaatactaatgggtttctttccaggacatacaacaaaactccagaatctacaaagatcagcagattatactccttcactgagccttcagaccttgaagtagaagacacaggggaagccctccatccccagatattccgagtctaactagagtacagccaccacaacacctggccaggttgaaacagaggattcctattccgaagaacttaatggggaatatatacctgttggcatgtggtgatgggatgtcacaaaggcatactttttctggttgatttgatgtcactccatctttttagctcacgggggacaaaagcagcaatgaagaaaggcatatggaactctcacagcagtcaattctaagaaaaaaaactgcaattaaattttcctttctcctaacatctagtttttcttgacaaccttttttccttttttttttttttttttggaggcagggtctctccgtagcccagcctggactacagtggcaagatcacggctcactgcagtctcgaattcttagaatcaggtgatcctcctgcctcagcctcccgagcagctgggactaccagggcataccaccacgcctggctaatttttgtactttttgtagagacggggtttcatcatgttgctcaggctggtctcgaactccttagctcaagcaatctgcccgccttggcctttcaaagtgctgggattacaggtgtgaaccaccgtgcctggctgactacagttttttaattgcacgtttgttctttgaactgaccactgtgggcattccatgccttcctccactgccgcctttttcccaagctgaaaagacaaggaagatgtggcatcaaattaactagaaagagcacgcctgtgacttcccatcaccacgtaacaacaggtgcatatcaaagctgtactcaagaaaaggtagacatagaatgataaatcccccaaaatgcagtaagaggaaaaaagtacaaaacatgatttattgtgtaccatccttggaaattcagaaggacactgaccaatgaagccataggaagaaactaagaactgggcttcaaagtgaagataactgaccagcgagtggattttatgaagaaaaggaaagaagcacagggctctgccaatgacaattctaccatcgttcatcaagtggccccaagtttggactatggggtcccgagtgggattaattctgatcttgcagaccaaagcctgaagatgatatcagcacagcgggggtcacatttgatgtgtttcctggccaggacccctgttatgtagctaaatgccttacagctcccataaatcagcttccccatctgtttccttgatggcctttccaatgacttagtgacctcaacttttaggtctctgtccagcacacacatcttatttaaataaaaaacaatgatcatcaaggccctgcctgaaaaacacaatcctcaaaggccctgcccaactcctttctctttctaggtctgctatcctctctcaatcagggtagagccttaactgcacagatggtctggtccagagcctcaatgccaccagacagggtcctactgagcaaacaggagaggtagcaacaaatacccaaggtacagtcgccagcagggaaacacaagctccagagcccaggataaggggtggtcaagaaaagcacaacacagagcttgtctttcggccccaaagatggcaattactgcattgtaaaggcagcactgtctttagctattctgtctttaactcaagcttgggggggaagttggggtggggcgtgggggagaggagactactgaggatgaggggtggaaatgaagacgagaggaaactgtctatcaaggctcatgagccccaaaatataagagaatcgtgtttgttccttcagacccttttctttatatttcaggatgaattcattttcttaccgtctttgctttggatataagcaatgaatgatgaatgaatcaagctgataaatgaattaagctgatgaatttcagggttggttacaaatctggct

SEQ ID NO: 1126 - DNA, 8749 bp, Homo sapiens; identical to SEQ ID NO: 1125

SEQ ID NO: 1127 - DNA, 8749 bp, Homo sapiens; identical to SEQ ID NO: 1125

SEQ ID NO: 1128 - DNA, 8749 bp, Homo sapiens; identical to SEQ ID NO: 1125

SEQ ID NO: 1129 - DNA, 8749 bp, Homo sapiens; identical to SEQ ID NO: 1125

SEQ ID NO: 1130 - DNA, 8749 bp, Homo sapiens; identical to SEQ ID NO: 1125

SEQ ID NO: 1131 - DNA, 4821 bp, Homo sapiens
ggagaagcaggagcagggggaggaggaggaggcagagcaggaggaggagcaggaggaggaggaggaggtgtcatctgtggacaatacctggaagggcaaggggtggtgggtgtcactaaaaggaaccagccccagctacttcactgcaggctggtgccctggtgaaggtgaatcagtcagaggagtgctgactgcccatggggctgcaccatatcatggttcccactagcaatatatgagagttccagttgctccacaacctcgccaacatatgacaggtgcttttgttaaagatcttgctgttgattcccgggcaagatggctgaataggaacagctcgggtctgtggctccctaagagatcaacgcagaaggcgggtgatttctgcatttccaacggaggtacctggctcatctcattgggactggttagacagggggtgcagcccacagagggcgagtcgaagcagggtggggtgtcacttcacccgggaagcgcaaggggtcagggaactccctcccctaaccaatggaagccgtgagggactatgccttgaggaaccgtgcattccagcccagatgctatgcttttcccacagtcttcacaacccagagactaggaggagattctcttgggtgtctacacaaccagggccctgggtttcaaacacaaagctgggtggccatttgggcagacaccgagctagctgcaggagtttcttttcatattccagtggcgcctggaatgccagtgagagagaaccgttcactcccctggaaatggggcagaagccagggagctgagtgctcttgctcagcagatcccacctccacatggcccagcaagctaagatcccctggcttgaaattcttgctgccagcacatcagtttgaagtcgacctaggaggcttgagcttggtgtgggaaggggtgcccgccattactgaggcttgagtaggtggttttcccctcacagtgtaaacaaagcccctgggaagttcggactggttggaacccaccacagtgactcaaagctgctgtagccagactgcctccctagattcctcttctctaggcagggcatctctgaaaaaaaaggcagcagccccagtcagaggcttatagataaaactcccatctccctgggacagaacacctgtgggaaggggcgactgtgggcgcagcttcagcagacttaaatgttcctccttgctggctctgaagagagcagcagacctcccagcacagagctccagctctgttaagggacacactgcctcctcaagtgggtccctgacctctgtgcctcctgacaggagacacctcccagcagaggtcgacagacacctcatacaggagagctcaggctggcatctggcaggtgcccctctgggacgaagcttacagaggaaggagaaggcagtaatctttgctgttctgcagcctccgctggtaatacgcaggcaaacagggtccggagtggacctccagcaaactccagcagatctgcagaagaggggcctgttagaaagaaaactaatgaacaggaagcaatagcatcaacatcataaaaaaaaccaaccactcaaaaaccccatccaaaggtcaccaacatcaaagaccaaaggtagacaaatccacgaagatgaagaaaaaccaacacaaagaggctgaaaattccaaaaaccagaatgctgcttctcctccaaaagatcacaactcctcaccaggaagggaacaaaactggatggagaatgagtttgatgaattgacagaagtaggcttctgaaggtgggtaataacaagctcttcctgagctaaaggagcatattctaacccaatacaaggaagctaagaaccttgaataaaggttagatgaattgctaactagaataactagtttagagaagaacataaatgacctgatggagctgaaaaacacagcaaaagaacttcgtgaagcacacacaagtatcaagagctgaatcaatcaagcagaagaaaggatatcagagattgaagatcaacttaatgaaataaagtgtgaagacaagactagagaaaaaagaatgaaaagaaatgaacaaagccttaaaaaatatgggtctgtgtgaagagaccaaatctatgtctgattggtgtacctgaaaacgacggggagaaaggaaacaagttgggaaacacacttcaggatgttatcaagagaactttcccaacctagcaagacaagccaacattcaaattcaggaaatacagagaacaccacaaagagagcaaccccaagacacataatcatccgattcaccaaggttgaaatgaaggaaaaaatattaagggcagccagagagaaaggtcaggttacccgcaaagggaagcccatcagactaacagcagatctctctgaagaaaccctacaagccagaagagggtgggtgccaacattcaacattcttaaagaaaataattttcaacccagaatttcatatccggccacattaagcttcataagtgaaggagaaacaaaattctttaaagacaagcgaatgctgagggattttgtcaccaccaggcctgctctacaagagctcctgaaggaagcactaaatatggaaaggaaaaaccagtaccagccactgcaaaaacatacaaaaatgtaaagaccatcgacactatgaaaaaactgcatcaactgatgggtaaaataaccagctagcattataatgacaggatcaaattcatacataacaatattaaccttaaatggaaacaggcaaaatgccccaattaaaagacatagactggcaaattggatagagccaagacccatcagtgtgccatatttaggagacccatttcacatgcaaagacacacataggctcaaaataaaggaatggaggaagatttaccaagcaaatggaaagcaaaaaaaaaaaaaaaaaaaaaaaaaaagcagaggttgcaatcctagtctctgataaaacactttaaaccaacaaagatcaaaaaagtcaaagaagggcattacataatagtaaagggatcaatgcaacaagaagagctaactatcctgaatatatatgcacccaatacaggagcacccagattcaaattcatcaaggaagtttttagagacctatgaagagacttagactcccacccgataatagtgggagactttaacatcccactgtcaatattagacagattaacaagacagaaaattaacaaggatattcaggacttgaactcagctctggacgaagcagacctaatagacatctacagaattctccaccccaaatcaacagaatatacattcttctcagcaccacatagcacttattctaaaattgaccacataattggaagtaaaatactcctcagcaaatgcaaaagaatggaaataataagtctcttagaccacggtgcaatcaaattagaactcaggattaagaaacacactgaaaactgcacaactatagggaagctgaacaatctgctcctgaatggctactgggtaaatgacgaaattaaggcagaaataagtaagttctttgaaaccaatgagaacaaaacacaatgtaccagaatctctgggacacatataatgcagtatttagagggaaatttatagcactaaattcccacaggagaaagcaggaaagaactaaaatcgacaccctaacatcacaattaaaagaactagaggagcaagagcaaatcaattcaaaagctagcagaagacaagaaataactaagatcagatcagaactgaaggagatacagacacaaaaaacccttcaaaagatcaatgaatccaggagttggttttttgaaaagattagcaatatagatagattgctagccagactaataaagaagaaaagagagaagaatcaaacagacacaataaaaaatgataaagggatgtcaccactggtcccacagaaatacaaactaccatcagagaatactatgaacacctctacgcaaataaactagaaaatccagaagaaacagacaaattcctggacacatacaccctcccaagactaaaccaggaagaagttgaatctctgaatagaccaataacacgttctgaaataggtacacgcatacctatgtgacaaatctgcacgttccacacatgtatcccagaacttaagtataataataataaaaaagaatacttttaaatcaattttgcttccacttttaccttttaaaataatctagatagccatttttaagtgccaggtagggtggaagttgactaaatacggacagagctacaaagtgaaattaaagaactatgctttatgaatacctgtcttaaagggtaatacatcttgagtgtccttatttttattttattattcagctcctatcatcaatcgtggtagcttcctccccagcactggttagctagaactttgagaagctgagattccctgaactcaatggggtcttgacctcaatctgttgtccaaacaggtgcaaatttgctgcaaagcatcattgtctgctccatgttttactgttctgagttatttcattaaatgcatttataaacttgaaaaaaaagattttgctgttgaaaatagccctgaagcataatgctcaagtgctgtctattgtttctatgcaccaggaggctgttgtgtttcttatgtagaaaatacatttattagataagcttcattctgttatgagttgtagtgctgctggtcatgagttcattgtggatgaattaacaatatccactaaataaggtgtctttaaatggaaacacccatgaaacaaggttgtgtattgatgag

SEQ ID NO: 1132 - DNA, 9499 bp, Homo sapiens
ggagcaggagaaaggaggagaagcaggagcaggaggaagaggagcaggagaagaaggagcagaaggaggaggagcaggaggaggagaaggaggaggagcaggtggaggaggaggagcaggaggaggagaagcaggaggagcagaaggagaggaggagcaggaagaggaggagaaagagcaggaggaagaagaggaggagaagcaggaggaggaggaggaagagcaggaggaggaggaagagcaggaggaggagcaggaggaggaggagaaggagcaggaggaagaggaggagaagcaggagcagggggaggaggaggaggcagagcaggaggaggagcaggaggaggaggaggaggtgtcatctgtggacaatacctggaagggcaaggggtggtgggtgtcactaaaaggaaccagccccagctacttcactgcaggctggtgccctggtgaaggtgaatcagtcagaggagtgctgactgcccatggggctgcaccatatcatggttcccactagcaatatatgagagttccagttgctccacaacctcgccaacatatgacaggtgctgcaagaggatggttatttaacgctggcccccaaggaggaaggcacagaccttcctcctcctggaacatccaagggcactggatcctctgtgtccctctgagatggggtgccactccagcaagagcaccacggtggcagctgagtcccagaagcttgaagaagagcgcgagggaagagagccaggtctggagaccggcacccaggcagcagactgcaaggatgccccgctgaaggatggaacccctgagccaaagagctgaaatgcctctctccagagtcggaccctcacctccttcctggaactgcctttggccccagaaccatgagacaatccccaccctgagaagctccgatcactgggaggagagagaaagcctccagctttgggattcaggcttcagaagtttttagcagcctttgctcattggagaggtggggaggataagtctataaggaatcctatttccccagctctcccacagagaggacaaaagaagtcttcacacgttgtggaactttcctgcaacttctggatgcagacaagcctcagagcagactgttctggctccagtgaatatcggctgccaagctgtgagcatccagggatccccgtctgcctggctttcctgaagtcagaaggcgccttggtcatactgtgtggggtgtgtggatctcagtttgctctctttctttctccttttttcaacagctggcggagtagccaacacccctgacagcaatgtgttgcacttggctcactccacaccctatgaataattttaatatttaacttgaaatgttgttaagaaactatggaaaatatcaggatcccactgggatcccgtaaattgaaggcaacaaggtcttggtcctccagtaaggggggcatggagccctggtgggaaggaaagaagagaaatttgtgttcctgattccttaatccccaagaaaggtccctctgctaacattcacatatctcttcctagccaaagtctgtccatttcaaccctctagcatctgagctatctgcatccagctttcaaaaatatttcgctgtttactaacatgtctgtcagcctctcttttctcccccgcatgtgttttgtttttaaatccactcaaaagcgttttcatttgaaatcaaatagacatgtttgcaaataaatgttgacacaacacatttgaaagacagaattggggatctgagattaagagtatcagcagagaagagtgggtgtaattctgtggaacaggagtgagaacagaggcgagggagccgttgctttgtgccaggcgccatgctgaggactttccatagacggtttaatgccacccaactactcccattttatagatgaggaaatggaggaaataaagtcacttgcctgagtttgggcagccaggaaggagcagaacccacagttgagccccagcagtttggcttgggaaacgcatgtagagtgcttcttaaagcagagagcctttctcatgattaaactgaaatactagtccctttatagcctgtgcatagtgaggaccatttttctttattcactgagacctacctgcctattgagaagtatgtaaccggtcagcttggagttgccccactgcaggttgggtgatgcattgagggactttttatttttactctggtggtgggggacggggagggaggaagagacggagagggaaagaaagggaagaggtagggagatgaaagagcggggagaggcagaatgggagagggagagaaggagaggggagacggagggaggaagggagagaaaggagaggggtgagggaaaaggggtagggaggagggaggaagagaaaaatggggagagggtgggcgagaaggaaaggaagaaatcgaggaagttggaggaatgagggatgaggcagggagggagaaagggagggcgaagcagtaaggtgctgcaaaggacccttctttttggccataaaaacctgagaaactgattgagattcttttgagcaataaggcaactgcggtgaggaaaaaataaggaaggaggcacaaaaagcaaagcagttcagcctgaaattgactacagagcttccctttgcttcagcagagcctggaggagcaggagggatgggggccctgtcagctggcccaaagccctgccctgtcccaggggtgctaagcttgctgcaggccaggaaacaggcctgggcttgcagctggggatcaggaagtttggggcctctttgcacagcttactggggataggccaagctctgggaactcctttcaattttttttttttttaagacaactctgtttttctccctcctccctactagtggaaatttaccttgcaaaacaggactgtgcatggtgagagctgcttgcaatgtccacactcaggactctatggaaagagttcgcagctggtggtgaggctttgaggtggggctgcccttatttcactagctcctgaggggcagagctcactcagctttttaccaaatcaaaggaaggaagctttaggtccttcgaagttcagaaccagggtggtttgttttgcttccttttggaatggaataaaatgctcatttaattaaattcaagttctctgagggcttttaaaaacagaattcttcatctacctccagctgtggcaggcatgctgcaatttactaggaagttaatctctaacagaaaaaagtactcagtttccttttaaggacattcccgttatccactggagcctagcatcactcgtctgtctccctttgaggttcgagaatttctaaagtgcctggtaaaagtggttaggattatgtctactgaaatataactttaacctctggaaaaacaggcctgcaaaggccaacttcccaaactgctggaagaggagaggtttattagttaacgtatctatccatccatcatccatccatgcctccttccttcctttcatccagccatctatccatccatctttccatccattatccatcatccatgcatccatccacccacccatctgttcttcagtccttccatctttctttccatctgtccatccatcctttcatccattatccatccatccatccacccatctgttcatcagtccttccatctttctttccatctgtccatccatcctttcatccattatccctccatccatccacctatctgttcatcagttcttccatctttccatccatccattcatctttccatccattcatctatccatttattcatacattcagctcttaccctggattttttagttacatgaggcaatacattttttgcttttaaccaattgattcattcaacaaatatttgttgagtttctactctatcactcatcattcattcattcctgtattcatttattaattcagtgtttactgggcaactactctatgccaaactccttagtgttcataaaatgttcataaagtgccatctttgtgggagtaccgcctggaacagggtggtccagggagatctttccagtctcgatgagacccaagagctttcaagagtaagttggaattagacaaagaggatggttattttggaagcgaatgtatgacctggagttggatacaagaactgcatggggcacaatgtacagtgtaataggagcctaaggtgcccacggcacagggacagggaggtaaaccttgacaagtaaaaaatcaaatcaggggctgggcacagtggcttacacctgtaatcccagcactttgggaggccacggtgggtggatcatgaggtcaggagatcaagaccatcctggccaacatggtgaaaccccgtctctactaaaaatacaaaaaaaaaaattacctgggtgtggtggtgcgtgcctgtaatcccagctactttggaggctgacgcacgagaatcgcttgaatctgggaggcggaggttgcagtgagcctagattgcaccatgaccatgcactctatcctggcgacagagtgagactccgtaccaaaaaaaaagggatcaaatcatgaagtgccttgtattttatactgagagcttgagagtttatcttgatgggcgcagtggggtgtctttcggcagaagaatgatgctaggacgtcagtggcttttgactggttagtatcctgtttttttagtaacaaatcttatctttttcctcatggggaaccctttcctcactctcagtttacatgattgggtggggctgatcccattcttcaacgtcagcctgagcactgcatagcccctgtcaaagtgataggttcaagggcgggtgtagaaacccaaactagtccactgagagtcttctttgaacttttttttttttttgagatggaatctctgtcacccaggctggagtgcagtagcacaatcttggctcactgcaacccctgcctcccaggttcaagcgattcttctgcctcagcctcccaagtagctggaattacaggcacccaccaccacgcccagctaatttttgtatttttagtagagacggggttttgccttgttgcccaggctgctcttgaatccctgacttcaggtgatctgccacctcggccttccaaagtgctgggattacaggcgtgagccactgcgcccagccttctttgaacttttaattgaagcaattaggaaaggaaagttcaccttcttttagaattaataaaattgtaggatttggccctggaaactcttaaccactgagaagggactgcttgagaatgaagccacagagcagagtggagcagagtggagagaaggagagacatcgtcctgatcaacttgtttgggcaactggatccagccatgccagaataattcttcccctagaagattcacaagccaataaactcactctttttgtttgtttgtttacagtggtttgaatttggtttctgtcattttcagagagatctgagtaaatcagatccacttagatttgtatattaggtagagcaccctggtaactgtttagaggatggagttgggagggataaagctagaagcatgaataccaattagaaggcaacctaggaaaaaaaaagcatacaaggaggggcaggtttaaagggaagatgaggggttgagttttaggggtgttgagtttgaggtgcccataggacaaaatgtaaataatgattgcaaacacttatatcactcttaccatgtctgagcattgttccaaatgcaatacatatagaactcatttaatcctcaccatcacactgtgctcattttatagattaaaacacagggagttttaatccattcactgatcccaacttgctccttggctgtaaattcccacatttccttgttgtattctgaattaagcccaatctctctcccctacaataaaaccccgttgttgtacagggggtgcagggggggtgtgatggttaattttatgtgtcaagactgggcgcagtggctcacacctgtaatcccagcactttgggaggccgaggtgggcggatcacttgaggtctggagttcgagaccagcctggccaacatggcaaaacctcgtctctactaaaaatacaaaaattgtccaggtgtggtggcacgtgcctgtaattccagctactactcgggaggctgaggcaggagaattgcttgaaactgggaggcagaggttgcagtgagcctaggtcacatcactgcattccagcctaggtgacagagtgaggctctgtctcaaaaaaataaatagataaataaaattatgtgtcagtttaacttggctaagggatgcccagatagctggtaaaacattatttctgggtgtgcctgggagcgtgtttctggaagagattagcgttttaatcagtagactgtgtcaagaagacccactgtcgttaatctaatctgttgaaggtctgaatacagcaacaaggtagagaattctctctcttttcttgagctgggacatccatcttctcttgtcctcagacgttggagctcctggttctgggattttcagactccaggacttagaccagtggcctctctggttctcatgccttccgcctcagactgaattacaccactggctttcctgggtctccagcataccaatggcataacatgggacttcttggcctccataataatgtgaaccaattcccataataaatctccccttatatatctcgatatattctgttggttctgtttctctggaggaccctgactaatatagggggttaactagttcttccagctctcaaggacacagctggggcttgcactaggcagtttgcctttagaggctgagacttgaggaattcatttgggaattgtgggaacccttttggacctccagggttgctgtaaagtttattttaaggtgaaaatatttgacctgcaaaaggtgtagaaataactcttatctgaacttcccttatctgacaaaagcagagcctcccaaaattacagctccattaaccccactctgggggagtttactgcagatttagctgccaagaaggcagattgcccatttattagcaacaaaaagcccactaggaccttccacactccctcattgaagccctaaaaacctctctcttttgttaagttgataatacaaacttttcctttgggctatcccatgagttttctattatggaaactccgatatgcaagtaggaaaaaaaatccttgttaactggtcctttctcagttaaatttgtgggcctcaaactgctgaacccaacatggaagaggaagaattttcctcccaacagagtcatcagaacacagcggcagctaaagcccttgttgtaagggaagaagctgaggcacaaaatataattttaaagcatttgaggccaggcgcagtggctcacgcctgtaatcccagcactttgggaggccgaggtgggtggatcatgaggtcaggagatcaagaccatcctggccaacatggtgaaaccccatctctattaaaaatacaaaaattatctgggtgtggtggcgtgtgcctgtaatcccagctactcaggaggctgaggcacaagaatcccttgaacacaggaggcagaggttgcagtgagctgagatcgtgccactgcattccagcctggtgacagagcaagactccatctcaaaaaaaaaaaatttgatgaagccaacgtgaggacagctgcccgggaaacactttcaacttggcttgggcagtgttccattcagcccaggttacagtcaggtttcaaaaggcaaaagggaacaaggggtgggcggatacaaagttgtctgacaggaattctcattggcttaggaaataacattgattagtgattagctttaaatgttgaactacagggtatgagttttggtgtctagcctacggcactgtgtggttaattttatggctgcttggcatcaatctagagcccacatagcaagtggttccaagaggtggttacttgattcaaggcaggagtgagaggtgactgccaccacacttcagtgccctctgggtctgataatttggaggggctggcattcctcaggtacagtagataaggtgcctgcattctctccccacacacatataccctgaggggaggcactgcttggagcagaaaagcatctatcaaggacaaaactctggaaaaaccaacatgtaaagggcaggtggagtagataagctgcaaaggagccagcgatggactggggcttggattgatgggagacggtgaccaatggcttctgctcacggaacattcaccaagtgccaggcattgagctcaaagatgctttataaatgctatctaatttgctcctcacaaaaggtctaccaggaaggtaaaattcataccttacgggtgagacagcacatttatgaaggttgcatgaattgcccaagttaacatagctagttagtggcagaataggaatttgagctctaaagaccagggttttaaccacagcagcgcattgaatagtctcctcccaaacttcgtgtccacctgggacctttgaatgtgacctaatttggaaatagggtttgaagatgtagccaagttaatatgtggtcatgctggattagagtgagccctaaatccaatgactggtgtcttttttttttttttttagaaagggtctcactctgtcacacaggctggagtgcagtggtgtgatcacagctcactgcagctccaaactcctaggcacaagtcatcctcccacctcagccttccaagtggctaaaactacaggcatgtgccaccatgcctggctaatttttaattatttttttgggaggtggggtctcactatgttgcccaggctggtctcaaattcctggggtcaagtgatcctcctgcctcagcctcctaaaatgctgatattatgggtgtgagccaccacacctggctgactggtgtcttcatgagagaaatgggaggatttggacacagagacatagaggaagaagaccatgagaagatggaggcagagatgggagttatgctgctacaagccaaagaacagctataacaaagactcctttgacctaattctggtcgcactcctctaagccctcaaggccctgacctttggtctccgcatctggcatgtgtagtctagttcagctggatcagtttagtgaaaatcccccattcttgatatctctctcaatatcttaccctggcctgccttcatcaagaatctgctgagtcagtctagcaagaatacccctttatctctgatgtttcctctcagtgatttttccattcaccaatccccaacttgctccttggctgtaaattcccacatttccttgttgtattctgagttgagtccaatctttctcccctacagccaaatcccattgtagtagtccccccgaataaagtctgccttaccatctttaacaagtgtcatgaaaattctttctttaacacacag

SEQ ID NO: 1133 - DNA, 9499 bp, Homo sapiens; identical to SEQ ID NO: 1132

SEQ ID NO: 1134 - DNA, 9499 bp, Homo sapiens; identical to SEQ ID NO: 1132

SEQ ID NO: 1135 - DNA, 9499 bp, Homo sapiens; identical to SEQ ID NO: 1132

SEQ ID NO: 1136 - DNA, 9499 bp, Homo sapiens; identical to SEQ ID NO: 1132

SEQ ID NO: 1137 - DNA, 9499 bp, Homo sapiens; identical to SEQ ID NO: 1132

SEQ ID NO: 1138 - DNA, 9499 bp, Homo sapiens; identical to SEQ ID NO: 1132

SEQ ID NO: 1139 - DNA, 677 bp, Homo sapiens
cccaccccagccacctcttcacctgccccaatcactccttccgcagggccaagtctctaactaaggacagcccatataccccagagcccactaaaaccagcctaccctgagcctgcctgctctgccttgcccacaccttccagcatgcgccacaataagggcccccgcccacaggtccagcctctctggcgacctcccgactcgctctggagctcccctgtgtgccccctccccacgtggcacagcatgtcctctcctcttggaaaccaggagtttgaaattcttgcttcaggccatatggagtggatattccttccagaaggaaattacagaccactctctgtttctactcaactgcttttcactccaggatgcttcacctcttggggccttccccagcagaggcccaggatcacctgcaaaaggcttccccaagggtggggccagaagcagggctgcagatatgtgtcctgaacctcccatggaccctgctggctcccttcaaaggcttcgggcatagcgacttgcctttccgtcttgttcagtcgtcaccagtcagccgtctgcagacttctctccctcacgttgtggcagaggagttgtacattctctagattttaaaaatatataagttactttttctttaaaataaaaattgtctctgaaataagctccca

(The sequence listing continues in the following parts.)

We claim:

1. A method of detecting a non-coding RNA in a subject, comprising
   (a) contacting a biological sample comprising a prostate cancer cell or tissue from a subject with a gene expression detection assay, wherein said gene expression detection assay comprises a gene expression informative reagent for identification of the level of expression of SEQ ID NOs: 1710, 1277, and 614; and
   (b) detecting the level of expression of said non-coding in said sample using an in vitro assay.

2. The method of claim 1, wherein the sample is selected from the group consisting of tissue, blood, plasma, and serum.

3. The method of claim 1, wherein detection is carried out utilizing a method selected from the group consisting of a sequencing technique, a nucleic acid hybridization technique, and a nucleic acid amplification technique.

4. The method of claim 3, wherein the nucleic acid amplification technique is selected from the group consisting of polymerase chain reaction, reverse transcription polymerase chain reaction, transcription-mediated amplification, ligase chain reaction, strand displacement amplification, and nucleic acid sequence based amplification.

5. The method of claim 1, wherein said reagent is selected from the group consisting of a pair of amplification oligonucleotides, a sequencing primer, and an oligonucleotide probe.

6. The method of claim 5, wherein said reagent comprises one or more labels.

7. The method of claim 1, further comprising detecting two or more additional non-coding RNAs.

8. The method of claim 1, further comprising detecting ten or more additional non-coding RNAs.

9. The method of claim 1, further comprising detecting one hundred or more additional non-coding RNAs.

10. The method of claim 1, wherein said non-coding RNAs are converted to cDNA prior to or during detection.

11. The method of claim 1, wherein said method further comprises detecting SEQ ID NO: 347.

12. The method of claim 1, wherein said method further comprises the step administering a treatment for a prostate cancer to said subject based on said detecting the level of expression, wherein said treatment is an siRNA or an antisense oligonucleotide that blocks the expression or function of said non-coding RNA when expression of said non-coding RNA is present in said sample.

* * * * *